United States Patent 11,549,145 (METHODS AND COMPOSITIONS FOR INHIBITING AND TREATING NEUROLOGICAL CONDITIONS) - sequence listing, part 134

SEQ ID NO: 2434 - DNA, 493615 bp, Homo sapiens
caccaacaatgcaacaacaaactcccaaattttccaatagaggacacgtataggattttgctttgatgttacacatagatgatgcagcattcacacacgtttaaggatctgacaccctgacatgcagccagtgggtgccttaggagtctgcgccttagtgttatgccatggaacaggcccagctaatgtttgtctgattttatagctgaccctacgttactgtaattgagggcagggctcatgttttggcagggtctggagtttaactatgcagatttggtttttagaaggtcataacaggcggtgtgtgctgccagataccagccaaagtagtagaaactggattccaatgatataccacagggagggatttaatccagaaacaccaccacagtcagtataatcctcctgttgttaaaaaaaaaagaaaagaacagaaaaagaaaaatctaaaaatcttgaaaaatatttagtaacacatctttcagagtaatccatatttagttcactttctgaacttaccttataaaactgctgtaattgaaatccaaagaaattactttctcctagattttatcattgaggaatttccctagcatcatttgacaaatgctttaaatttttagttgtagcttttgatgattatgaaagaaaataataaatgctgtttgaataatatactaattttaaagaaaaaactttcacagtatcaaaaatcctatatatttataaatgcaagaaataaatgtaaaatttaatagtaggttttataattcccaagaattatgattttagcaactatgctccatatggtaaagttggggactggtaaaataaatacatttccatttcccatatttcttatacaatttataaggctcaacatagagtgcaatcatagcatctggaccttcatcaagaattaaagtaaaatgggaataatgtatttgaaccattgtttatgttggttcaaatacattatttggacacatataggattttgctttgcaaatatatatccaaaatagagagctaagctaggaagagatttgtcttgagacaaccaagaaatattagaatgaatatactcccattaactccccacagtctagtggtagctcatttagttccctcttaatgcaaaagtattattcatcttttattcctaggttctatatttgataacattgtccacatcctttaattccttttaacatagtgaatttcatttttaaaaacctccttattatttttaaattttatttcaatagattttggggaacaggtggttttggttacatggataattctttagtggtgatttctgagattttggtgcacctgtcacccaagcaatgtacaatgcaccgaatgtatgtagtactttatcccttactcccattcctcccaagtccccaaagtccattatatcattcttatgcctctgcatccttatagcttagctcccacttagaagttagaacatacaatatttggttttccattcatgagttacttcccttagaaaaatggtctccaactccatctaggttgctgcaaatgccattatttcattcctttttatggctgaggtgtattccatgttgtatatataccacattttctttaatcattggttgatggacatttaggttggttccacatttttgcaattttgaattgtgctgctataaacatgcatgcgcaagtgtctttttcataaaatgacttcttttcctcagggtagatacacagcagtgggactactggatcaaatggtagttctacttttcattctttaaggaatcaccatactgttttccatagtggttgtattagcttacattcccaccagcagtgtacaaagtgttttttttttttttttttttttaaccacatccattatttttttattatggccattagtgcaggagtaaggtggtatcacattgtggttttaacatgcatttccctgataattagtgatgttgagcaatttttcatatgttttggccatttgtatatcattttttgagaactgtctattcatgttttttgcccactttctgatgggattatttgaaagaccatatatttaaacatctttaaagaatctgctaatccaaggtagatgttctaagaatcaaaataataggttgaacaattttctttcaggataattttacaaagattctaagctcccaaagaataagaactttggctctttttgttcaccaggatttaatacagtgctgccacacagtaaataaaattatttctttaattgtattttaaggcagcagaactattttgttaagaagaaagaaagctgggagaaaagaatctatgaaaaaattttagtttcaatcaatttacatcccaaatctaaatagaatcataaaataatcaattcttagtcttcatcctctttgacctttcagaagcatttgacaaatatatgacattgtctccttgaaatacgttctcatgtacctttggctaatgtactcttctggtttttcttgaaacttgtttgtgtctctctccttggcttgacctcctttctttcatgctctctaaaatgttagacttttccaggtgttacttctctctcctttcttcttcttcctttacactttgttcctagatgatctaatccccagtcctatggctttaatttcatccgtttcctaataactcactcttttgtatgttcaatcctgtattctcctctggtctgtgtattcattgatctctacctttctcctcttgtatgtctcatagggatttcaaacttgacttgccttgcccctaatataattcttctggtatcagtaaatatctggtaccagtaaatagcatggcatgatcttgacctccctgggctcaggtggtcctcccacctcagcctcccaagtagctgggactatagatgtgcaccaccacacctgtctaattttttatattttttgcagagtgggggtttcagctgggaatccatcctctaactctaccttcaaaatacatccccaaacttactgcttgtcactactgcaggtccaagtcaccattacttcttgcttccacttttgcaaaagctgtctcacttgtcccatggcttctactctgcccttttataaacgcttctccaaaaagcagtcttcttaacaccacacattctttcactccctgcttgacatttctcatcattctcagagcaaaatctacattctttattgaggtctacaaagccttatgaggtctggagcctggctgtctcatcttcccaccttctcctctcccgcctactcactctgcttcagtaacactggctttctctgcaacaggccaagctgtttactgcctttgcatttgttctttttgttcagatgcttttctctccaggtagggtaaacagataaaaaacagggtaccagtaacaattgaatatcagattaaaaaaaaaacaaatactttatataaatgtatttcatacacagaagagtggctagatacatagcaacgatttgataaatgaagagtaggtactcaataaagcagcacacatggactggttagaaacactatgaggtattaacttaaagaagtcattgtcacttaaacaggagtactccccagttatgattaagtgttaatttgaataaaaattaccacacaagacccatttgtgtattaataacatattttgtcatctttatactctacaaatgtgttatggaaagaaaaatattctctttggcccttatttcactgtttttatttttatatataatttttgtttaatttcctctgtgtgatgatgagatatgtctgtttctatttgggaggtggtagtttagataagttatttgggctccctgtggtgtgcatgtcagttcacactgaaaaatgtgtcttttaagtttcctgatcatgtcttcccaagcattttgcatggtgcaagtccatgtaatgtatttcatagaatcatttcaagtcttattatggcatacattctacacaaatgcactgatgtgggaggaactcagcattatttctgtcctatagagactgaaatcccactgacaccatgaccagatataataaatcggtctgatttttaaatgattatttaagtagaaaataacagattggtactttcagtttagaacattaaaatggaaaaagaatgcagtgccaatattatatatatatttattttaaaatatgataaaactaattttattagacttccttataggggaacctcccttaaaagactgtgttattaaagatatcaactaagaattctttattcctttctcattactctttaaaaaatctaaaccatagtaaaattcatatggtttttgccccaaagttttcttcatacagcatgcgttaccagtggctaaaatcttttgaagttactgttgctaaactcttactctgcctttctttccccattcagaacctgggacaactaattgcatacagtacaagcttaataatttttaatttattaaatttagaagtacatgtttcaaaagaaaatgttctggtcatttggctaaaaggtttttgatctttttttctgaattatagccatcatttaatttccttcaaaatgcaaatcgctggtgaagacagccatcaaatcatggactaacttttgaattcaggtaagtctgtactaaagttaccaccagcaactttgaagacaatctatatttaaaaatttttaggcatgtagatactgcataataataggaataatgcccctagcaaataatttgttctccgacatgtcaccttaacactcttacacattaactcgtgagataggtaggtagtagtatatttattcaactctttaaatgtagacagattatgtacccaataatatgctttataaattgggtttgcataaaataataaatttctcaatggacagaattggcttgctttacttctttgattaataaatgttagctttttgagtcttcataaacttgttatcaaaaagtcttgtttgaacacttgagttctgatgaagtcctcatggtatggagcttcataactgtttttgtataatctatatccttccggactctaccgggtataagggccccttggtaggctttggagattatactaccattctaccttgcttgtgagcagaacctaatccaacagaaattgctagttttagccagactacattggagcatagaccataacctttatggtccttaatgtgggaaacaactgccaactaacatttcagtattttttgtaatgatttttttcaacttaattgtttcagagaaaataatacttcctttgatatcattatatcaacattcaaatagcactaagtggattcactgttctatacagataactgtgtttttaaatactgaaagcatattttgttaatgtaaaatatacatcatcgatattatgtattcctttgatacaataatataaaggaatctcaaatgttttctttttggagatcagaaggatatagattatacttctacaattatgaagctccataccatgaggacttcatcaaaactcaagcaaatgaaaaagctaacatttattaatcaaagaagtaaagcaagtcaataattgtccattgagaaatttattattttatgcaaacacaatttataaagcatattatctggtacataaatatcctagttgagtccatggtgatatataattattgccatgatagatttataattatagttcaaggaaagtaccataataggaaaatgttattttggtgggggggggggggggtggtggtcttaggttaaaaagattttaaagtcactgttgctatatatatatatatatatattttttttttttttttttttttttggaaatggagtctagctctgtgatctaggctggagtgcagtggcacaatctcagcttactgcaacttccacctcctaggctcaagcaattctcctgcctcagcctctggcgtagctgggaccaccatgcccagctaatttttgtattttagtagagatggggtttcaccaggttgcccaggctggtctcgaactcctgacctcaggtgatgcacccacctcggcctcccaaagtgctgggattataggcttgaaccactgcacccagccgttgctataagtttttaagagaaaggtaaaaagagagctggcctactcaagagcaatacttacatattttttagtgtaactgataacctataaatcttatctaaaaattctatgattgacagaagtaagcttttgaatcaaaagggaaaataaggacaattatagaaatataatttgattacacttttcttgtgtaatggttgactacctatgaacttctttcaggaattaataataattcaaataattgcctatatatcaatttttaaaatgtgtatatgaagatattaaagcaacgtttccttactttggcgtcttttgccatgaaaactattcttttattatgccagaagacttgtggttattttctgagactccctctgctattctactccccaccctctatcacccctgcctgtgaattcactccattcatagtaatggccacatctccatctagtggcttcctaatcaatgactacttggaaaccaatgacaaacacaacgaaagtgcgtgctctagtaatacatcatgatgattccagagcattagaaaagaaattgcaaaacagtaaatgaagaactaaatgcaaatccaagacccaaaacatctctttagtagtattgaatagagaactcagaaatttcttaaaaggttaattaataattttgggctagataatgtatattaaataaaatgaacttagaaactagaagcacttattctaaaatatttcaataagaatattttgagagtaaaaaatctaaaaagttatttaagtcagatttattttaaaaagtagaaaaatctgaaaggaattgaaagagtgcattaaatttgtgttagcatcttttgtaaataaattgagataaccacctctaaaaattgtcattaggtagttctcataaaataccatgaagcctgtatatctgtctctgtaatgacaatttttacacaaaaactttatgaaaaatgatttttacataaatattgaatatgtttcatttaggattagaaatgtacatgccatttgaaatcagctatttacaaaacaacaacattggtcctgagattttaataacctggtttcaggaacattaatatcgcagatttaggaatatgggtgattttctagaatttcaagccaaaaacaaaaactaagaaaaattagagaaagtgactgaccatccacaccacatgaaaacttgcagtaaaatgaagataggagctgacatcatggtacaggcacgactcgttgtgcacttaagttgatcctattaataacgggcaaagtagcaagtataggaaaaggaaagaaaacacagaagacatacaagatgagatttcatgcaatttgctggcagttaacgtgagtctccatccagagcagattcacagtgaccattgcaaataagcattaccaaaataactccactgctaaagaaacacaagatattattagcacaccaagctactgagcaacagttgtactttcacacacaacccatttataggagcttcaattgctgaacatttttgtcttggtcaaatccttttaatggcttgatcataagatatagcctcctagaataatattttgggcaataggcttttaagtcacttttcaagttcatctgaatttaatatttctagtgtcaaaaaactggtgacaaatagttgatgagcgaagtttctctaatgagtgacatgacccttggcccttcataaaacattctttgggggaataattttacatgggcaacgtgctgaagttgcagtagacagaataacaggagtccgcctatctggacttaatatatcttaaaaagaaaaaaaaaacgcttagttgcaatgttgaattactctccctagcaaggatcaataatccctcacagagataactgggattgactggctaatacatctttcatttttagtccccattactgattttattacttctttgtgctatttttaatttatattatctaattgcataatattatctgtgaaaatgttttgtcctttctgggacaaatgcagctatgtatttgagtaggtaaactaaataactcaaataatttatgagataatgctttacaagtttggatattcattggtgtgtgcacacactgaagaatcagaattaggaagtattgtatttaaaattagttaaaaagaggtagacagagatttttatgtagacttcatctttgagaatagattaatatttcttaagaattttaaaagcataaagctaatgtagtacatactgatgacatattacctaccttgtatataatcaatacacagtaaatcagaatagtatttattagagaaagatagctgaactataggaaaagtagtaagccatctttaagtgacatatattaaatatgatttgtaatattttatcaaaccctatgtaattgacctggtctagtttcaaacactagaaaaagaaattagtacaattaaaggaaataatagaagtctaatatgtgatagcatcagaaaccatccaaaagaaactagaactctgtaataataagacaatggctgtataacaggtttttcaattcacactagaactctgtaataataagacaatggctgtataacaggtttttcaattcactgaagacaaatataactaacaaaaatataataaaattaacttttatatcttcaggattggaatataaatggaggcaacaaatataccataattaacatttactatgagttaaattgattggaattgtgtttgaaagcacaatttctgtgggaaggacatataaaagaagcaactgtcaagtttatgctaaccatgaaaactactgaaatgaaaaaaatctaccagcaagtatgtcatgttaatgagaaaaactatggttaagacattacgtttgagttaaaattgcaatttgtatccttgaattcttgcggacagtgaccattaatttatagtattttaatccagtagaagtgtgatcttaccaagacattgttatcaaagcagacatcaggcccttttcggtatctgggttgcttaaccatgtcacaaggatttggaccgtcagctaaaagagacttgttaaggaatctcatgttagtttttttcacatgattaaaaataaatacaatgcaatgtatttcccaaaacatgtgagagagataacttatacatcattactctcatccaacacaattcaagtacatagggatttaaagaactaaattgtgaattatccttttctggggcatgtgtagcataattattcttgacattccaaccaaattttgagtgaggaatcgattctgcctttgcgaggtgatcagagcagtctaatagttttctctttatgaatataaacaatgtgacaagattcaaaatgcattaagatggttttcctttccagatagctctgatgtcaaaggatacaagtctgctccgcttgtatgagcagtcgtgtgtcacatggacatgtccctttgctctcaaccattatgaatattaagttggtgttcataagcttttctccatgaaagattctgcaaaataaatatggtatcatagaaaatgagtatcttttccaaaataaatggaaatctttcaaagattcttacatattaaaatgaaagacaaaatatgacatctgaaacagaaaccattcccagcacaataggagtatgattttagaagaaaaaaatgcttcatttattagcatgaacgtattacctatgtcaaatgaataaaaaaattgcaatatatgttttatgtgtgaccattttaaagtattaatcctcattgcaaaataagcacaatttagttgttgatgtacatagaaaaaagtttttctttacacatacaaagaattgtgatgcttatgccaaagttgccttattttacagataacacaacagggaatacaaaaatgtctaggcatcttgcccaacctaagggcagagaaaagtctggaacagtgctattaagcaaactttctgtgaagatggaaaagttgttcgcactgtccaatatggtaaatactagccactcgagggtattgggcacttaaaatgtgacaagtgtgactgaggcacaaaattttaattctaattaatttaactgtaattgaaatttcaatagccacctataggtggtaactactgcactgggcaacacagacatggacagaatcaagggttttgaattccatcccctgttttgtccacaccttaagctgctcttactttagtaaccaacataaaaaatgtaaatatatcactaaaaaagtaatttctttatcattatacattttgcagaaaagtgggattttctttttgccctgttaagctttgatttccataaagcaaatcaaaaggaaagtatgatgcaatttaacatcttggttatactgaccttcttcactttacaatttaacttacttctttaagcacaccaattgctcttgctggatgtcaattaataaaaggccaatgtctgtgaaactctgatgtatccaataaacatgccacaatcccatttcctgaagtccatagcctgatatgctaatctcctctaaacaagacagtctgctttttttctgagttcatgcttgactcttccttccctttcctctcctctttatatactctacctcctccttggagatagaggtctgctaaagaaagtcataaaacatactgaccacgtctcctaaaaattcatgataggttgcttagcccctcttgcaaaatttttttttttaactattctggcactttcataatctcagattacctcacctcctcctatttcttcttccgctatggtaacatttcttctagaataatcttccctccacctctaaaaacaaagtgtctctactctgtgctttgtaagctgtgacttgctgctctcctctcaggaatcctgtggcattaattattactttcccctcaaaatccccatcttgcctttctcctctaccctcattacaacaaaattaaattctccatctctttttaaaagatattttatggatactgactaacattaaccatgacctaaaaaaactgtatttttcccagttccttcaaattcaaataaagataacattcagttcttcaagtcagagaagactagaagtaaaaacaaaacaaaacaagactttttttttgtaaatctgtttagttactatatagaaaaataaataatatttggcttagaattatttaaattactaatatatttaataactttatattagaaatttttaatatgggttattttaggaaaaaaagttaaaatataatcaaatttctctatgttctgcctaaagagaaaggaattatcttgatcatgtaattattatagttgaagaaataacagcttatcaaagttagaattttaaaaattacaaattttaaaagtctacagagaaactaaagattgctgacattttcagcttaaaacaattactcacatctctgactccaacacaattttcagttttttctgtaatgattataacagtatatacaatttcttaatgattataacagtatatacaatttcttaatgaaataggactactcctgaaataaataaattacctggaacagtttccacagtctaatacaccactgaatgatttactgtcgttatcgaagaaatactgggtttgttcagtaatgcagctctgcttggacagggaggccgtgaagtcatcatcctccatctcaacttgggtggcgggggacggtgtaaaaacaaagaacaccattaggaggggtctctgtagtcactcccctcgagtcttcacttctcacagagcaaaataaacgtataagaccaggacccctcgactggcttgtttactgctgtgtaatatcgtggcagcccgtaatagatgcctgataaatatcaagagaataaatgaattcaaatacaagatggctatgagatcaggcccgtgtgacctaggtaatttctaaaacattaggaaaggttggacaaaaagtttctagctctaaaattatgagatgggtgacctgttttctctttcacacaaatattctctgaatttgttgaacttcaagcacatcccaaaagaaaatttttattgttatggcaatgacaaggtctgagcatttacatacctgcctcaaggagtcgtggaaaggtcaaactcaagagaaactgctgtagaatagacctgaatttttcaaataaaaaaaaaataaacatctagggaaaaaatgtgtttttacatgtacccatacacataaatactgtttccctttatctttttgggaaagaaagtcttggagtgtttttatttaagtattttcaaaattatataacacattgtaacctttttgtaatgtgtaaaagaagtcatgaaatcagaagtgttcagatcttgttcaggatcaagtgggacacaatgtgtgaagaaacctaacaggcaatgttatcaagcagaagagttcactctaagagggagaatgtctgtttcagcgcgtaggttttcacattcattacgtctccttattttagtttttaaaaccatttgttttttgggtttcccccgcccccaacaaagaaacaatgctgtttataccatgggtttgaatttgttaactatttactttgtaatatagaatatatttgtaaatatgtaatgtaactttcatgaaacaaaatatacatattagagagatacagcacatttcagttttacagtaactgacaactgagccaaatttctagaactgaatttagtttaaaaaaaagtgggggtgggaggggatataggataaagccaagtatttcagggtcatgatgaaattttaaaagcctactgaaattaatatataaaatcacatcagaaaataccatttttcagaataaaacagaattttctaaatcttttaaaaactctcaaaattttaaaatcttttttgctgctttaatgatatagtcacttaattttagctgggcaaacctcaacatcaaatgaatattgtacattaatctacatggaatagggctaacaatacagtgtgatgatacaaaaaaaaagattagaagggagagagggaagagggagatcatggattccagacgtaacaggaggtttagttacaactaaacaatgagaaatgtgatcttccagaccttccacagtgccacaattgaccatttaaatgtcttattttcataggttgtagggtctacaggtgagggttgagggaggtttggaaggtagcatcagtgaaaagaaataattagatccatgtcggcaacctgatgcccctaaaacaatactagtccttgtatcaatagtaaagaggtagaaggttgccatcatgccatgaatttgatgcatgtagacatccaactgggatattaaagacaaattgtaacttcttacagatcaatacacctaaaagaaattagtgtaatgtttttataaatatttaatacaaatgaaaagagtttcaatagatatgtagaggaaggaagactctaaagaggctgaagtttacatccgcataacattgttttcatatgagaaactgaataatggtaactttatagtgttcacttaggaaaaactataaatattaccaataggtgatgtaaagaatgaaaacaacttaactcccttaataaaaatttgaatatcccctaaatccatattttcatcagatgcttttttattttacaacttctttctttcattaccaataaaactaaaattttgacttaccaggcagcagcagtggcccaccagccaatttgtaatatgtctgctactgatggctataaaataaaataataaggtcatttcagtagtctacttgatactgaggacacttgagtaccccttgagaattgattagaccgtggatattactgaccacatatgctgagcgatgtcctgctccttgttttggtgcagcaccgggctcacatactgactgataatcataagatttgttaaaagcataaactgatatattaaccaggtgtctcatcaagctgggatcaatctctccaaaaaatcttccaatctggtgaagaaaaaaatcataaagcaacgtgcacttaaaatgtaagccaaaaatgaacacgggaatcaccactacagtgaaaagaaataatacaaagaaactgaactacaactgaggagcttaaaaacaaaagcaaatgagaaacgtgtatatgacactgtgaacaaactaaaatgagagtaagtgttctcattactcagtggggctgtgtgatattttatttgtggaaagaatggacacacattactaagcattaaatcacaatcaaatgcttcccagatgaataaaacagggccggggaatggagaggtataagtggaagggtacaaagaagcagttatgtagaatgcataagcctagagattcaacatacaacagaggactgtagttaataatactgtgttgtctaccagaaatttgatgagagtagattttaagtcttcttaccataccgcaaaaaaggttaacaacctgagatgatggatatgttaattggcttgacgcagtaatcacttaactatgcaaatcaaagcttttttttgtacaccttaaacatatacaataaaaaaaagatcaaatgcccccctggggaatggaaaagtggcataaatgagagagcaggctggcctagaaaacgaacttgtaggggctgtgatgaactggaacaagtcccatctaaaggggcaatcatgagtgaatcagctccaccccataaatcctgtcatccagaaaaaaaacaaacaaagcccagggttgagatatttttgctttgttttttcaaaagaaagaagccaggaatgcagattcagaagtgaaattagttggcatctacttcaaatttgttaaaaatagcctatgtgctgctcatttgcaggtttgagactagaaatcacatcagttttaacaagctatatattaaattagataccatcaactgacaaatgttgaagtgaaagttttctaaatatcagaaagattaaaagttcatgtcatgctaaaatccttaactgtatgttttaatgataccagtactaaaatgtaaaatcaaataacataaaaactagacttagcatgcatttcttaatggtttacataacattaagcattttacaaattattgtatgacagaaataaaacaactcatcgatttctaaaacactgaaagaggttttgtaatgttgatccgggaaacacactttggaaagcctaattccctcttatttgaggtacatacctgattagtataatcatcatgatttgccatcagaagaaacccaccatcatccagaatcacacaatccattacctatcaaaataaagtgaacagttaacacatttttagaaaggttaggaggctgcattgtctttaccccattatatacatgattagagcaataaaaatagaaaattttaaatgcctatcttctcttgaacatatatgttcattaaattctggtgaaataaaggcatgcatagatttatatcaaaccatcaggcttgataatccaacaccaaccatccacttgagactgtcaattcagtctgaacaaatcagaagagcaaattagaaataatctttttaccatttccgggtcatctaaatgatccagaaaactggatagagaaaattatttaataatgagtaactgatttaaacacatacttaggattttgacaaaaagatattttaaaaaaatatcattttagttgtcctgtttcacagacttaaaacacatcagtactataagactatttataattatttcatattttagattaaaaatatgtagttggataattggagatttaaaagcaaaacgcaaaacaaaaaatgtccatggttaatacttacttcaccctgaaacacaggataaattcccacctagtttaaatcatgttttaatgtatgaaaatcaatataataatttgtattgaataaaaatcacaaataaaaacatggttttcaaagttgaggatgtaatgcattgcattttcctaatgtggaagcagtttattactaaaatatttgctcttaaaacagctactgcatagtctatgtgaaatagataagttacaaaaatcattaaaattattggctcataatttcacaggagtaggagtgataaagacgatatgaaccccctgcttcccttggagatatacagacacacaaaagaggactggaagaaaatattgtttcatcattgttattcaatttttagaattatttatctagtatcattcttagagcatcttcaacttttgaacaaagttcacatttcctttttcaatttctcaaacagaagtgaaagtaatacaagacaccttaaaactcaatccatgtaactataactttataataaactgtaatacttccaggtttagttaaaacatttttcctgtaactatataatacagtgtgaacaaatttagagaaagtgtgataggtgagagaaaactgcattgataaccaatagggttgctttggttagaaacttcctatccagaaatagagctaaagataaatatgtacaaaagaatgtaacacagttgagaccgaagagaaccatcatattgacatgaccatttttttaccttccaaggatacatacatatttttaaaaattcaagcactttacattcaaaatcaaaagcatacaaattcaaatgaatatattatttcacatttccatagaattttttagcctttgattaaaaaattcctgcatattttttcatcactatagtcttagcaagagtaacacaaggaaatattgtactcaaaagtgattttaaatagttttcttacgtcactgtttcttttgcagtcacaaactggaccagcacactgaaagacaaaaatgcgattatcacctcacttttaaaagttggattttaattatattattaccatgttataattagaaattctgaaataatttatccagtagaaaaataagattaaacagtctagtctataagaaacaaaagttttatcttattagacaatgtcaatcaatatataaactagcattgcatgttataaccttgaaatacttctattacatattgactaatttaaacaaaaaaagctttgaaaaaataggaattcagaattctacttcagtgtagtggtattgagaatgtatttgccactgtataaggaccttatatttttttctattgaattttgaaaacattaaacatagcataagaattttttaaaaatatcttaccggatctctgattgaggttttggtgaaattctctatccaggaatttacatcaattttaattccaacaactgaaaaattaatttgaattaattcaaaggtataattagatgtaatacaacctttgcaatatgacagttattttgatagcaagtatcagactatagtttattacagaagttttagttttgtgttcattaagaaataatgctaatagctcttaaactattacataaattgtaacatattcacaaaagagtgtattcattagccacaacctgaccaattaactaatacaataagctaaataaaaaacagtagtgtcaggagagcctcataaacttgaggtcattcaaacggtatattttaagatgtttccctaaccccaccagtgcttgcagtaggtgcttaataaatctttgctgaaagagtgaacagatgaatggatgagtaggtgggttagtaggagagtgggtgaataaatgaatggctgagagaataactgatttagtaagtaattgagcaattgagtgaatgaaggaataggtaagtgagttagtgagtaagtgatggagtgaattcatgtaatagatccgctgatggggtaaagctgtcctcaggagcaggaaggctcaaaatactctcctttaaaacttcaaacactgaatcatacaatcaaaaaaactaatagcttttactttattgtattcactcactctagcccacttccgatcctcattaatgctcacttttactatgtttgtttacttgcctatttttccaaaaagtcatttttctatatattttatagcaagtttttaactgagccctacctaattcactttaacagacgcctactagaatatagtataaatatgccatatttatcttttccctcagggctggaaacttaacttttttgtacaaatatgtaactccttggccatataactttgtacgtattttaaagtattaagagagacttctggaggtgggttgctaatccaacattaaaaattttgattattatactaaattgattccatcaatttgtgtcagagtataaacatacacactgttttgaaaattcctcaaatctatgtagtatcaatttgattttatcccaacttcagaggtaactagtcatattttatttaatttttttaagtgtgcatgcctttattttgtttgacaccttttgatgaccttcttgataaacattgccagtttataatataaatgccaagtaacatttaattttgattgtgtttttgtatttaatatttatccttacctgcaggtttaagaagtttcccttgaatatatatttctacagctttgcttaccataatgcccgattcataggcaccaggtccactttctaaaaaaaaaataaataaataaaacacctatcaagatatattgaataataatattgattttccgtcattagatacaaatggatagtattttgcttaaaaattctagcatctacaaactataaaatgtttgtgctctccttcctctcttcttccgttgtatacactaggctaactggtatatccatgaattggtttgtattaattgattcggggacattaattagcttggttgcatctgctttcacaacataatgaatacatgccaaatctctacttcacaacatttgttaaaatattaagtagttctgctgaagtgaagtggaaagattgatcctggatgcataaaactgactttgtcttttataagacgtatgtcactgggcaaaactttgaaattctctgaacttgtttccccatttaggaaaatgaaggtaaatactacctatgtgcaaagatgttcagggattaaattacaaggtttttgggaaataagtcaataaaatattttaaaagataagctattattaattgtataattatattttataatactgataaaatgtaattaatcaatggaattactctatttaattccttaaatgtttttcaatacattttcagttgtaatatgagggattatctacatgtgtttctatttcttatgcatgcctaacagatatgctatctctaaattactggaagactgtttgctgtgtatgcattttgcttcttcaactaaatgatgtttcttttctattttcctaatgccttgcaaatactctatttttaatgatgactattctgagtagttaacataaaatgtagtgatttggggggagagcagatagtagcagtaatttattatttaaaaaattgagaaaagctgaattccaaagcaatacttactgttaaagtagggagcagtgaaaacatagttatcattatctaggctccttttatagaagctgtcctcatatgtctctgggttttcttgccaattttctccagccctaaggaggaaatggctcatcatttgtattctttaatctacctgataacctactttatcctatgtggacttgctgagctttacagatacgcctacatctcaggtatgtctaaagaagttagtggtaattgatagcataactgatactcattactgagcaatgcatcagcatagcactaaattaagaatcagaaaaagctaactcctagttttactccgttgtttactagtcaggtaacaggacaagtaagttaataggtcaattaatgttagtaagcattggtgcctactcagcctacttcatggactgttacgaagataatagagataagatgcatcaaagaagagtgaaagataataaagtgctacataaatattgctgattggttataatcattgtgttcatttcactggtttagcttgtatctacaaagagaaaaatctctttaaacgtctcttaaatgttgtaataaacatatttggcaagcaaaaacatcattgaagaattttataatgtcatttttcagagaaataaaatcttttaataatgtaaatactgtaaacaatggctccaatgtaatctaatggcaatcagtttatttgaagaatggcttccttaagcagtaatgtacaaatccttggcgcagtcttttgtaatgtacttgtttttacagatgttatttgaacttactctttgggataaactctggtaatcccaccatcagtcacaacaaatcgtgctttcactcccttgctgaaacagaagacaaaacaaggaaatgttctattgaacatattctaaaaaacaaagttaggtgttggtgatacaaagagaagtaagtttaggaagtaaaggaaatatatcaatagatacacaactatgttttaataatttaaatatctattaaatttgtacttgaaggatgtttaaggaagacatctcataggaaataatgactgaggtgcattttgaacatggagtatgaattgacagcaatgacacagaaagcaggaaggtatcacttgtagagaggaatgtatacataagggaaagctaccagagatggctggtgtttggtatagaaaaaaaacgtaagacaaaaggagagaaacagtaagaagtaaagtttcaagtgcaagttcctcaatggtcagctaatgaatgattttgaattccatcttagagagcttcacctgtatcttgaacttagaactgcattttaggagttagattctggccaatatgagttgtatggagaattgtctagaagctgcatgtggaggaatggagaacactaaaggcagaaaaatcagttgctgtgatttcttagaaatgggatcttagggccttcattatgaggtagagaagaaaacattgctaggagaaatatttagcatttagtgactgaaaatggggtggagaagagattttaaataagaatcatactcagattttctcaactggatgtatggtaatgctattagaaacccaaataaacactgactagaaatcctactttagcacaaacagaaacacacaatcatgcccatttaatttggtgtattcaccctgaagtgtatgtgcatgaaaagttgagtaatagcagacattagtactgaaaaacacccacaactgaaaatgcaagttgtcaacaactgtatagtgattttcttgagaaatattaaacattattaatgaactgtaaatttatgagattcatacccaatttccacaggagaaactaaattgaaatgcagaatacatatttttattaataagaacaaatacttacatatttttctgcttactccagtaattttggacaagttcatttgtaaagcctgcatcaagcaagactctattaatcaaatccgcgttacctaacacagaaaaagatcatcagttacactcacatttctaaaattatgatcataatgaaaaatatattttctatttccaaaagcaatttagagtagatatttctatgaattttaaaatatattccacattcattttctttgtaattttaatattgttcatcttgcctcacagtttttcaggaaatgaatggatttagtagtagaaaaatcaattctaaatgagccaaattattttgtaaactttatcaaaataagaaataagctatgttaagaaacaggaaatagtccttcttttgtgtttttgtttatttctgtatggtagcatggcgattcccaaccatcataattttatgacaatttaatgtatacacacataaaattttatatatgtatataaaatttatatatatagaaacagaactaccactgaaattatcaagtaaaaacattcaacaaaaagttactgtctactttcactttcatttgttataagaaaagctattttcattcttttctatcacaaatatcaaaacataggataatcttggagtaaataagactatgaaaaattcagtgccgcatatcgaggagcaaggaatggaatgagcatcacagagcagtacaatcccaagaatgtttttgaaatctactggtattggtcaaagaaccaatacctaagtagataataggttgtcatttctagaataactgaagtgcatattagcccaagtttaaagataattgaggaaacaggtgatgaggatcaaaggccaattattatgtattcttaaacaaaaacctctgccttcttcccattctccttgttcctctaaacccattaagctctgaaataccctaacaggtaccctctgaaattgcacatttacgacaaaatttgactttttcagataaagaatatatgttcttaacatcctattactatacaacatggtggtgagataggctggaaacatttttgttgcttttaattattttaagttaatatatcttacacctgggattaaaggatcaatgtaatccctattttggagtacattttaattcattctagacactcttttttactatattgttttagaaactgaatcatttaaaaaacagttcatttggaaagtaaatgttctaattgcctccaatccctttaggtaaaacaaaataaatagatacagatataaaaaagaatgattccaattttcatggtgttctgaaaagttatatgttaggaaaaacatttctgataaactcatttttgcaaggaatatgagagtgtttcataattttggtatccaattaaaggaacattcaacaatcttattacagttctctcttggaaatgcctagtactcattaataggaaataaacaatgacataaaataacatttcaaaggcactggctcagtctcagtgagcttgcactgagtagaaaggtttggaatcatcatgttaagacatgatcaatgtaaactctggctcccatgacaggttttcagagtggctcactgaagccgctaactaatctgtgctaaagtgaaggagctaggaagttatttcttctcatatgcaataaatcgaagttaagagtcagctttaagaaagcctttgcctttttgataactgataaagtgctttgacccttcctaatagaaagataaataattgaaaaacaaaaagaagggaggaggagaaggaaaaggagggagggagggagaagagaacaaagagactcctctttgagagagaaccaaaaaagtcaattatgtgtacttattcttttttcaaattttatttatgaagataaattttgccatgaatttggttttcctcttatttcccatttgtacggtatttgttttggtagtgcttttataataaatatttttagaagaaaaaatgatttagattttttaatgatttaaaagccaagaatccataattttctattaagcttagagtatgaatgatgcaaatttacctgaaagacaaatataatggttaaaaactaattactaattttctgttgtctattttaatttgatttacctcataaatgaaaaattacagaagcataattttttaagacataaagttaacttgtgatcaaaatagaatgtcaggaaggaagaaaatcattaagtgatatttctttatacttcggtttttattctacccatattaaaactcattatattatttgaagcatataaataaatttataaaaatgtacgttttcctctaccaggcaaaatgctataaaaaaaccttcaaaagatcattcaaaattaaatttcctaaatttgagaggagctaacatgagcgtgccatatttacgtttaaccatttgaaagaatatattaccttgttttgaaaatttgatttaactaaataatgaaataacatttctttagtttgcaaaattaaggatcaaattgttacattttactattaaaaagttgtaaagtaaataaacaaccagcacaatataaagtaatatgattatcgtatcctatgatatactataaaccaatagaaccacactcaagcaatcattttgaattaatgcatacttacatgatgggttgtttggagtttttctatcaataaactcgttgaaatttaaaagaaattcagtgttattatccgatattttcaggtcattgcagtaatctctgaaaaaaaaacattttgagatattagatattaaaatcaaaactttacagggtaattaaaggtagtgaaaacactattttttttttttattagccacaagactttgcaaactattgagcttcttgttacttccatttcctcacttctataatggaccaatactttaccagtaagtggtgattataggcaatatgaattaaacgtttggcctttggacagtaggtgctcaataagttttggtgtagttatactattatcattgtatatcttagatttaggagtctcatatagcaattaaaacagaaatcttggggcatcgggggcaaggggagggacagcattaggacaaaaacctaatgcatgcggggtttaaaacctagatgacaagttgataggtgcagcaaaccaacatggcacgtgtataccaatgcaacaaacctgcacgttctgcacatgtatccctgaacttaaaataaaaaaaaaattgcctggagttacacacatatacaaacacaactgagtggacataaagctagtgaaatctgaataatatcagtggattgtgtttatgtcagtttcctggttgtgatactgtgttaaacttatacaagatgttgccattggaggaaactgagtaaaaggtatataggttctctctgtattatttcttgcaactgcatgtgaatctatgactgtctgaaaataaaaatttagacaataaaaaagcccagaaatcttaaagttcattacatgttaatatattttaataaaatattaccattattttaaaaaatattttaaaaagtggcaatgttttacatatttgcaaattatctttaattcctgacaagagaagacaagcatgtctctgcaatcaattgcaagagtttgttttggtctatacagaaaatttgtcctcacagagacgagaggcttgtttttcttcagatattgcggctgttctgtttttgataacatactgaaacttgtttatttgtaattcattgatgggtagttgtaacatggaatctgaaacaatattaatagtttttttgccttctgttacattaaaattccatattctttcttatactttaaatgaatcttttaagcatccgtgattttgtaaaatcataaactggttatttagaaaatgagttgtgtacaacttccaaataatgacacattatacaatattgaaaatttacactcattattatcttcaactaagtaagtattgggaatgaatcatgtatacaactttcccaaaattctaattttcgttggaaagctcagtttctgtcattggcagcaaatactcttagttgttttcttcgaagtcaaaagctcatctgatttatttttgagaaactatctgctggctatccaaatctgaataaccatagttctgtaatttgttctttcaagtaatgttacattaaaaaaaaaaaagcagaaagcaccttgttcacttcctaacacaatcatacaggtcctttatttttttgagacatccaagttactctgggatgcagtagcacttctagttttatcacatataatattaaaagacatgcactcaaggggaaaacttcaataaaatttataattctgaaatcaggtagcgtgatgtctctagctttgttctttttgcttaggattgtcttggctatatgggctcttttttggttccatatgaaatttagttttttctaattctgtgaagaaagtcaatggtagcttgatgggtatagcattgaatctataaattactttgggcagtatggccattttcatgatattgatcttcctatccatgagcatggaatgtttttccatttgtttttgtcttctcttacttctttgagcagtggtttgtagttctccctgaagaggtccttcacacacatcccttttaagttgtattcctaggtattttattctgtttgtagcaattgtgaatgggagttcactcatgatttggctgtttgtctattattggtgtataggattgcttgtggctgggcacagtggctcgcgcccataatcccagcactttgggaggctgaggcaggcagatcacgaggtcaagagtttcaggccagcctggccaagatagtgaaacctcgtctctactaaaaatacaaaaaattagccaggcatggtggtgggcacctgtaatcccagctacttgggaggctgaggcaggtgaatcgcttgaacccagaaggtggaggttgcagcgagcagagatcatgccattacactccagcctgagaaacaaaagcgagactgtatctcaaaaaataaaaaaaaaggaatgcttgtgatttttgcacattgattttttatcctgagactttgctgaagttgcttatcagcttaaggagattttgggaagagacaatggggttttctaaatatacaatcatgtcatctgcaaacagagacaatttgacttcctctcttcctatttgaataccctttatttctttctcttgcctgattgccctggccagaacttacaatactatgctgaataggagtggtgagagagtgcatccttgtcttgtgcctttttcaaagggaatgcttccagcttttgcccattcagtatgatattggctgtgggtttgtcacaaatatctcttattattttgagatacgttccatcaatacctagtttattatgagtttttagcatgaaggggtgctgaatttcgtcgaaggccttttctgcatcaattgaggtaatcatgtggtttttgtcattggttctatttatctgatggattacaaggctacagtaaccaaaacagcatggtactggtacaaaaacatataaaccactggaacagaacagaggtctcagaaataacgccacacatctacaaccatctgatttttgacaaacctgacaaaaacaagcaatagggaaaagattccctatttaataaatggtgttgggaaaactggctagccacatgcagaaaacagaagctggaccccttgcctacaccttatacaaaaattaactcaagtggattaaagacttaaatgtaatacctaaaaccataaaaaccctagaagaaaatccaggcaataccattcagggcataggcatgggcaaagccttcataactaaaacaccaaaagcaatggcaacaaaagccaaaattgacaaatggtatctaattaaactaaagagtttctgcacagcaaaagaaactatcatcagagtgaacaggcaacctacagaatgggagaaaatttttgcaatctatccatctgacaaaaggctaatatccagaatctacaaagaacttaaatttccaagaaaaaaacaaacaactctatcaaaaagtgggcaaaggatatgaacagacagttctcaaaataagacatttatgcggccaacaaacatatgaaaaaaagctcatcaccactggtcattacagaaatgcaaatcaaaaccacaatgagataacatctcatgccagttagaatggcgatcattgaaaagtcaggaaacaatagatgctggagaggatgtggtggaataggaatgcttttacactgttggtgggagtgtaaattggttcaaccattgtggaagacagtgtggcgattcctcaaggatctagaaccagaaatgccatttgacccagcaatcccattactgggtatatacccaaaggattataaatcattctataaagacacatgcacatgtatgtttattgcagcacggttcagaacagcaaagacttggaaccaacccaaatgctgatcaatgatatagactggataaagaaaatataacacaaatgccccatggaatactatgcagccataataagttcatgtcctttgcagggacatggatgaagctggaagccatcattctcagcaaactaacacaggaacagaaaaacaaacaccgcatgttctcactcataagtgggagtcgaacaataagaacacatggacaccagggaggggaacatcacacactggggcctgttggggggcaaggggagggagagcatcaggacaaatttctaattcatgtggggcttaaaacctagatgatgtgttgataggtgcagaaaccactacagtacatgtataactatgtaacaaacctgtacgtcatgcacatgtatcccagaagttaaagtaaattttttttaaaaagtgtatatatatatatatatacacacacacacacactgttcaaaacagcacatatatatatatatatatatttatttatttatttataatcaagcccataaagggcttaacatatgttaattgaagtggacattcattggcctgtcccacaagccaaatactctcccttctcaagtactttctccttccctaaacacgtaagtaaatttcgatcttctagtcagctgtattgatatcattcagctataaaaaaagtactgatacgtgcaacaacatggatgaaccttgaaaacatcatgctacgtgacataaggcagatacaaatggtcacgtattgtattgttccatttatacgacgtgtctagaacaagcacatggccataagagacagaaaatagattagtggttgtttgggtctggggagggttggggaaggatgggtaggtaacatttaaggttacagattttctctttatgatgatgaaaatgttctaaaattaactctagtgatagttgtacatatatgtaaatatattttaaaactttgaattgtaaaaaaaaatatgaaatgtgacactgactacagaaatggttcatacactaatacctgctggattaaacaaaatccactgcctatgaattaggaattagaattgagagatatatctatctttctctatgtatctggattctaccctagtttccaccttgtcttatagtgaagctgagaaagccaacatgcataatctgctacttaataactgggagagacaagggaagaaactgtagacaacaacacagacctcagatggagagtcttgccaacatagcaggcctaatttcaatctcttcctaaattgtttgctatgttaatattctgcgggaccctgtttttgttgtttttgttttttctagctaatgttctccttaatactgagaaaattctttctagttaaagtgggttaaagttgttctcagtaattcaaagtaacttgaaattaattaaagtgacttgtgtccaaaaactactaataagattgcaagtattattagtgatacaatttttaagaatattctttatatatttacagattctccagtcaccaagtatttattcagcacctactgtgtgccagcaatggattcactattgggtattgaatgttaagtcaaatagacacagtcatggtctgttgaggaaagtaaataaaatgtggccagtgctccccaagagaaatagagaattctatgaagcagtcaggaaggatgcgtataccagtgaagaaaggaaagaaatccccacattgaggaatttttaagttgggatttcggagggagcgggatgcatatgtatgtatgtgtgtgtagtccaaaagggaaaagagaattaatggaaaaaagaaggtaaaactaaaaccaagcaaaaaaaaaaaaaaaaaaaaaaaaaaaagaaagtgcatttaggaactgaaagacgttagtatggatgaaatttagagtacgggtagggaaactttccctgacagggccatgtagcaagtgatttaggcttttgtggcccataaattctatgacacgactactcaaccctgtctttgtagaaaaagcagccaaagacattccagaaacaaataagcatcactgtgctccaacaaaaatttatgtttaaaattgatagctgatctacaggatgtagtttgatggtccatagtttagagtgtgggggaccacactggtacaccaggacttggtggaagagcatttgaaagctataatataaagcacagataatcataaagacaatatacaatcactggctcgtatttagcagatgagaaatatgatttttttcacattttagaaactctctggttacagaacagagacagcattaagaaatacagggtaaatatgaaagtagggagatcaagtaagaggcaaatgtagtagtttaggtgagagaaggcagtgacctggattagggcagaggcagctgagattgacagatacacttgatactcatacgacagaactggcaagactggtgattgattagaagtgagatacaagagaaaggaagcagagaaggacaactaacaggtttcaagattgctcgtttgggaggatggcattttctcctctgaggcaacataggtagaactttccaaaggaaacaattatttataagatgctaaatctgaagcacattgaagagatactcttgtctggtttccatgagatgtgtctcatattgaaatatgtaaagtctggaaatagatataatataggattaaataatataatgcaatatcaatgaaacacatatgtctttgtctctagatatttatggccatcatatagatttgggaattatgaacctaacctgtaggcagagaacacatgggtggcttgtggtctgaatgcagtctcaggtaaaaagacagcctaggctagcatcctttgcagccttcttatatgagtgatcagcagaagaaatgaaactcatgaaagagacagtgaatatgcagccagagagggagtaagaaaaacagaatagtgtgtcatcaagcaagagaaagcacactgtcaaaggacagcgtgatcaacagcgtcacacactaaaggaaattcaagcaagagaagcttctcaaggatacgggcattcaaaaagccaagaataggctttgttaacagagatttttcaaaaaacccatattccctacgttaaagtagaaacaattcagaaatatccttttgcaagaattaaagggtaactcagaacaatttatatgcatctttgagtttttggaataatttaagaaaagtgaaaaattaacaatccaagcttctatgtaaattgttcccaataatttggcctagattaataggaattatatttgaatattatatgtgtctgtcatggaataggagtcaaaaactgaggaaagaaagaagaataaagaacaccctgggactactgaatagtttcaaataattacaagaaaactgagatggagaaaaagatgtacatgcgtgatgaagggagattatatgagagataaataaaattgggtagaaagaaatgaggtgcatctaaaaagctatgtaaagcaatgccactgtaaacatgttctcccagaaagttgaattagaccattaaaaaaatccattattatgttcattctacccctacgtgtatagatacacataaatattggtacatatatgtgtatatatgtgtacatatgtgtatatacatattcacaggtaaaaatacacaattttctattactgttggaagcactgtttgttctacaagagcaaagcctatgtccatcttattcccattgtgtcccagagtctacattgcttagcacatagtaattgcttttttttttgagatggagtctcactctgtcatgaggcaagagtgcagtggcatgatctcagctccctgcaacctccgcctcctgggttcaagtgattctcctgcctcagcctcccaagtagctgggactacaggtgtgtgccaccatgcccagcaaatttttgtattttcaatggagacggggtttcaccatgttggccagatggtcttgatcttttgaccttgtgatccaccagcttcggcctctcgtatttgaatgagtaaagaaatgaataaataaagattttgtttcagttttaaagtaattatttcctttgattccataatgtgatatggaactaacccagagcagtcttgactcaattctgaactactgttgaaggcctagctactgatagaagatgtatcaaaaatacaacaaaaccaaccttggtgctatgaatgtatagccagattcttcaaaattatctggcttcagggtttccgaatctgcaaagataatgttacaggattagataggtaattcagagtatatatccagagattctataacaataagaaggcatgagaaagattacctaataagaaaaattgaaaatagagtacttacatcctaaaattgaaacatatcaatgaatataaatgtcctcaatgcttcccaaaataataaaattataacatggattaacttcataacatggatccccacagttatttcaaagaaaatgctatgtctataattttctgatctaaccctactataaccgaatatcttttaaaaagtgattgatatgaatgttataccagaggtattttaaagaccaattatttatataaagtttaccaatattatgatccagaaaatgatgttaaaaaactcattaatgcctttagtgagttaataacattcctcatattaggtatgaattagtaagtggaaggatacaaaacaaagcttcttaagtccaagaaaaaaacttgaatgtgaaccagcttgcatatgaaaacacagcatattctttctaccatttttttgctgctaagttttgagtgatcatgaaggaaaatttagcaaatgagaagcacagaggataatatccaataggaaggaaaatatcagtggaaatgtcaagtgtactaaacagaaagaagttgagcaacaagaaaatacttgcccttcattttgcccttttttgctgtgaaaatccatcagaaagagaaagcagggaaacaaaaaaaaaagagggtaaagcaaagggggtcataaacaatattttattcaatgactttcttgaataaaaatattgtgcatagatcaaaggttcatttatgtacagctgtagtctgaggaaaaaaaagacatattttgaagactggatagtatgtcctatcaattataactagattaccctctctgtactgtggttatttcaagggtctgttttgcaaagtgattaatgcaggtgtaataccaatgacgtcaggctataaacataagcatttactaatcaaagactcacgagttatcccctcatttatcaattgaagaactagctcatgcagaattgctggttgtgaaaagaccatcatatctatctatcaagtgaaagtggaaatataaatgtactatgtataatgcacagtgaacaccaggcctgatgcgggcaaaaaagaactgacagagaaatgaaagaaactgtagcttactttaagatcagatgtaaaatatatacgtatatttttggtattcttttgtattttacttcatcctcacagaaaaatttaaggttgttagcaataatcggcagtgtgcaaaggatatgatggtcattttactttacaaaatctagtcacccaaaacaaaataaacaataacttgaagtatgcactagtattaattactctacattccaaatgaggcttaaaaaaattaatccatttgcattactgagacattaatttggattacgaaaagaaagttaattgccaaaccaaagccaaagaccagtgcaatttaatttattcaaagtagaagaagatgtgaagcacaatattattctggccaaatgcaaaataaataaataaataaccagaaacaaataaaaggaaagaaaaggaaaagctttactagcacagtgccatgagagtagagactatgttgataagtagcatgtgaaacattttgctccagctagcagacccttaaaacgacagcaacaggacacagcactgcaatgattctatgagcacatagcaaggcagggaagggtggtggggactgccagtgagactggagtacctgctcatattctatccatgtagaatatttcttgttccttgcatgtttggaatgggttagaatcattgctgtagatttggtaataacacctactaaaatatttcataagccttgggtattccaaaatctagacgtatttaaacatctgatactaggagataacaaatggaccctgaagtcactttcacagtacttacatctggcctgagttattgtctcttctagtttggcttttatatagtaaaaactgtaggttggtaataccaaggccaaactgcaatagaaacaagagaagcataaacacaaacaaacaaaaatgaaacataacttaaaaaaaagacacatcaagttcatgggaaaatcgaaagatcttcctcatgggaaggaaaagacatattactttgacaagaaaatgcattcagcaaatacagtacttaatttcagtcttgccatccagagtcatctagctctctacattgtagggaatcagaagagacaagtggaaaataagttcctgaatgaacccataaattagccaaggaaggagtgtcatggccccctactatgtttccagaaaattatattaaattactttgaattttaacaaaaaattgaagaacattaggggtatgtttaaacaaggtaaatacataataccatttggacacacttccttaacgtattatatataatgttaaagtgctttgtataaaatggacactattaaaatacaaatggaagagttactattatcattactttttttttttttttttttttggagacaaggtctcactctatcccccaggctggagtgcagtggtttcgatcatggctcatcacagcctaaatcccctgggctcaatcgatcctcccacctcagcccccgaagtagctgggaccataggcacatgccaccacgcccagctaatgtttgtattttagtagagacagggtttacactatgttgcccaggcagtctgcctgcctcagactcccaaagtgctggtgttacaggcatgagcctccacgcctggccattatcattactattgaacaatgcataaagtcatctaaaatatattcttttgagggattaaataaccactattttaaaactctaatccttgggcaagttctctagtactagtctactcataggcaaattcagattcctttactgcactaacagaaattgtttgctaagctcattagtttatacccaatagtaaaactaagtcatagtatttatttcaagtttatttactgtgattattccacattatttggaagattgttattagatgtaataggaaatgtgtcttgagttttgtagttaacaagagccacggcgctactctagtcttacggtagatgtccaaagcagaggagggttccagtgaaaatcttaggccaaattcagaatgttttagacacaaaaaatgtcagacaagctggccatcaaaacttgccttaatgactgcccaaaataaaaagctgttaggcaggtaatcttacttattttgaaattgccaattaataaaataaaataataaaacacatcagaattgttaaaggatttcagaattttatgcactttccaataacacaactgcatatgtgtaattctcctattctcatgctaatactcaaatgtaggacataacttttccatatccacatgtgctatggagccacatgatctttgctatgctttgaatatagaagaaaacttgtgaacagtgggtttacctctaaaatgcccaatctaactactttccaaaagtaatacttgtttaatgtaacccacttggtcaccttcagcatccacttttaatagctagctcaaattttagtaatgtgcaggaaaaggtgtgtatatctatgcttttgagtatttccaggcatgtgtagatcctttaattaattaattaatttttaataatttcaacttttagatttagggatttgtagatcttctgaatcacttaagcctcacgtagccccagttttgggactggatatcctaacatcattatatatttttatggacaatatagaatagggaaaaacataaaatttcaaaatttcatatgactataaatattaaaatttcactctatgaaaaggaaaaaaaaagcaagggtttatttgctaaaatttaattatacaataaagatagcaaaatgaatggatgcttgttacctccaattcccaaatctttctctattattaagtaattcatagactttccttatgggaaaaggtcagggaaataaaatgttatgtagacttaatgaaaatttctatattcattttataggtaacttcctttaagtggaggcagagattaaaattaaaataagcagtgcaatcactctgacagcaagatgacctttcatgattcacttgccatttacaaaatgtacagcagaattactgagcactgaagattgtctcccagaaattcttctcaagggaaattaggacatttttattgccccatcagcatttattgctaagagaaacttctaattaaaaccgataacattatatcatacaactgctaaagtgtcactggataagcttgggttacatctaatataccataaatatagtatggaaacccatgaggaagaaaagagaagttttaaaactagcacatctactatgcgttttgttggcctgtaagtctttgattgttattaatagctacagtccgttctatagaaaaacatagctatacttaatttaattatgtccatctcaagccaagttaatttttcaacatatagtcagataagatctttatcaacattcctagtcaatggtgctgtcatatacaatgtttgctgtctctgtccatataaaactgatagaccaagactgctttatttccttctagagattaaagtttaataaagcaagtggccaccagatgaatagtatagcccaggcagtgttttgtgactgacagaaacatggttaactgagttaagtggactataacacacttttcaactcatttatctccataaaagtaaattattctctaaaaaaagagaaagcatcctattaaaataatttattacatttcaaaatatggtacttggatcaagacttaagaagagagaaatcaccagatgaaaattttgtatctcattcatgaaatcaaaacatatcatgttttttccttcaacttagatgtaacattttgttctaaattgctctttgtgaatttgtacagtgattcagaaaagtatttccaatggaaatagatttaatctggcccaaagttggagacttggaaagcgaatgtgtgaggaaacgcaaaggtgggaaagttggggccttgtcagagaacagtgatatgtatggtgatggaagtggcagaaatgacaggacagatacattgggttagaaatgtgtgaagggactatcagacttggaagttcaaattaaacttgatgatgaaaatggaaggagacaaaagttttgtcaacaaagagtgacatgaactcgagaaaagaacattcgcctgctcacactgtgtattatcactgggtgcatgcggaaaagaggttgagcatagaggccatttgtgagacacgtaaaacaccccaaaagtgtccttataactgtaggagagccaactatcacattgtaagggtcaaaagaacccagtttttctcagaatttgttcatctaagcaacaaagacacagaatgcattctcatacgatgccctgatactttgttttatcataaaatcatctctcaagagacagaccttcaagatttcctctctttttgcaccttttgacaagttaatccaaaaattgaaaggtggcaataaggaagagggaggaaaaagagtaacttgtgtatacacataaagattgtgcatgtataaagaaatgcctagaaattagagataggaatcagttgatagaaaaaagtaaaataattaaaacagccattctggtgttttgcaatatgctctcctcttctgtctattctacatgcaatcctaggaatactaaaggagataagttcctatgataataacataggctcccataaaagcttatgtgtatgttctggggagttggtttgatttttattaggagagaaatagttgagttcaccacagcctacatattaactgtatattaatatgtagttaaagagacttccgtacttaaatattgcaatggaagttctgtacaccactatatgaatttgaaaggatgagacagattgaaaatttcttcagttggaaaattcttccatttctccaaattgaaattcttcaattctgtgaatatttgtagagtgccaactatgtgccactgtcatacaagctgatgattcagaagtaaataaagcagggaacaatccctgccctcttggaacttactagtgagagaacagatgataatcagtagaaataagtttctctatatatgtttcgtgtgtgtgcatgatgttaaatttcaataagggttatggagaatatgaagtggaagagggagatagagtgtggtgaaacattatacattttaaataggatcgttggagaaggcctttctgaagagatgaaaagtaagtaaagatgggaagatgagggaatgagcatgtgactgtttgggaaaagtaattccaggcagaagtaatttcatatacaaaagttctgaggcagatgggtgccagtgtttatgttgtgtggcaaaaaggacagcgtggcttaaccagggacttttcagtggagaatctggaagataaattcacagagctgacggtcagtaaggtcaaatgatttacgccactgatggccgtgccagacttcgggtgtcagactgaatgaggtagcaaatttactggtgggagttgagtagagaaatgaaacagtctactcaagggttaagatccttcttgtgattgtgttgagaacagaaataacgatagacgatggagatacagatgcaagtagttatgtactctaatagtgggagttctttctgaccacttctatttttctccgtgaaatggaaagcaaattcatcacctgagcgaaaatgatgagacagtattacaggtttggagagtgaagtgatcaagagtcatctacgagagtcctaaaattacaggattatggatactgccagctaccgctaaggcccacttgaggttagaggtcatgaattttaggtgatatgtcagctagtgagcattttacttcagtcacttttagctgtatgggtgcagtgtggtgtggctaataatttgaatttaaccaggactggtattttgccaaattgctgtatgccaaattcaactatgatgaaaggagttggtggtgtgcacaagacagtgaaagacccaaggaatttctgctaaataaagaagggcacaaggacacaaagagggcaagacagcaaaaagggagaagggattgatggatttcatgtcttgagtcaaggattactgcagttgggctactagcaggagaagatggaaagctaaaatgtggtaacctgagagttggatgaaaaattctcatgtaaagactatgaaggcattgcagacttgacactgtaagagctgcagaatatgattttggagtcagtgactaaggtaggggggtgacaagatcattagaggagagaaggccaaaagtaacagagcccaggtattagaaacatcatctatgtcaatgctacttaaagtgttttccatggacctagccaatttgcaaactgtctattacaagcccgtgatagcaaaatacagaaattgggagaagtatttagaaaattttatagcaatgtaacagactaattttatgtctgtgaaatataatagtaaaaattttgagcttatgttttttcttttaaagtttattttattaaataatttttatttttctttacaccagtgtgggtatggcatcatttgcaaaacagtgaactatgtgaatgtaggagagagtgacaatgagccaggagttgaaatctttataggaatgagagggatgtgactgttaagaaggaggaatagcaggtggtgtggtttggtgtcatgagattaaaagatgggaatttcagaaaggaaaaaaaaaacagaatgagtaatgacgacacactcatatcaccctcagtattctaaagacttcagaggaagcagtgagctcagaggagagttagagcaagaaagtgaaggaagtgttgagcaagtgttgaagaatggagaattaccaagagattactaggttttaggctgtccaactttccgaagcccagccaatgggaggaatcacaatattatagaactgatactcatggaggtaaattatatcaactaaacatgttatatcagataccacaatgatgagataagctttatattttagttagttttcaactcaaatgtacctaatgtaaactaaacaacaactaaaagaggaagtcagtgaaagtgaaccctacatattattatgggtatttgtcaacatttctcatgtaaaaatacaaaatatatatatttatatcacataggttttcatttctaaattttatattactagagtttttccatcttttccattttaaaaattagtctataagtttagtatgttttcatgttgggaacttttctagtgaaaatcacatgaaaattcacttgtgaaaatgcagacttaatattaatccattggaatacacaatacacataaaatacagttaattacctgtaatctgtgccattgacaggtgtccatgtgtatgtcctgtttcctttgtcaatatatctctagaaagaagtttaacgtggttattatcactttacattttgtatgaatatatacgaaaagtaaagccgtagaatttacttataaattttgtagtcatttaatactcatctttacaaaggtatgatctattttattctatatttatttattttctgggtgtgtctagcaaaatttttgacagaaacaaatgtaagtgaaaaatctttatagtttatgccaaattattatcttcaaaacattgaaaacagtatttcctgaaaaacaaattttaataatgaaacaggactatgaagtatttagacaaggctcggatatgtccatactaaagtatgttaagagtaataggcaacatcaggacattaatgcagtgtgtctagatccaaatttatgattagcatatgactgtttttatgaagccactattatagcattattatggtatcataagaggctactcagtatcactgaaggttaggacaacatctaataaacccaccagggaaagaaaatacagagctaaggaagttcatgcatggctctatcttttatacattctgtcttccattaggtattgcgatggcacatgtataatttttttttttttttagacggagtatcgctctgtcacccaggctggagtgcagcggtgtgatctcggctcactgcaagctccgcctcccgggttcatgctattctcctgcttcagccttcccagtagctgggactacaggggcctgccaccacgcctggctcatttttttttttttttgtatttttagtagagacggggtttcactgtgttagccaggacggtctcgatctcctgacctcgtgatccacccgcctcggcctcccaaagtgctaggattacaggagtgagccaccgctctcagccgctggcacatgtataatttttaatttgcttagttatttttgagtttcatcattctcaccaaaacagtaacatgtattgaagtatttcttggtatcaggcactatgctaagcacctgtcattctgtcacttagtccaaccactggagtatatacttttatatcctgcaatttattgatgaagaaataagtgttaaagaagaggtaaggtgcttaagttggcaaaatatataatgccaaattcatgtttgtgacaactacacaatgaatgtgtgcgtgtttgtgtgtgagcatgtgtggggtgtatgtgtggcagatggaggggggaacagggttgtgaagagggctttggactagcaatattcttaaaagaattagaagaaacaatgcttatatatttgttactactcataaaaaaacagggcaagcaagtgttggtctgcaagttataaataaaatacagtatcagaaaacagtatcagagcagagaaataaaaatgtaagttttttcaatatcagtagcagaaattataatcttgttcagtcttcaatttgtaataaaataatcaaacggacaattttaaacattattactaattttttagtcaagaaatctatttttcaactgcttttgaagtttgaaagtattctcagattagcttcttaaaaaagtcattattcagtaagtttatccttactaaattctaccatctttcagtaaattttctgcatgaaatagtacaaatgaattctagttttagcccaagcatatagttataaacaaaggactgttgatggagtatgcataataaatacaaactattttcagattccaacaaaccagattcacttgggcataaattaagttgaaaagttctaattctattttaaacttatttcagtagtaatactaaaatccataaaaatgcagtatcataagggttagcatatgtgcattaaaaatttgattcatataatttctcatttattctatacacttacaatttttatagaatagtaagactcatgaaagacatgaccatgaaaaaaatgtttacaaattaatttcagacagattgtagtgaaaaatattcaataaatcaggtgtaaatagaggttctgtgggaaacatttcctaggtgaggaatttcaaattacttgcaactcattatgccaaacattgtgaaatgtgccaaactggagattcctagctcatcaatatggaacatggtacaagaaaggttctataattcctacaacaaccacaaaaatgaacttcaaagttaatagctaacctaagcctgtggaattcagctactttggctaaaccaaataacactataatgtgaaggttactatcacatcttaaatatctctgccaaaccccttacatagaccatatagatagagcttttgaaagatatcaccttaaaattagaataatacgtatgcacagtgttgtaattgtctataaaatagtgaatagtgataaaaattatagtcattcatagaataaataacttttcttgaaataccaatatacatagaaatctggagtacaaggcaatgtagtaattgaaaattagcagttatatctatttacaatagtgtgttcatcagagacattttaaaattctaagacaggaaaatatagtctttaggtgaatatttgtcaaaaaaagtaatttgcaataaattgaaggaagaaaaatatcaatgggagttaatagaatattactttgtaatctgagaaaagaatgtgcaaaagtctaagcaaatagagttgaagtttcaacaaagactgaaaggtaaatatacctccctttgcgttctgtaatagggactcattatgatattaaaatgagaaaggccatgtgctaatgaaggatcatagtcagatcctagctcaccttccacctagggaaggatctgatgaggaatttcagaggaatgtaattcatctagaaatgatgagattgtgaggaaaaggatataggttatacataaaagcttaagttaaaatttccaggctcaaaagcttctgagacttacatttttcaaatactcaaatgtataaatgtctgtatgtactccacatctgactaatagacataatcctctgactgataatagatatactccaatatgataatagacataaaccaattatttgtgggggtagttgtgttgtcacaggatttaatttcagatctaagtgctgggaaattttaaagtgtgtaactagtaaaagaagataaatcaagccagaaacaagtaaacaaaaagctaaaaataaaaataattaatatgtggaactcaataattagaataaaaaggcaaatcatgtaaaacatatagctattaaatattaacttcaattttgtaacattggcatagtgtaaaacaacatggcaacattatattgtgtattctatttctcataaaatatgtatgtaaaatataatttcaagaatatactgttaatgtataagaaaacatcaagaaacctaaagcaatagtattttataaaaagaaaaagagggttaaaaatatatcttagtgaaaatatccctccagctaagaagtgctttaaaaagaaaaattgtttcctagagatctccctgttttataagtaaatagtggattaatagaaaaaaaggacaagttaccaatatcaattattcttgatataatttttatttaagaataagctagaatcaattcttacctcatcttgagatttaaccagagttctgaatgttttttctccactttccccatcaatcatcttatttcgaatctaagagtaaatgaaacaactactttattccagaaacaaagctgacctgccaaaatatgactattaacatggtagtttttcaagttctttaccttatttagaacaaataaaataaaaatagggggttagttttaccagtatctgcagttgttctcagggaatttttttaagttaccatattatagtcattttacattattttaaaataataaaacacccttaatgaaatattttcaacctgttggtagtttttgaaacgtaattaataaaatgttcaattatattatggctagccacattggagtggaaagtagtcattgagacatagaaatgtatatgtacagaattacatataacacggaatgcttcaaatttctgccttacacaatgagtttcatgtgagaaaaatatttttaagaggactctttacactttttagtttgtaattcttatatctgggtaccaaaaaaatctaaataaaggacagagaaaactataaacacctatttggatttagaataatagagttgagtctccttcagtagaatactccaaatccttaaaaatatgcaaggtcggccaggtgcagtggctcatgcctgtaattccagcactttgggaggccgaggcggacaaattgcctgaggttgagagttcgagatcagcccagccagaatgatgaaaccccatttctactacaaatgcaaaaattagccaggcatggtggcaggcgcctgtaatcccagctacttgggaagctgaggcaggagaatggcatgaacccaggaggtggaggttgcagtgagctgagattgcgccactgcactccagcctgggcgacagagcgagactccacctcaaaaaaaaaaaaaaaaaaaagtgcaaggttacattatccactaaatattccagtcgactggcaattctcagaagtttcctcaacttattttttataactcaaccagtgatttacatgtggcttcgggaagctgcaaatgataagtaaacaaacttggtgtgattaaaggaataatttgaatttgaagaacacgaatgtttgatgtatctaatttagttcaaatatttgggtcttaaaggaaggagtagataacagcttctaatgtaagttgagtgtgcacttatgaggagctcaaaaataataaagactttaccatgaaccaggccttttgctaagtcctttctatatattatttcattcaatcactattactgattgatttagaagaaactgaggcttgcagaatctaagatcattttggtcactcactggagtaagagtccagacaccaagcttgtccccattactttatcctactttattatgtcaattactttacaacaaatactattaatcacctaaacaccctaacacaaggccaccgtctagggtaattataataaatcattaaattctattgttctacaattgaaatgcagtgacaagttataaaagaaacatgatggcatttgcaagggagttaatccatctggaaaaatcctaaaaatctgtaatctagaatgcaagagccaagttctgctacttattagctgaagaactgtagagaaactatttgacctctctgtacctcaaatgtatcatcagtacaacagatattataatttgaaataaaaatacctatttccaagcctcttgagaatccatgactaacatatatcatataatgttatttattatatatttctaatatttttattattaatataatactctcattattatggaagactctctcagaggaggaaatatgcaattttgcttttgaaataaaatagattgccaagtaaaatgtattaaggcaaacatgacagcttctactcatgctatttcttatgtgtttgggtggttggattccttccaacttttttttcaacactataacaacatcctccatctctatgatttttactgaagtttacaagatacatttgtattagaatagtgaaaatatgtctacctttaggaagagaaagaagactaaggtcgaacccaacttaaacatttattccttttcatatgatcttttggataggaaaacctaggatctagaaaattttaatgacaaagaacattcatctttgtgtatacagtatcaaacagacaagctaacacattgtagccgttcaacagatacttgtagaatgagtgcataccagcatctgacctgaggaattgtttagtcttactgattccactcacctccactttaatatcattctctaactctgcatcaaggaaatccaatgttactggctcctgagatttggggttctacacagaaaacaataataattaggtacatgtaacattatacaatgatgctgtgtataaaacaatttaacgggtatttatgaaattgtgcaaaaattacctaggatacaataattgtataaaggtatcttctttcatatatattttatatatatatatagcttatatataaaagctagagattgagctttaagtgcaggaaatcttaataagcaagtgaagacagtgtcattttgagtgctgtatttgatactgcatttatattcacaagctctttgggcacatcacttttgaagaaccattcacaactttcttttcattaattagcatgggaaaggggcaaaatatagccatttggatgacttatttggtaataaaacaatggcaacatgtaagcatacttttaaaatttgtaaaaaaaaaaaaaagtgtatgagaaaatgttttaaaattatgtctacacttgccaagtaaaacattctattggacctgttcttccttctgaaagtatataaagaaaaggtgcaagtttgcttcatatatttcaatctaagaaattttatattttaataattcaaatgacatcagaatgtataagataaattttgtggttgtcataaagattttaagattagctattataattaaagtcttactaggataataacccctgggttcaatgaatactatttcctattgcttcttcttgctggtgtataataataaagaaagaacactggggaataagatagattcttatttattcatatcattatataaaatgatactgttagtctggcaaatttacctcatatgatattattttaatgtctcaattgcaaaatgaagattcattgaactatttgataaacaaaatacagtcaattcctctataacttcctaagtaatgtaacatgtcatactaaaatttcaaagcttactagaccaataaaatcataataggtatatgtaatttcataattgcaaaattttagaaactgaatttttaatttttattaaaatattacctaaatctgataactagattccagtaacaaacgcaaactatgctggattagtgcaaaggtcactcaaactttaataatataagcctcacagactctttcaaaagatgttcaaattatcaccattttaagcactgttttaggaagaaacttcccaaggcagttgcaataagtaaaaatgtactaaaattaagcatatcttatcaagatgttgaatgacatagtatacacggcatgtatttactgacaaaaatgccttccttcaaagagtaattccacctaaagatgaaaatttttgattcctatggtttttgataaatgaacattcttaaaggcaaattttaaaaaatagccatgtctggcactttaattgaaaaaaatattcactgcttaagtactctatcactacaatcagaagattctagaatactgaaaataagtattaaatttttcaaaggtgaaaatgctgaccagtattggtaagatactgatgacatcttactgcgtgaaaaggaaatactcatttgaaatgcagcgtattttaaaagaataaaataaaagccaatgttgaaaattcttctaatttctttgtttaaaaaatgaaacctagaaaacccctaacaaaaggatactctaaagtttacaacattattcagaattgctcatttaatgtcccatgaaataaactgtcctcacacaaacaccatcatatcagcattaaaattttaacaaactcactgcaaagcaaagtcaaaataatgaaaataataaaaagtaaacagaaataagagtatttatcttacatgcaatggataatgcatagcatgaccagacccaaacagcatgcatggaggaggcattatcaggaagaattggcaatatgaagatcatgtcccaatccagcatacaaagacacagagaagaaaatgaaatcataaaagaaaaatctcaatgcataagttgtacttttaatatagcaatctagctgaccattttttaaaagattcaccacgggcatggtgactacaaaattcaaaagcataatctttcaataagaaagcaccaagagaggctgaagaactggaatatagtctctgcacacccattgtttttgtctgatattaaaatacctagtatttctcatttgcaaaatttggttatcaatggaaataaataccacaccatttgtggaaacgaaagaatgaaatgttaacaaattttaaattgaaataattactagatagtattacaaatgctacttagttcaaaaatagccttcaaattgaggagtcttgtgtggttgctagtttgccatttagagttttcttagaatgaaaacaaaaataaaacagaccattttcaggttgtttattttttaattatattgttaagagttacatgcaatatttgaggctgctgcaaaaacaaaaattcactaaaatgcacatgactgcaaaagtataagataatacataaaaagaaacatgcaaggacagtaacaaaacaatttactatatcaagaaaggcataaacataattttaaactttataggaattataaaagatatgaagactttcatatgcaacaataggaaattcagtttgttctaaaattctagcactggaagagagctaaagtttctcaactagggcagtggctctgcactttagacctccatggggagctttaaaaactatttagaggccgggcacagtggctcacacctgtaatcccagcactttgggaggccaaggcaggtggatcacgaggtcaggagatcaagaccatgctggccaacataatgaaaccccgtctctactaaaaatacaaaaattagatgggcatggtggccagcacctgtaatcccagctactcgggaggctgaggcaggagaatcatatgaacccaggagggagaggttgcagtaagccgagattgcgccactgcactccagcctagtgacagagtgagacccatctcagaaaaaaaataaataaataaacaaaacaaaacaaaaactatgtagaggcctggtcccatcactgccaaattaaatcagaattttcagaggatgaggcaggggactgacatatatatatttaatttcctaggtgaatatactgtgtaggatggaaactagtgactagttcaattctcctgcttttcagatgaagaaaattaaacactacaggatttagtggagtgctcaagaacacagtgttggctttcagaaccaaactagcactcaattctactaattcacagcttatccatctcttaataacatattacctcttcattttaatgtcaccaacttatttatttactcattttgtttttgagacggggtctcgctctgtcacccagcctggaggcagtggcacactcttggctcactgcaacctctgcctactgggtccaagcgattctgcctcagcttcttgagtggctgggactacaggcatgtactaccatgcctaactaatttttctttcttttttttttttttttttttttttttttttttttttttttgtagaggcagggtttcactatgttggcctggctggtctcaaactcctgaccttgtgatcggccctcctcagcctcccaaagtgttgggattataggcatgagccaccgtggccggccttaatgtcaccaactttttcaaagaaatggtaggcttacctacacaatcttaaataatgttgaacatgctttgaaattctgaaattctcttgctaagctataggaagtatccttttatgttgattattaatagttttactgtgcatttagaaatattgtatacatgtgataactgaagttttgttgccaaaaggaaaagctttcgcaatgagtttaccaggtaataaaaattcactacttatttgcactttggtacatttttaattagctaagggaaacttctttaacttctaacccaaaattacactttttagaaattttggcttaaaatctgtggcttatggaaactgtcatataggaattgtattttatttccacgtagaagtcaatttacaagcaaattgttaggatcacatgaatttgacattaattttacaattttaataacaaatttatttttagaagccatctcgttatgatttctctgattattaacttgattccataattgactttgcaatctttggttagccaatacacaccctctaccatcattaataacatttttgctccagcttattaagaaatgatgctcatctcatttcatgctctggaagcttgatgtcaggaaaggcagctttaattataagctttaagaacagaagcttaatcccaacttggatttagcaaatttgaaagcactgttaaggctaccttcattcacagttacctggatattgggtctcctttttcttaaattaattgttggtatacctacaccaataggctgaagcaacagaaaaatggtaattcatcatagtacatgtcaacataggtacgggttctatcctataatcaattttcgtcagatatttccttgattgcaaaaaggtctaaatgatagaattcaaaatatttggtaggtatggagttcatgagtcaataaaataagaatgtaaaaatatcttcaatgaatacaaactgttacatttttaagaaaaatgactattatttttctttttctagaaaagtacgtatttgggaagtgggaaaaatggttgtttgtcccagattacttttccattgatttgacaaaaaaaaaaaaaaaaaaaaaagagagagagagagagagaaataacaattttctcaaaaaattgacccaaatataaatatttttaatgtccatccctcaattcatatgttgaaatcctcatctccagagatgatggtatccaaaggcttttgggaggtgattaggtcttggttggtgggtccctcatgaatgggactggtgcccttgtaaaagacgccctagagagagacacgtctcaccccttctcctccatgtgaggttagagtgagaagatggctgtctagagggaggcaagcccttacagaacaccaatctgtccaagccttcatcttgaacttcccagtcttcagaactgtgagttactaaattctgtttataagccacccagtctatagtattttgttatagcagcctgaatgaaccaagaaaattgtacgatattaaaaagttttaacgtttcatatttgtgcctttgttttctgaagtgataccaaatgttatatctatgaaactaatagagaatgtaaccataacagtgtagatttattttaaatattaacttctcaaacatagattatgcacaatttcctatacaatacatatttcttagaattgaacaaaatgagatatctaattaagtagacctaacctggctacttcaatgacacaaaacggaagaaagttaaaatccattttggaataaagcagaatacataattcaacatacgtcaaaatgtggtcatgctggtaaaagtacacactgagaaaatgttatgaatccttaaaaaattaaatatgtgaaaagtccgtagctattttatgatattctgggggcttttaaagaacactcatcttctacaaaaaaaaaaagaggaatacttgcataacattagactttcaccttgttaaataataatggctgctatagatatagcattatttttcttcacttgtattaatgaatttctgataaaataattaagattttgttagtatactgttaccatatgttcctttgtatttgttgatttctaaagcaattatcttatactatatcatccttttatgaggtcttgtatcaatctgtatagcgtgctcctttagccactaaatggaatcataaatggaaatcataatatttactgaattaatgatgagaattcataagcatgaatttcagaaataaagaataaattgatgttcagaataatttctttttcatggtgttctgaaatagtatttttggaaatgtctttctgttacatattaatatttgctttaataaaatccaaatataaagatatgcaaagctaatttataatatggaagaaaaatatcaattgggctttaatgaagttgctaaagaatttgttttctctgtaatattataaattttagtgaattatttcaaatacgagccaaatataggttaatgtcattcaaatagtaatattttctacataaatactggttattagtagaagaatgtagaaaaggaaaaaaacttcaaattattacttctctttcactatgaaaactgcctaaattgttacagcccttagatggtagatttatatatatagatatatagatatatatatataaatcatatatgcattattgtacttattcttctgtctatgatatatgttagttcctttgggtaagggttaaggtttataatcacaaaagtagagatccttcacacccttcatcacattactttttttttttttttttgagatggagtttcgctcttgttgcccaggctggagtgcaatggcgtggtctcggctcactgcaacctccgcctcccgggttcaagagattctccctgactcagcctcccaaatagctgggattataggcatgtgccaccacacccggctaattttgtatttttagtagagacagggtttcaccatgttggccaggctggtctccaactcctgccctcaggtgatctgcccgcctgggcctcccaaagtgctgggattacaggcatgagccgccacgcccagcccacattacacttttattccttttgaattactttagttaggggaatttaattgaaaatacactggatatacaaagcccaaacaataatacttcaaaattataaaaaaatttaagatataaaaagttttcaagctatagcaaaatcataggatgattagccaaacataaattactcttttaagaggaatttaacaggatatgcttttaaagagctgtggtagtttaataataatatgaaaaagtacttatgcaacatttatattaaaacaacacatttaaacataactagggtgatcaacagctacacgtgctacagataattatgtgatgaatttgatatggaaatacgttccaaagtcagataaactaaaatagacattagttataaaatgtaatattatttaatgtattaaaatatataattaatatattacatttaatgtatttttgcattcaatatcaatagttctcttatggatttgaaccatatttaaataacacaagtttttgtgtgagtatgttcacacacttgtgatatattctaatatatgactaacattaactatccatgactcgggagaaagtagtagtatgcataagtctgcatggtttaaaggatcttcaacattatcttcaaagtataacaataactaaaaggatgcttctaaagttacaattataagacgtctaaataaattttgctattaatgccctgtgaaacagttcatgaagagtgaaatgagttgtacaaggtaatttgtgaaaatatcttgtatcttgagaaaataggcataaaaattaggataatatggttcatcgatggcattttatctctttcagattaacttgctgattaataaatacttcccatttctgaagcccatcacatggattttacttatacaatctcttacatctgtttacaggcctgtcctaaagtaaaaggaaaaccattctgggagatggaaagcagagttaattactagaagagaagggcaatagaaaatgtggcctggacataaataaacattactaatatttatcaggttcacactcctgtctggagcaatatcctttttatcttacagccttaaaatcaaagtcagaagtgggatgcatgaaattgaggctcagtgggtgataatggctgtctttgagataaaaatgttgcagctaaattggtaacagaaaatgaaaactgctttcacactttcatatagtatcatgtgtggtccttgtcatctaagaagagagacgcattagagactgtactttgatatttagtgttatacggtaaattttaaaacaacaatcctattaagaacattaatcattaattctacaaaacactaatcactgtaaacaaattatatactgacctttggctgaagatttggatgtaataaaacataaccattaggatcgattgcaaagtaatacccattggggcacagctggaaaagaaaaaaaaaaaaaagcttggatatgcctgagtcacaattagaaatctatattcttttaaatacataatgtattaaatacacattgtatagcatgttgaaagataacatggaatcattttattttagagatgcttttaaccatttagttcctttgctaagataactgcccataatttttgagaattacctaagtgccaagctaagttagtacagagttctaaactagaaagggtatcaaaagagcaaatttcatcttactgtaaaacgtggtgtcagtcttttaatatcttccaaagacacatctactcccatcacaccaagaatcagctggttctataataagagggcaaaaaatggcattttatgtcaaaaatttacgtatttttacacaattatcatatgatcatcttttgcttgcattatggttatattccacattagtttaaatgtatatatagggtgaagcactctcagtgtcaatttacaaggattctcagctttgtttcccacaactttatcatcatcatttaacttagcaaagaaaatctagataattgaggctaaaatatataaaggataaataaaaatgtttgacacttcttgtacccttttcttctaatatttattttcactgctattgtacggtcagcccttatagctgtgtgtctatatatgtgagtttagattgactttatggtttactataattaagaaaccacaagaatgtccagcttaaagattatacaatatagaataagaacacattggatttttgctgcagatagttcctgtgtatgtaactatcctaaaagtatgtgaccatattggtgataaaatcctcaaaacactatttctagtcactgctaataacttctatataccaagcaacaggcatcatagttttaggtgcaagtagaggaggcttgtggcaaactgctatcataatcttctatgggacataaagatggaaattgttttaaaattttgggtccaaaattgttgtttcaaatggaattatataaattataaaataataagcaaaaaattataaaatctagtaattacaaaaacatttaaaccttgtgtaggcacagatagagtaagaaagttgtatcaacaactatgctcttttccatgaaccaatcctagtctgagcaaaaacttcccaactgaagcaatctcttagttcacagtgagatctgtgaacacgtatgagaaagtgagagttactcttttatgagttacaatatttagaacctgcagatagttaagaatggtaataggcccccaaagagaaataactgttttctatggccaccttattaacataaggagttcaactgagatatataataactgatcaaacaatgcttaagtgcagcagacgtcatgaaaccataaactggaaataaatatctactcaaatcaagtatatcacctacattataaaatcagtttctagtattaaaaaagtcttaacttcaaaatctcaaattccttctgaatcaagctaaaaaattggaatgcaatcctatttaaaatcaaaagcatttaacaaataataagtacaagataaataatttttagaacttttaaataggcattttactgcattgacaaaaaaccagtgctataaaaattaagcattctatgaaattattcttcctgtatcctaaaaatagaaaaaaaaagagaaatattaatttaaatcagatccttaagttacaagataatttttaaaaagctattgtttgggagttggggaggaatgatttaatataccaatgtacacctgatacaaacatcgccatgcttttggtctttggatttttctttctaaactccattaatagctcagatggattcttaaaatgtgcacacaatattactgtccatttatcatataattactcccagagtctgactctgtgttctcatcaggtcatagttaagtggagttaagttgaatcttggctctagggcaacagagagtttgacctgcatttcctttttcccaggtggttatcgcataggcagctgttgcctttgacctctggcctcacaagacaattacactgcatgtattttcttatggaaatatcttatccatgttgagcttcaacgtcacagtttgtcatttattattattaattttatcaattaacttttaacctttaagtttgtcttattttcaaattggccggttatgttgaagaccggaagagttccagtaatgacaagtcccagttcctaaaaatagattcagagagaaagggcaaattaaaattacaatttaagctttgtcagagtgcactaacctttgatatctgagattgcattttatagttactttataaagagccacaaaaactagtaactcattttgaatatctattaaaatttatttttaaaatatcaaggaaaatatcttggaaataattaggacctactaggcacctactgaagcatgcaacatttaaaataatcctctaagataacttcaaaaataatcagcttacacaaatagtcaacagcctgtatgcatttcagtaaccctgtgtcctccccctttttcatagtgatagttcacctaatatcagggcctccataagcagagtgataataaaatattattttaagtgattatttagcttccctttttgtagccttattctttattttttatgccctaagccaaagacttcatgctaaatgaaaaatgtgcagttgaataacatgataaataaaagaaacattctattgatactgcatatctgggatattctaagtaaatgttacgctcttcagaagcagtactacttttctaagtagaccccaaaataagcagtactttttgacaagtaaaattatgaagaaaagacaactgcaagcatcaaatataaaagtctagtctgaagagtttaacatagtagaactaatgccatcctattaatcagcacataatttaatacattaaatgaatccatacagattagtcaaaataaactgattttcaagtcagagtttgcttttgttactgacatctatatccattataattttaaccatttcatgtcaaaactacatttaacaaaatcactctttaaaataatttttattgtttgaaattttgaatttgctaaatgagaaattattattaatcttctcacgaatagtgattccaaatccaaatctcaagaactcagaacagagttctggaatcagaaccgagttcataaagttggatttggaataattattcactagaacattaaaaatatttattaatatcagggagcaaatgttgtggtatcaggttgtggttcataattgtgcacataggaggcccaaattcaatgggaatatgaatgaattagggaggagagacaataatagagaagcttccagaagaccaaaataccaaattatttgcagcaaataaaactaaggaaacaaccatacatatttgggtgcatgatgattgatatggtttggctgtgttcccacacaaatctcatcttcagttgtagttcccataatccccacgtgttgtgggagagatccagaggtaattgaaccatggtacggtttcccccatgttattctcgtgatagtgagtaatttctcacgaggtctgatggtttttaagtggctttccccttcgctcaacacttattctctctcctgctgcctggcgaagagatgctttccgccatgattttaagtttcctgaggcctccccagccacatggaactgtgagtcaattaaaccttttttctttataaagtactcagtcttggggatttcttcacagcagtgtgagaacagactcatacagtgatagacacatgttggcgcttataaagtcctaaccaagaacattagacaatgaaacatccttaattatataaattaatgcttccaatgaaaacctcccacctcaataaagtcaggctatagattaattcgtaaaactggtatccaaaagataatttagtaaggatttggtgaagtgtctgttagagctataatctatatgcatggttttaaaaatgctaccatggtttaagacaaggtagatatggatgtaatcatttcctttgcattacttttgcatttatactgcataccataatttgcttctaaaaatggtaaaatgtagcctaaagtgagttactagattactaacatattaaagataattatgaatgaactcatttgggcccaacttgaatttttttctcatttactaagcagaccaaaaacttgtactctactcctgagtactgcacatgtctctagaaaataagagagaaataaaacaagatttctctaccctggaattttaaaaatattttctagagcccaactcttgtcatatctctttttataaagagcttcactttgtctcctaattaaaatgaactctccacaatattgtcctaatctccccttattaccaaaaatgaccaaggtatcatttttttgatatactcagtgcttccccaacttttatgctataccccatttttatggtttcacttttcaccaccaattgcaaaaatcttacactaatatcagctaaaatgtctccattttcttaaccacaacccactttgcccccaatattggcttcattttgaagtcagaattctttttctcattatatccattatatttcgttttgaaatatatttaccttttcctttttaatataactgtttatttttgaccaacatatatttttaatctgctgtgtggagagattataaacaaataactaggaatatatgaggatcactttatcatcttcaaaacagtaaaaataacgctatatgtgtccaatgaatagcaaattcacgtgttccttttttttttttttttacattcagtttcagcttatagcacagcacatttagaaccaacatttcctcctaatgtcatttgtgctatcagtaagaaccttaccagcaatgcagacatgctggctaatgaacttccagtcaaaggaaacacaacagggcataattattgactcctcctatcatacactgtcctgtgatggatttgaaaagtgcaacattttgaccacagctttggatcactatgtgaccttaagtaaatatgtgatgtctaaaaggaacactggacagtaattttaagctagggcttgaggtaagcaagcttcattttatcttccttagcgtgcaaggctgctgttaatagtgcctatttttcttctaacttcctgtatatgtttattttctaaaaaccaaatgataagtaattctaaatggactgcattttgccctatgggttcatcattacatttggaaaagtagtaagaacatatcactgaactccaagtagggaaaagggttactgaatcagcatttattttcaggtcttattattttgattctctccaaatatattattttagtaaattattcataagttcttctcattaagactaaacataagaataaagcttaagtgcgatgattattatttataactttcatgtcaggaaagtaaaaattacatttaaaagattttcaactttggccctattgacatttttggagggaaaatactttgttgtgtgtggtaggcattttcctctgcattacaggattgtttaacagcgtgcctggcctctgtccactcaggggtgtccaatcttttggcttctctgggccacactgagagaagatgaattgtcttgggccacacctaaaatacactaatactaacaatagttgagatttttaaaaaagcaaaaaataacataatgttttaagaaagtgtacaagtttatgttgggctgcattcaaagccatcctggaccacaggttggacaagcttgctctagatgccagtagcaacccctcccctcaagccatgacaatcaaaaatgcagattttttccaaatgaactgtgaggggcaaaaagacccccttgttgagaaccactgcttttaaatataatgacatatctttactaaaatgtcaattgtgcgatggacaatttaacatgtgtttgttatttcacaccagatttgatcgcctcaatgacgtatttccataaaaagtatgaggttgaatctagcacaaaagattatattaatacatgaagaagtttgtgatgatttcagtataaggtaaagtttttgcctatctaatcgcatgtactcctgagttttagcagatccagctatagctgtggaggctagacatgcttctactagctcctctactttaaaaatactttcttcaaaattattgttctaactctgcaaaaatagattctaattcacaaagactttcatctttttttttacattaacaattaaaaaacttattgaaatgcccatgtattcaacattccaggttggaaattctacattcccaatgaagggatcaagtagacaataagctaacactttgcatttgtagttttctactacatacgagtctatgtttttatgtaaattatataaattctaggaaagaagtctgtgatagaagaaattttggggagggtttaatgaaaaggaaaacagagacatcatctagaaagaagtagaaatcatctgtgtgcttttgttatgacagtctttgactgaatagctcaacctcttaccaatgcatccaggtacacatttgtccattggacttgcttagctttgtctcctgctaaaaccattggtcttcccaaaacatccaaatattcctgtttatgggaaaaaaaaaaaaagtcgtggttaaaactaggaatgctgtgttgaaataaaaattacagagaaaaaatattctagagttaaaaatgaatatagaatcaaaattattgacactgaatatataatcagttaatttctattttgggtactccataggtggtatggctacgttattttgaatgaacaatatttgacttacattatttatacaatatatctaccccagtttttttctagtaacaatcagagcattgtttttctgtgttacagccagtaagtgaaatacgttccctgtgaattgtttcatgttaatctaaactatttaaggctctgtgatttactgcgtggaattgcacaaatttaaaatcatacagcagccacatactttctttcatatcacagattgtttggctgaaattcaaaactacatttaaacacatcaaaaaataaaggaaatactgtgccaaatctagacatcagactcaaatgcagctgctgtttcatttcaacattcagtgtattcagtattcacgtccacaaatgccatgttatttatgctaaattttgacttcgtttattttgtagatcttcagctatgtttaaaaaggagtagcaattttcatagtaatttatgattatttaaaaagaataaatatttaaattaacttaattactacattctacaaaaagttatttaacaggcatgttttcaagtgaatgatgttagaaaaatcatctccttgttgtaactttattttagattgataaatagatccacaggggttatttgggaggtatttaagttccaactaggtccctgtaaaatttgtccagcataattagtgtttaattttatacacagtacctacaatttgaagaaacttttaaaaattatttgtagtagactcaagttcaaattacatgaaatgtatttttagaaaatttgattttatttattttctatgatgtttgtaacatctgaaaataacaatatactcattttattaacctgagttttggttatttgaaaacacttgcaatgttaatgaaataaaaccaatgtatcaacaagatactcagtattttaatataggtgtaatattatagatcttttcattcttgctaattttctccatattgagcatatttaaaccagaaaaatatcttttacttgaaaaaaataatttaaacaagttttaaataatcatacctgagtattgattcttattgcaccaatggaaggaatttcataataataacctgaaatatacatatatgtttttatacataaatgttactttataataaagggccacaaaattattttattttataaatattttataaagagtattttgaaaacaatatatttcacttcaaaactgagctaatactgaaatatcaaaattaaggatggttaatgaatcttcacaacaaacacacaggctttgtgaaaaatttcattacatttcttagttactataaaataggtattcttctatgaaggaataggaaacatggtatcattaaaaatattttttcattggataaattattaaagatgcatgatggataattattatatttatataaaatctttgcctaaatataactttcagaaaaaatttaagttctttttgttgccatggtatcacagttcatttctcaaattaacatatgtttttctcagtaacatcattctttctgagtgaaaatatgagctcactgcaaatatttgaattatcctggaatgtataaggtaatatttttcaaaaacagtaattaaaccactcagagaaaaaaatatgtatgtcatactctcatatttaagctttatgaaattcagatattgtttcattcctaatttttcatttaagattatatctgatatatatcattcagtataattcagtgtaatacattattttatgaatgtggaaatataatcagatatcagaattttcatataatgtaatgccagtgtcaaaattggtatgtgttttctctataaaaacatgttcagaatcttactcttgtctgattcctataaaagttagctacaattttagcttattttaaataagtacacctaataacaactaccaaaatagtttttcttctaatttattagaagaaaacagatttgttacctttgttttcacaggccatccactgaataggtcctctgtcataattgtgttgaccaactgaaaacgtgaatacacgtacctggatgaattgaaaaataggtattcattaggctgaataaaatttaattcaatggcaaaataaaacagctaaaatttctattgaaaagagtgctttccagttgaatgatatgacaagaaaaactgaggccagtaaagccttcagaaagagaccagaggaaaatcacataacctactgtaaacacagactccagttgctacatttaaatttgtacctgagtgtcatgttgcatattccaatcctcaggcaggagtatgactaatgtttcattcatagaaagtacatctttcatggccagacgcagtggctcacgctcgtaatcccagcacttcgggaggcccaggcgggcagatcacctgaggtcaggagttcgagaccatcctggctaacatggtgaaaccccgtttgtactaaaaatacaaaaaattagccgggccttatggtgggtgcctgtaatcccagctactcgggaagctgaggcagaattgcttgaaccagggaggcggaggttacagtgagctgaaattgtgccattgcactccagcttgggcaacaagagcgaaactccatttcaaaaaaagaaaaaagaaagaaagaaagaaaaaagaaaatacatctttgaggtccaacctcacttcacctgtctcacctggttatatatgttatctacatagctagtcactgcaaaaaaagcttatttccctatttcataggtatgtagtaatgaaaaagtattcagaaaggtcattgtacttcaaagttgcttaacacaattaaactttgtgatggttttcaccatggaaatatttgggatgcacacatataattatgttgttagtatattacttattttctataaaagttggctgacacatataaatagatattctaagctcctaggatttttaaatataatcaaaatattgactgttcctaacatgctataaagtatgcaaatattttaaaatcaatagagagtttttataatttatttattgaaagacattgaatttaaataatagtgtgaaagtataaaaggtaaattccatgaggtcaacctatacttaataaaattatttttacatatatattgatttttactaatttagtaatctaagtaaacccatactctcagctcaacattttagctatttctaaaaatagacatgcagaaaatcacttttccatgagttcaaattccagtttgaactatgttaagagcttttccctaattcatgttgactgactatttgaatggacattttctaattgttttgtatcttttaactgttgcacatgatttcagagtacaaatctcaaaagagatttcacatctgttctctgttctttcactggtcttggccacacagatcacattataacaatccctgcccccaaaacgtacatcagggatgttgctatttcatttgtaaggttttaggtgagccactcttacatcatccaggtttgccttagctggttacgtaagaggccacatggtgaacataatccaagctttaaatacttcaaactgtaagaataaataattgtttctaagtgaatgacagaagttggtttttttctctctctcaatctatctttctctccaggaattcccaatcaaaatgcaatggtttcattttctttaattcatcagttaggtcatttttgggtctgtctataaatttcaatgtagggttactgcttacagagttgagcttctaaatggaaatatttttataagcaggttgaccaccctaactgataattcaatttaaatgccataccctaaacaatcatcaaatgaattcaagtcagggaaaaagtccagatgctccaggaagcactgggggatctctctcataactaacatttgaacccatacctcaaattttcaacggaagcatggctttgcctagaagttcctgttaccacaacaatcatctagtaaaacatttttcataaaatacttttcagtaaaaaaataaacaagtaagactatatgaatcttatatctatgtctcagaaaggcaagcacttctaataacatcgaggctacactcagatccacacatatgattatttgactgatgttatcattcaaatagtccaaataaacactagccgcccgccccccccccccaaaaaaaaagcttgttgctttatttattttgctataaaagtttcacttaacttctacgtgtttgcttacatggacccctcagaggttgtcaaaattaaggtatttgggatcagggctggggtagtgcacattctgtcagctttaattataatttttgaaacacgccaaactcttttgtaaacctctttgttctttttcttgcataggttcttggctacttaaatgtaagctgcattaactaactgaatcattcccatgtcatcaatgtataatttgtaccccttttctcaattttcatttgccttgttgtagagatttttaaagacattattttcctgaaattttattccaagtgtttactaaaatcctaattgcaaatgcaaccttctttataatttatacaactgctttaccattacaatatttacgcaatctaatatacccaagattattttatcttggttttacgtatatgtatgtatatatacacacacatacaaacacatatgcacataggtatttaatgattttatggattatatagattatcttagagctttctataatgatcttataaatatatattcagttgagaagaagtttaatataagtcattcaaaacttaggatctattgtagtgccttacacacattctttgacagtaaaaaatcaatataaaaaaatttcattccctagcgccataccattgttgaacttgttttttctttgtacattttagctaattacataagaattttaacttcactgatttcataaactttcacattacatattgtatagtgcatataaataatgtattggttaaatttaaaagaacttttgtgtacacaactttccacttggaattgtaaatggtttcattcctcctattccatactatgctactgccaccatgtggaatagtcaatgaactaaattccagatgctaaagtccacagagatgattgataccctgcttcttcagatgttttttttttacttctttaaacttacagttcttgtttaaccttaattttggagttatagaaaaataaagtgattccttgaaatatgtacaatttaaaacttaaggtaaattaccttctcaaagatgtgtatttgtacagttcttttaagcacatttgcatgatcttacataaaaacaaaatgacatacaaaaataactcaaaatgcttaactagtagtcacacaagctaaatatttcatcttaactctcactcaagcaaatcacttacattagaggaggtctacatccaggctaaggcgacttttgtggagaaaaaattcctttactcatgcctagtagtatatttataatcacaacactaggttcatataacaaatgcacatgaaaacttttctgttgtgagtaaaatgttcctagaaaagtagctaattgtttctcaacatatatgattttatgtaggctcatctttcaaaatgtttgcttctatgaaattttcatcatagagtcacacaagacatatacagtaacagatggctttgacaaatatttttcataatgctggagtacaggtcttcaacagaaatactgtgggaagctagtattgaataaacgttggattgggctttaaaagttccaagattatacaatttagcttctattgtagtgtcttactcataaatgaaaacaaatgtttgttaaaaacaagtgaatagatgcttgagtggtttctacttcttaccagagggtaagaagactttggtgttatccaacatatcagtaagttcattacagtatgtggtaagagcaggaccaaaactgggctattagtgtcttgcattttgcaatttgggctgtttcactatacttacatcatcatacattcttaatctttttatttaatattaaataagcagacatccttactggaggtaaacaactttttaggcaaaatatacttagtacacttatttatgtactatattattccttgaaaataaaaaaaattcttataattctggattcacacatagttatataattgtaaaagcaatagtaatttggggagcagacttaataaaattgaacttaaatccaggtgtggtggctcatgcttataatcccagcactttgagaggctgaggtgggtggatcacttgagctcaggagttcaagaccagcctgggcaacatagtgagacccccatctctactaaaaatacaaaaattagctgagcatggtggctcacgcctgtaatcccagctaccctagggtgctgaggcaggagaatcgcttgaacccaggaggtggaggttgcagtgagcctagatcacaccactgcactctgtctgggcaacacagtgagtgagattctgtcttggtggggtgggggtggggtggatggggtaattaacttaaaaattaaattcgtggacaggtgcagtggctcatgtctgtaattccagcactttgggaggctgaggcaggtggatcatgaggtcaggagatcaagaccatcctggccaacatggtgaaaccccgtctgtactaaaaatacaaaaattagctgggcatggtggcacacacctgtaatcccaggtacttgggaagctgaggcaggagaattacttgaacccgggaggtggagattgcagtgaactgagatcacaccactgcacttcagcctggtgatggagtgagactccgtctcaaaacaaaaaacaaaaaacaaaaaaaattaaattcctatggctttttcatagttataaacttacataattttacttttagttgtttcaaaactatttttcttctgaaaggaacattataattccaataattaaatttggtattacagctctggcctacttgatttgagaagacttttaagtaagagcagttttggctatttacaatgtattactgatttgttccttatatcccactgatttgtaactttatcctacagttctgacttctgctaatctgtttttgttttgttttgtttgaaaactaaaatacttgtcttcaattaagagttttccaaagccacagggtcaacctattttaaaaagccataggaatttgtttcccagcagaacccagttactggaaactgtcacctcaacaattatcagttacccagagttcaactttaatttacaataggcaaatctccaaagaataatggaaattagtctatgaagaaagccaataaaaataaaataaaaacttcagccttcgaatcatgttagaaaaatgaagtcagaaataggttatattaatctactctgtgtactaaaatttttggcattaagcctatgaaaatactagattggatggaatattttagggtaaaattctaatgtggtttccataattcacaaatacatcagaatccagagcatttgactagcctatatctccagttttatagcattatgtaataaataaaagtgtccaaattcacctttcacactttattttataaagcccaaggatctgaaagttacttgcagcctgcaaagttttggtgatccaccttagcctatgaaagctgtaaggagcagatccctgtggggaagtcttgctgtctgacttgaaggcaggctcctgggtgggcaaattatgattagcatagccacagagctgctcagagaaagacacagacaaatggccagtcaggcgcattctgcatgaggttacggaattcagactgtagattaccatcttgactctgccacttagtagccacatgactttcagcaagttactttacttttctgattttgcttttcttatttccaaaatgggggtgatggtgatgatgatattattattatataatatgattattccagttgtaagtgaaaagtaaatataaggcattaatatatggaaattgtaagctctgtaagtattagctatggtaatgaagatgatgatgaagacaacaatgtcttttatagtcaaactattagtattaaatgatgtaatattttccattagtgggtctttagccttttatgcctcaagaggaacctaaaataactcaaaataacaccttcctagatgagcaaatttggtgagctttatcatacttagcaacaaactctaatgaaaaagggtattttctaaatgccattatgtccacataagatatatctatacgaaatttcctgtatttattgcaaatttacagatatgaccaacatatgtgctagagtgtctgacggagagaagaatttaatcgatgtctgttgaattcgctcaagtaaataaaacagaaaaactgttttataaacggcaacaaagtgcagtagtcatgtaagttttgcacacacattcacaaagaaccaagctagtgtttctcttgtgtgtcttacctgtgggtgtatgacatattttcatactatgatatttttaattcactagcaactataatgaatcatcctaataacatcagattataaggaagtaatctgaagtttcctttttctctatatgcatttagtactagataaaggaagaataagctacgggcccactgaatttccaagcaacttgcagttctgcaaagagtattatcagctgagaggtcagaatataagctgtatggtgatttatttcagatgtttctcttgggaaatgtcaaatacttcactgacactgataatgagaatgctcatgaaaaactatgtgttagactgattagagtgaagggaaaggtgccatcactacattttttatataaacggaagtgttccctacttataagatgacatatataagaacatctataacagttttattccacattccaaatttaggaaaataatgttgtttttaatgatttccttctaaaagaacaaagctatttaatttttctaacatttatgaattttgtatagattaggagcatatttattgcctatgtactgatatgaccaacatatctgctagtaatgagcacctaccatgcatcaagtactgtgccatcctttaagaattaattcattggtatgtttacaaatgtatacaactacttcgtggagtttatattagagaggaaggctccagataaaaagcaaagaaagcattaaaataattaaaaaatggtaatctgagggaaagaagaccaggaagaaagagggtgctgaaatagagaatgataaaggggatgtctggggaaagagacaactgtagaaaggttgactgggggaaaatccctctgataagatatactgtgagcagagttcttaatcagagaagagagcagcagaaaaaccagcaaaaagtgcctttctggcataacattttaacacaaacaatgggcaatctcaattctaggtagtaaattttacttggaatttcaagtgccatttctgtgctataaagtttacatcatatcatatactctgtgcataaagtaatacttaacctcatttttcattcagtttgttttagatattaaaaggactttgtaaaatgcattaaagtcatattattcaaagctgaagatgtgcctggtaaaatattccttagtttgagggactgacaacactaattttactctatgagaaacaagtgtaaataaatgttatcagagacaagaacacacacacacacacacacacacacacacgtgcataaaacttatcttttaaattgatgatcgctctactagctgggcatattacattgtagttattgttttcagcttcacagtaactccagaataaatacttggtttttatgaacaaaggtagagccctattctaaagctaaaaatttaagaagctgttgaaagcatcaaaatatctgaaacaaaagtttttagaagcaatccatgtgttaaatagaattaaatgctacaagttaaatgtctttcattatcatatatttgaacatttcctccaaaggctttacttttgcatgaagaagccaagcagagacattagatatgcaataaattattttccatggattattttccttactatctgttgaaaaactgacaatgttcactctaactacataaaacacatctgcatattcagatatttgtaacttggtttagattttacaaactattgaccatttctagtttggatctgagagcaaaatagaaaagactttctcaatcattttttaaagtgaattctttaaaataagtacgttaagaataatgcattctcaaaaatggatttattgtcaagtgattataactttagatgtgcattctttattttgaaagttatttcatatcatatgcttttttctcatttgttctcattcaatttactagttattttgaaatttttattaatttgaatgttttttcattttttaaattaattctgagaattaaagaatcagagaactatttccttactggctaggcaatcttaagtatgtattgctaagcagtcccttggctattctatggaaaataaaataattttgctagccctggaaattatctttcaactctgtgtctggttttactttcctttattcatttgtttggactacgggatagagttcattttagttttggcactatttttaaggaggtctcatgtacatgggtgagccctaaggaatggcaatgctgcaggtaaagattataaagcaaatgtattttaatttggaacagctgtgtgaggagattaacatggatcctgttttaaagctatacctatctataatcaggtagattaattcccaagagtagcacatttcacaaaagaactcaaacattttgttctaattctcaaaccttttggcctcattaaattgtgctgtgtatctcctgcagcctcattcatcagctctccaattgtaactcatcaggcctacctggattgctctgaaagatttctgattcatctagatgaaatatgaatgtaaatgaagcattctgcagccacattagtattaaacaagaggcttgggggaaaacaaagagttaggtttttttttttaagctcaccaaactttctttcaagatgttgtaatttttctgtatttctaaattttattacattatggtaagaactaccatcctatggtgagatctaccatcctaacacacatttaaatgtacaatgtattacggctgattctaagtacaatgtttacagcagatctctggagcttattcatcttgcttaactgaaactttatgtccactgattagtaactccccatttctcccttctccccacttcaggcaaccactatttcactcttcgaatctatgaaattgaccatttttgatatctcatgtaagtggaatcatgcaatattttttgattggtttatttcacttggtacaatgtcttcaaggttcatccaggtttgcacatattgagaatttccttttatttatgctgagtagcattgcattgtatgtatataccacattttctttatctattcatctgtcaaggaacattaaggttgtttccacatctaggctattttgaatagtgctgtaatgaatatagaagtactcttcaagatcctaacttcagttttttttttggataagtatccagaagtaggctttctggatgctatggtagttatatttttaattctttgagggacctccatattattttccgtgggtgctgcacaattttgccttctcatcaacattgtgcaaggattccaccttctccacatcctccccaacacttgtcttttgtttctttgatgacagcaatcctgacaggtaagagatgatatctcattttggttttgatttatatttccctgatgaccagtaatgtacattttttcatgtagctattggctacctctatgtcttttctccaaaaacatcaagtacttagctcatttttcaattgggttattagagatgttttgctcttgagttgtaggagttattttcatattttgtatactaaccccttatcaaatatatggcttgtaaatattttcccaattccaaaagttgtctttatagctctgttgattgtttccttttctgtggacaagagttttagcttgatgtagtctcacttatttttggatttattacctatgtttttagtgctgtatccatgaaatcattaccaaaataaatgaatgccatgaagctttctccctgttctctttcaggagttttaacattttaggtcttaaattttagattttaatccattttgagttgttctttgtgtatggtgtcagataaggatccaatttcatctttatttgcatgtcaatattcagttttccaacaccatttgttgcacaatggggaaaccattatgtattgtttgcacccttatagaggatcaattggccatatatccatggagttatttctgggatctctattctgttccaaaggtctaaatgtctgtctttatgctagtgccctactgttttgattaccagaagctttgtaatacattttgatattaggaggtgtgatgcctccagctttagtcttgttttgttcaagatttctttggctattttgtggtcttttgtagttttatatgtattttagaatttttttctatttttattaaaaatgccattgggattttgatggaggttgcagtgaaactgtagatcactttgggtactatggaaattttaacaatattaagtcttccaatccattaacatgagatgtctttccattggtgtcttctttaatttctttcatcacagtgttacagttttcagtatataaaactcctttgttaagttcgcctcctttgttaagtttattcctaactgtagtattctttttgggtctattgtaaatgagattgttttcctcattttcctttcaggtagttagttgttagagtatagaaacacaactgatttttcaaatgttgatgttgtctcctgcaatgttactgaattttgtttatttgttctaatgagctttttgaagtcctttagtgtcttctatatttagatcatgtcatctgcaaaaggagactatttatttctgctactaatttctagtttcactccactgtggtcagtaaggagactgggtatgatttcaatctgaatttgttaagaatttgttgtgacctaacgtatgatctatcctgaagaatgttccatatgcacttgagaaaaatgtgtattatttctattgggtcaaatgttctctatctgtttaagtctatttggttatagtgttgttcaagtcctctgtttccagattgatcatctgtctggctgttctatccatcactgaaagtgaggtattcaagctttctagtattattgtattgctgcctatttgccccttcagtgctgtccatgtttgctttatatatttagatgttctgatgttgggtgcatacatctttgttatatattattgctggattgatgcttttattatataacatccttctttgtctcgtgtcagttttttttttttttttacttaaagcctgttttgtctgatataaatgtagctatccatactttcttttggttatcatttgcatggaataacttttttcatcccttcacttttagcctatgtgtgtccttaaatctaaagtgaacttctgataggcagcatatagtgtggttttgttttttatccattcagccactctgtgtcttttgactggggagtttaattcatttacatttaaaattattattgataagacaaaatttattaatgtcattttgttattttctgtcttatttttcttttgtattttctttcttcctttatgtttgtcattttgatattttaaagttacatgtgaacttatttaaaaaaagtttttttaaaaagttgcattcaaacatagaatttttaagagtactgagcatttatattttactaaatctatcgaatttcatttttacacattggccatttgaaagatagtatttctgtggaaagtgaaatgctgagttgataaacgtattatgtaacattaattttgtggctctggaattagtactgcatgcacaactttagataacaataaacaattatctttgttattaatatctgtgggctgcagatcgctcacacagggtgggtgtgtgtacagcaggcaataaagttagaacatgttcctcaattcatccacacacatttgaagccatatttgaagatggtgaaaaatatataatgtacatatgtacactattttatgtatataagcactctacacatacacatatgtcctgggcataaacaattactacacaaatgctgttgttttaataaaatacaggtatactcaaaagtataactgaattaaaggtggttgtctgctatcatttatactcattattagtggacacagaacatgcaaatacttgttttcatttatttgtgggatctaaagatcaaagtaattgaacttcaggagatagagaagagaatagtggttatcagaggctgagaagggtatgctgggggtttgtagggaggtggagatgattaatgggtacaaaaaaatagaatgaaaaagacctagttcttgacagcacaagagggatatagtaaataataatggtacatttaaaaataatgaaaatgtataattgggttctttgtaatgcaaaggataaatgcttaaggggatgggtactcaattttccatgatgtaatgtgattgcatgcctgtacctaaatatctcaaattccaagatgaacgttttattcatttaacatggccttctcacattagaaaatgtgggatgtcatttaacttcacagtgcatatgaaatgtgggacagcaatgtttccagaaattaatacctacttgtcaaattcagaaacgtgttccatctctctctcaatccctcctcttttcaagatctctatcaattagcctttctcagttttgtatctataagctttccttgtctgagtatcctttcattcatctttagcctataataatgtataaggtcttctattgtaaaataatatgcatataatcatatgtgtgtacaggtatatctcattttatcatggttctttgttgcattttttacagattggaggtttgtggcaaccctgtatcaagtaagtccactgttgccatttttccaacagcacacgctaacttcatgtctctgtcacagtttagtaattcttagaatagtttaatctttttcattattattacatctgttatagtgatcattatatctgatacagtgaatatagtgatatcatactgttatattcagtggtccctgaagctggcagaggttggctcatgaggtgtaaggaaaaaaggcatctctataacataaaagtgcaaggtgaagcagcaagtgctgatgtagaagctgcagcaagttatccagaagatgtagctaagatcactggtgaaggccactataataaacaacagattttcaatgtagagaaaacagccttgtatttgaagacaattttatctaggactttcatagctaaaaaggagaagttattgcctgcttcaaagcttcaaaggacaggctgactttcttcttagtagctaatgcacttggtgactttaagtggaagccagtgctcttttaccattccaaaaatctcagggtccttaagaattatgctaaatctactctgcttatgctctgcaaatgaaccaacaaagcctggatgacagcacatctgtttacagcatggtttactgaatattttgagcccactattgaaacatatgttaaaaaaaaattattgctcactgacaatgtaggtagtcgcccaagagctctgatggagatttacaaggagattaatgtgttttcatgcctgctaacacaacttgcattttgtagcacatggatcaagaactaattgtgactttcaagtcttattaattatttaagaaacacatttggtaagactatagctgctataaattgtgattcctcttactgatctgggaaaacccaactgaaaaccttctagaaagatccacaattctatataccattacaaacattcgtgattcatgggaaaagacaaaaatatcgacattatcgggaatttggaagaagttgatttcaacccttgtggatggctttgaggggttctagcattcagtggaggatgtaacagcagatgtggatgtggtggaaacagcaagagaactagaagtggacactgaagatgggctgaattgctacaatctcatgataaaacttgaacaaatgaggagttgcttcttacggatgagcaaagaaagtggtttcttgagatggaatctactcctggtaaagatgttgtgaacattcttcaagtgacccaaaggatatagaatattagatgaacttatttgataaagcagtgccagggtttgagagaaatgactccaagttttaaaagttctgtgtgggtaaaatgctatcaaatagcactgcatactacagagaaatcttttgtgaaaggaagagtcagtcaatgcagccagcttcattgttgtcctattttaagaaattgccatagccatccaaccctcagcaaccaccactttaatcagtcagcagccatcaacattaaggcaagaccctccaccagcaaaaatacaaagacttgctgaagtcttagatgatcgttagtgtttgttatacattttgtgaattaaagaatagagtattctttaattaaggtatgtactttttttagacaaagtgctatcacacaattaagagactacagtatatagtaaacataacttttatacacaatgggaaaacaaaaaacttgtgtgactcacttaattgcaattttcactctattgtggttgtggtgatctggaaccaaaccctcagcatctttgaggtatgcctgtgtgtgtgcgcacaacttgaccctgagttaactgtcttattcttctcttttatttcttagcaaatttgccatgatttaaaaaagaaaaacagcttatatttatattcctacttcctcattcctcatttacttctcaaccatctgttggcttttgctcatatcactttatgtaagagaggtcatgccaaagctatatacatggttccttgttcctggaggggatatccatttgaaacagatataaatatgtgtggatatatatatatgtatgtatgtatgtatgtatgcaggcttttatatatgtattactgtgtatcacagaactttgttatagcctctgaagttagaaaaacaaacaatataatatgcagttccaagaatattttaatttttatgttagagacaaaattaaatgaaacatcaccacaactgaatgttaactacttaattttcacaattgccttggcattaataaaggttatatgttttcaggaaaaatgtgtgtgtccttaaaacacagcatcagtatgttagcagacaaagagcaggactgttgaagttgaatataacttgatttattagttttataaaagtacatgtgatatgaatctttttatcatgtggtttatcttgtcatgaaatgcaacctttgtttaaaaagttgagctcctgtaaaaggtgactggaatgagaagctgtatttcaagataatgatatttagattggacatttttaggatccatacatagaaaagaagctttaaacccataaattcttcactaattcaaccaactgaacaatttgtgaaaatagtggatggaatacatttactttccttataacataaaactttgtgtgtttaaaaaaaagaaaaagatcaaattaatgatatgcctccaagacactatgtgttaatcctggatgtatagagaattccgaaacaggaaaaaaaaaaacaaaaaacaccacatttctgaatttacatgaaagcaacttgttcttatttatatacttttagttaaatccacctgaaaaaacctttatactcttttaaaatcggatatatctcatgcacaaatttgaacacagaatgtaaaattcattgccatctttgagtcaaaaacttttcatttttgaaataaagtatgtagaggtgaacaagattcctagtggttgctttggatgattacataatgaaaggaaaaaaatgatttatttacacttagtacctattaaaatgatataagtagtggcttgcacttatatacttctatcacaaaatagtatacttaaaattatgacaaatataagatgctaaaaagtcccttccaattatcagagtaagattaatttgtaaatttttgagatagtacattttatattaatagaattgaattttgtgttaaacttttgttatatttgagttcttcaaaataaggaaatgctagattatttaaaatatgtgaaagcagcatattccttgcccccagttatattttataattataaatctgtcctgtaacagcactcatgcttccaacctctgttacgtattctcaatttatttgttgtgatgtattaggaactatcactggatctgtgctctgggctgcatgcctaaagttcacagttaaacaggacactgtcccaatactgtagattttttttttttaatccagagaggaacagaggagagatgccatgggtagagtacagagtgaaggatatgtatatggctttgcacagtgtgctatgggatcagaggccaagcatctaaaggagcctacagtggcaaggaggttcagggacatcttccaggtggtgaggattaccctgaattttgattaaggagtaagagttattaaataaagatatgcacatattagttaatgcatctggatattcccattcatttctgatgatttctttgaaagaaatattcgtagaatctagttatcacttgaaaatattcacaatctattaacagctcagttcatttatcaacttttcaaaagtggttcctctatgctattaaaatcaccagatgctaaacaaaaaccaaaagatgtacccttaaaccttacattaaactgtatgacactgtagtacatgcagtaagcagagtttaattaatttgaaattatatgtgtattatttcagtcttttgatcattttcaaatactcataggccgaaaattttagcacctagagtatcttaaagggttccaaaaattttcatcaaactgttcgccattattcacaatattttgtcaccaaaccatctgaacatattcatttttgtctcgcttttcaacacccaatccatgtgtgttcctcaagcacatataaaacaatccattagagctagcaataaccacacctttcaaaatggtgaaaattccaatcagaagcaaagtgaatgggcattttaccctgcagagtcttcttatatataaatgtatgatttttgtagaaatttttgaaacaccagaaagagtttataatttctcattactttttaaatgaatcattagcattttaggaaaccaggttgagaatcacagtattcttacaaaatgtggagtgttggtcagaaaattgaaataagctgataataggacggctagaaaaagtagttagagttttgattgaagctgatattcctccacagtatcaggttcaatgaggtccctctctgtaatactcttcccttatagtaaaacatacattcaaatatattccaactacaaacactaatcttcacagtcttcatttgcttatgaaatgctttcttttaatacattatacctataaaaggatttgtcttcatcttttcttgaaaggaatcagttttcaaatgaggatgtagtttttgctgttgtaaactgcctttttgtaaatttacaaaacaatacttagacattttttgagtatttaggaaatttgagtattactgcaatctttaataattaaataatataataaattttatccaataaaccttaaagtttaaaatttttcctattttaccattcctttgatttctctattttaataacattttatttacaatctatgcataagaataaaataggacccatacatatactttattaacatattaggcatgagttgcttgtgaatatgatataaatattatacttaacagctctctaatacacctattagtttataatctatgattcatatggctttataattggcacaatcaggttttaaatcaaaaattctcccctcactaccactacccactatctctttaaaaaccacctagatcattattaaaatttaaatattataaaattacactcacttttttatctttattgtatttgttaaatatctcctgggctctctcttctcctccatccgtgaatagcataataatcttattgcagtttgctctggaaacattatactgttaaaaacaaaaccaaacaaaacaatatgcgtattattcacaataaaagagaaaataaagctatatggaacgagcatgagcaggttgcaagtaattaatgaaatatctgctcacaaaatatattctaagaactggttcctggatcagttcaggcccacccccttcaccaggccttcccctcaccacccagataaccataagtctatctcacttccttcagtctttgatcatacgccactttatcatgaggtgattactcacaactatgttttaaattgcagtctccctccaagatagtatgtttcttcatagcattttactttcttttatatacatattttattttcttgtttgtttattgttggtatcccccaacagaatgtaagctacataagggaaggaagctttgtcttttttgctcaaagacttctttgtccctccatagaagactgcctagcacataataaaatctcagtagtttattaaaaaaatgagcttttaataaatgtcaattttatgcacatatgattttatagtataaacaaaaaataacattaatttaaaatgtgtatcttcaatccactttcaaataagtgttttcttccctctttattcattctactttattcacttcacatgtttgaaatcacaaatcctaacactggtcacctaaaatgcaatgctcttttgttcctttgtaaatgctgatacctattcccaggatgtcctcttatcctctctcaaccaaccacacatattctaatcctgaaagactcaagtccatggtaaatcttcttacactttaaggtctccaaaagagttagatatgggagaatgatggattagcaccaaagggccattaaaatgaacaattaatttagaaagctggacttctccgaggtccaaaattattatcttaacttttctactgttgtgaaatgtgtttgctttaaatgctgagaataaaagatcacactaatttatgaatgctcagcttctttgaaaatgtcaaccctaggttcagtgctgtccaaaagaaatataacatgagcctcatatggaactttaaattttctaataactactttaaggggagtaataagaaatatctgacattaatcctaataatatattttctttaacccagtcatccaaaatattaatcaatattaggtatcaatcaatattgagatgttatacagctttttcttccataagtcttcaaacttcagtatgcattttatacttacacaacatatcatttcagatcagccacctttcaagtgctcactagccacctgtgattgttgttaccatattgtacagcatggcacagccctggcttttaaatgactaatattttttaaaaattattttttctttagtgttctaagtcattgaaggtccatgctctaccttattttttcaaagaagataaaacccattttcccttgtgaaaattaataaatacaacgtttttctttattaatgaaaagatcctgtttcaggtcatctcattccatggactcagccattagaacattggcagtaaaagcttttaatcaaacattgtgaaagcacaagtattaactaatataatttgtcactttcaacatggctgttatctttgaaggtaacctatctgaaaatctgactacacaaaaagttgcctattttatcatcaaaatagttttgtgaaacatgcctcaaatcccttaactaaaattagtttctctagtgatttgtcttttttatctgcatgtgtaaaatagtcaaaataatatgtacctaaagaactatcctgtaaaaatgttaaacaaaaccataggacatggttttgtttttgaagtactgaaagtactattattggatgcaaatatcaatgtaaatcaacacattaggtcttgctgatcatttgtatacttacgtaaataaaattataacaacatttcccgagagagagatgttagggcatacacaaaagaaggaatatggggaaaataaagaaattgttttgccttcaacatgatttttcctaggagtagcctctcaggacttgtggtggagccaagtacataatagcaaattttccatgcatttgcaattatctaaagaatcacacagcgacaacaattaactggctttgaacaaattaagccaaaaaaacaagattgtttcaataaaattacaattagtagagttggtaacttactttaatatggtagtttgctgtatttctgtgtgccagtatatagcacagcatctatcatatatacactctatataaagtttttttgaaaaatgcatatatatggtaatattttatgaaatggtacctgaagattaattcaaatctaaatgtaagttttactttgggactgatatgtctaatgctatttaatacttgcttcagtgatcttaaaggtaaatgctgcgaggacaaaaaaaaaaccagaatggcatttgagcaataagatgactggaagtgtttgaaagaaaacacaatatgcttcaaattattttaacataaagaatttcaatatatatgtgggatgtatggaaagtaaaacacattagacttacttagggaacaactgggaccatattttaaaaatcactacaattgtagcagttataaaggcagcaggagaggccaataggagttaaatcatattttatcagcaactagtaataaatctggaagttaatgtggcctctctagtgaggctacctctgaaattgtactttacacttgaaactcctgatcatttcacaactgaaacctaaacaggaggcaatgaagtgaggggaaaaaaaatactaagaagaataattaaaatgccaagatcaaggaaactcaattattgacttaagcaaaaaataatttttatcaaaaacaaccatattcctttactagaggaaggatacatcttaatctaacggttaattacagtacaattttgtagttttgagcttttaatttttattaatgaacatacaacatttaacaaacatatgcatctcaccacacattatttcccttggaaatagcagggctgcacatctctgattttctgtcttcttaatctaacggtgtctattaaataacatgacctcaaattcaacatatctgaaactgagctatttctacccccacatttcctctatgtgtgttcctgtgcaatcatctacttactagttcagttcagagaatgtagagtcacctaagcccctctcactctgcaacccagcccacaccacttaatcagttcccatgccatgctccttaatagctcctcacttctattcccacaccagcatctctacgaataccttccttaacttagaacactccaaggccatactataaagttttcctttgcccctaaacacttccttaactgatacctcatggcctttccatttccatcaagttcctatattgctcatgtcccaactatgccagccatctgcaattttttactgtgctatgttgtgtcacacttctgtgatttgtctaaaatatgctcctttttctgaaataattttcccttcctctacctacctaagttctaatcattcttcaaaacctcattttcacggaaatgccacacttttcctgacctcctttgaggagctgggcccatcctctgtgctgtcccagggaacacgctaaatatcctgtaatggcacttgcacactgttctgtggatgatgatttagcactcagagcagctggtcctgtttacttctataattccagcaccagcactatgacaggaaatggtgatgcattcaataaattttggctgaatgaataaatgaatcacccaattggatatctcaaaaactatttagaatattcactcaggaacaacaaactcatatttgcataaagatcaaatataagagttcattcagtgattcagcaaatattaacagacattatgatctgactttttaccagatgtgggctagtaattacagcaataatgaccatgactccaataccacccagcaacctacacctgcgtgtggtttgctacatgccaggttccgtggacaatcttatgcacaattctctgaggtacatgtcatagtgacctctaatgcatacaagtggaaaccaaggtgcagagaagtaaggttcctactctcaaacatgataataatattgcctagtaagaaataaaataattgaacaatggtccctgcttttaagtaactcaaagtgaaatagagggcaaggcaatttaaaaacactagtccacagtatgagacacacactataaggctggaagcggtagctcatgcctgtaatcccagcacattgggaggccaaggcgggtggatcacctggggtcagaagttcaacaccagcttggccaacatggtgaaaccccgtctctactaaaaatacaaaaattagctgggcatggtggcgggtgcctgtaatcccagctacttgggaggctgaggcaggaaaatcgcttgcacccaggaagcggaggttgcaacgagccaagatcgtgccactgcactccagcctaggtgacaagagtgaaactccatttcaaaaaaaaaaaagacacatgctataacatggggcaataagcacgccagtatctgacagtctagacactgatgagtgattgtggggaatcctcactcagaaagaattcctgctccgggagttgcatttctgttcatcttaatgtctaccatttggaactttctgtacattttaggaacaatttaaagacccaaactagatgtttaaaactaaaatgttctcagtaaccatttgatgattgaaagtgcaaggttacagataaatactgtggtgattgagataagaaaaagtaatgatattctatataggccaattaagtttcaagtgcttattcaaaattaaattatttccttataaatttttttaaaacatagataaaaaatatcaaaaacttaaaaatctacattttagatgccttttgaattttaaattcaaagataaaaatagttcaaaggtttcttctgcctgcacacatctgtgttttaaataaatgaaaaacagcactatctaatcccagagagtagtaactatcagaatattgaaattcagatactacaattgaacaacaacaacaacaaaagacatagcatgatacttacattaagcagctgttcaaaagcaaaactaaagcccttcttataatctgtaattcctttggctgtgatattattcaccgcgtctttcaacacttttttatttcttacatttgcttggacaaggtgctgaaaacagcttacatcctgagcattgctgttaaactgcaaaagattaaaaagtaaatatataaatgaacattaaaatcaaccatatagttttcatagaatttgtgtttgatactcctaaacggtattgcattgcttactctttcaaatggaaaagtgagtaggctggtgacaaaggtgcattaagaaaccaatggctattttcatctgagctaccaacccatactggaacgctgagtctgctgcttatattcccgaagcctgctttccctgcttataaatttgagaattaaattatatgacatcccttctagttctcaaatttaatgagcatgtagaaaaaataatccaaagcaatgaaatagatgcaggatccagaaatgatatgggatgcttgccctggttgtgtggacatgttaaatattttcattgcctcttattaggaaagactggttggaaaagtaatacactgaataacatgaatcaatgtttagtcattttgaaatctgatggtactgtctttctacagaggctaacagaggaaagcaatctgaatcaagaacaactggtagccttttagaaatatcactttagaggttactaaagagtgccaggggaaccttggaggcaaggtgatggagccctgaacagcagagaggctgtgggagagaaaacatcaactccaacgataactgcccaaaatggaaaatttaagaacgatcatcaaagtaacttcgtcaaccccataaaaaatattcacatcgttccctggatatttccaaaaagaaagaacaataggaatgctgcaacaaaatccaggataagaggatgagtggagtcatccaatcatttattaactctgtaatttgtgaaagttattcaggctcttggcacctaaactgtcacatctgcagaatgggaataataaaaaaaagcatatttgccagaaaaaagggactggccagataaaatgttaaagatattttcacatcaaaaacatatacttattttaatgagtgggtcataagttattacatattcttgcaaatataattcatcatttttttctctgaagatcactgaacgtaattataaggtacattgcacagttcatcagtttattaagcaaatatttactagcagcctattatatgccaagaatcatggcaggtagtagttttatgctttcagacataattatctgcacacacaaaaataccataaatatataaacagttatatagtgtctactatgtgctgcatttactacatattctacaaatgtaaatcatttcgtctttgcaaatgctctgcaagataaacattatcattatccccattttatctacgaaaaaaactcatcctgcattgcctctcaatatagtataataaattatgattcattctataaagcaatataatattatgctctagaagacaatatcaggagaggcatttctaatttggactgcaaacatttgaaagaaaattctcctaagaaaaggcatttcctgtgattccagagaaatgttccagtgaagagcacaaaggaagaacattccaagcaaacagaacaacatgtgcaaaggccctcacatggagacaaaagaagcctttttaagaaaacataaagagagtgagtttagctcggtctcataggaggacaaaagacataaaatgagttcagagagggaggcaagggctagatcatgtggagtctaatggaaatgctgaagatgattttattttctgtgaaatggaaagtcactggaagatcttaagccaaatgtaaaataattgaatctggaattttaagagtgcatcctagctgctgtgtggaaaatggacttgagatgagcacaatataaagcagggagagtaatcagaaggctttgcagtaacctagctgaaaatacatagtggttttgttatttgtggagatggttagaaagggaagaattcaggaggtatttctgagaaagaatcaaataggacttggtggtggatttagcaggaggatgcataacagagcggtatcttcaataactgccaggtttctgacatgggcatctggaaggatagaggactggagggatgactggttcagggataattgaggaatagagaagagaagcacagagttcaatttagggtgaggtttcaatacatgtgagatatgcaagtgtacatgtcaagaaatgataacatttaaagcatgaggctcaaaagaagtcttggctaaataatttattcaaaaaaaaaaaaaaaaaaacagaaggcttcaggaaaaaaaaatggtttaaagccataggaaaacaaaacaaaaaaaagtagagtagaatagcagtccctgagaaaactaagtaagagcaagtttccatggaaacaggagagaaatcaggagattggactgttttggatgagagaaaaatgtgtcaaaaggaagacactgtgtggagacagggaagatggggacttaaaactgcccagtagggccgggcacagtggttcagaccagtaatcccagcattttgggaggccaagacgggtggatcacctgaggtcgggagtttgagaccagcctgaccaacatggagaaaccccgtctctactaaaaaatacaaaattagccaggtgtggtggtgcatgcttgtaatgccagctactcatgaggctgaggcaggagaatcacttgaaccagggaggcggaggttgcagtgagccaagatcacgccattgcactccagcctgggcaacaagagcgaaactccatctcagaaaaacacaacaaaacaaaacaaacaaaaaaatgcctggtgaactcatccacattatgtaggcagccttgggttgggggggtggggagggcagaacgaatggacagcaggagcatctgaatgcaggcaaatctgcaaagtgccttggctggatgcagagctggaaaacagggtggcatctgtagggtagactgggggtcaagaaaagtctattttaaagctaggggtcactcaagcataagaagactggtgttaaagagagaaggaagaaaaagatgcaggaaatagaagagaggtaaaaaataaagctcgtcgaaaggtagggacagatggatccaggtgacacacagaggaatggccctttaggaaaatgcacatcaacttcattattctaggaaagaagagtggaagctgaccgagccaggtggtatgtggatttggatgatgatagttactgtctgtggcatttgtctcctttaacaatgaggcaagatgatcaggataatgagaggagaaggaaggcttagagaaaagaaaaaacaagaggtaaaatgtcctgcacagatagtaagtcctttttcatgtttattttgaacaagactttcatgaatatcaccagtgtgagaataaagttccagtatatttatttactgttttctataaattcaaatattgaaaactgagtatcttcaggtccaaatgaccagtcccactgcctcttttatcactcttctattctttggttattggatgcaagcttattctacatgttccattttcaaaacaaataaatgttagcatttccctgtattggtaagtaaaaatacagtttgccaatacattaatagtaaagtgaccttagagaattattagaaatggttacaggaaatattattaactgacttatttaaaccatgaatcaccataaaggtacaagttatgcagaaattgagcactgaataatgtattgctcagagtctttcagttggccttgacctgcttttaacacagaaaagtgaagcatctcattaagtgactttaacacaaactgattaaatgtaaattcattcattaaatatatattcagtagtgtataacagaattactataattgcactcatagtaaaactcacaaataatgtacagaaaggaataacttacaaagtataactccctatagcaaatcttactctcctaggaaagtgatgagaaatttgaaagtttacaatcagataagactatatttcacagatatcttagactcatcagcttatatcgtattatgtatgttttaaaaataggttaattttcatgggctgaagtggcagtctttgataacacgtgcctacatactaatttaaaaccacatattaaaaaccttagagcaaaagtgtaatagcaaatatattacagaactttgaaatggtatatggcgagtgaaaagagattgaaggagctctgattttttcatcaattaagaaaatacttcttgtaaaagtgtgtatttaacatgacagagtcagaaatccaaactaacatcacattgattccttttccaatcccagaaaattcaactaagtaggtcactcattagaactgctgaggacaatttctgttagcctgtttagataggaaggcacgtgtgttaacatgggcatctggggtaaaaatcctggagggtttgtatttctactccagcattggggcattctttcctttgcccttccacatctcttgttccttctgccaaaaacactttttcccactatatgtactgttcctctgcctacaatactttttctcccttcttcactcagtcctcatgaaagttttcatgaccttccctgactagattaagtcacccaatactaagctctcttaaatctatctcttttttacagagcaccagttataatttcatatttctctgtatcctagcttaataaatagacccctctattggattattagcccacatggccagagaatatgtccacaccaccactgcattttctgtacttggcatgtaataaacatgctataaatatttactgaataaatgaataatggataaatgtttaaactctttggatgtggactttaagaaaattagaagccagtataaaatgttgatcaataatcaaactatggaaattagaagtcagtgtaaaatgttaatcaataatcaagctatagatttataagtagatgaattgcatcttagctctgcaatatgttgttaaacttgtacattcaaaagtacaaatactctgtccaaatagacattaaaatactcaaataaagatatacagaacatctaacatagagtctgacatacagtagatgttaaatggcaactctattgttttaaaaattattttagtaaaaaggattaggatactcagtactaaaattagaacagattcctaattcataagattcagataaactgcctcagctgtattgagcttgaaataaagttcactaacaggatgatacaagtgtccctcaaacattagtttggtgtttgaaacagtttctgataaaactatgatcaatgcatttcaatacttccaaagaaacttcttattaaatatcccagtcaggtacacaaattgaaagatgctttccagtcaaaacaaagtatcagtatctcaaatgaaataacccaagcttttggttttgtaaaggcagtctctatttttgctctaatttcccctgctgaatatgaaatcattccataaaatatttctgagaagagggactctgcttgtcatcacattatgtcaggatacaaacaatgaaatattcctgttgccttaatacacgctacaagtcaaagaagcagaaagttacgggaagtgccctttgtctggaaatggcaactagaacacatcttcttggagtaccaagtcttcctttgaatggtttagtgcagtcaagtagttctgcactggaaacattaagaattaatgacaaaagacattcttaaggtcacatattctacttgaaacttcagtgaaagagaagtagctcatttattatttgcccactcaacctgtctttttaaaattatttttagttttaaaaatgagaaagggtcttactattttgcccagactggtttcgaattcctggcctcaagtgatcctcccaccttggcctcccaagcagctggaattacaggcatgagccactgtatccagctctcaacatgtctattaattcgcatcccttcccctcagaaagaccgttctcctatgtatggattctaaatgtttaaaggcaggctttctttagggtactttgtacattgtttagtcctaaagcatttttaagaagcaaaaataggacacaactatagtttctgaaaaaattgttcaatatttattacttaacatgtcttaatgttttattttctctatttctggcatgtaaaataaataatggtgcaaaattgttggctcaagccatgtaatcatcagcaaaaataataattcaaatccagacctgactgctttggaaaaggattttttaaattaaaataatattagtacacttatttacacaagttaactatgatggataacatacacaacaaatttatattttgtaagattaaataatttaaataagaaacaataaaattttgcatattagtaagtacaaacacaaattatggtatcagacactatccacattttggccaccagatggcaatgcaggaaaataaaaggaaaatgaccagaggctgtgcgctccaaaattttggctgtgcttgttttatgtacttattcctatttttaaaaaactttcaaaatttattttgattttcatatttttcatagtagatttggactataagagattatatgaaaatgattattctaaaatccggataaaatagctgataacatttattcttacatatgtggatacattcccagttaagagttatttctggaaaactgataagaaataagatttataaagtggctgtttagaattcaatgtctgggtgaaatgttataactgcagtcaggactttggttcatttgctactgtgacttagctgcatttttgtatgtttagtatgtctttgaatttcagaagtcaataaatgaatagaaaagcccagattaatagaaaaaaatgctttctaggttatctgttaccaaattactttccaaaaattttgtgccaatttaaagtatatatgtgctagtttcactgcagcctcataaacacttcccattttttatttgctgaactgtaaataaaaatatttcaatattttaactatttgaatttgattgctagcaaaatgacccttctcatatattaatttttgtgtagttctgtttttccagattgttgcttactatttaatctaaacctatgagcctattcctttactatttcttaaaagagttttgtacttagaaaatcaaccgtctatcagtcaggaaattattcatctgtaaccttactgatgtttcatgggttttggtatatagtcatggtggaatttagtttccccaacactatgaggtgataacaaaattaggcaatttgtttttacaaatagcgaaatttcccatttatgatacattcattcatgatacattccttacaacaaattaagattttgaatacatttctgtaattttttagtcctttgtccctccgttatttcatgagcttgctttttaatatgaataattttaaaaagtattagctaacatgtattgagaatcacctgcgtgccaggctaaacacttgatatccattaagttgtttaactttcaacaagctacagttttagttttaataggcttcccattatatagttgaggaaatgaggtgtacgatgttaaagtgttcagagtcaaacagcaaccaagattcagagctcaaccccaagcgcaaattccctgacgcacttttctctaaggtctttaatcattttcaattacagtttaataacagaggagaaagctaccacatcccgtcatgtgatattcttcacaactgtcttcctactgcagtaactttagaaatttttgtcaaattaaaattgctctcatgagtaaattagaaaaactgctatcttcacatgggtatccttttcattccaggaaaaattattcattaattccaaatatcaaatcttttaaatatatctctcacactcttttctctatctttaatataggtcctaaatatattactaaaagtactgctagttaattcatgacttttgctaatgttgtgaatgtgattttaatttctgtcgttaatccctgtccagggaaaactagaaggtatggtcaccctctcacagtcagagacataaatatcttcactaatgacactcatggagttggccactccactcttcaagttgacggtgctgttcccaacagtggctgctggtttgcggtttccttggtccattgtataaaaaaagaaacatattgagaatgaattatctcttctttaatcaatttaggaaaaccaagtctagtccaggccttgcctctaataagcattacagccaaaactgattcaattatctcccctaagctgcagattgctcctttctgaaataaagggtttttctagattaggtggaaagcccttcaaattctaaaattatataatttacatcagctagtttaacaatcaggacaaaaatgtaaatatggaataaattctgtatatgtctaaaaaatggcaccagtagataaaatggaatacaattccctataattataaagacacgaattgtgtttgcctataaatgtaaatcatcattcatcaaacatttcaataaatattttcatttttaaacaaatatttcaaacaactcaaatcatgatgtaacctatatttagtctgtttaccttgttgaaatcttggatggatttctgaataagtcccaattaccatttttaatatattctttttatattttgatagagaaaattttataattctctaatcatattcatttaaaaacatttgaagccattgaaagtatgctgttcttttacttgaaatgtaaactgaatttaggatccccctgcatctccacctgacatttctgtcttctcaaccatctcttaaccaaccactgtgcactcctgagtccacagcacttttccaactggaaaaatgggcagctttctttcccactccatcattctccaggtacaataaccttatcagtattatttccattacaaatgttttttgcatagccctctagaaatttgaatgccagctcctgaagacaaaaccttaatgaaatgatgaaacaatcacatactgtctgatctggtcccctttaccaacactgtgaagcagacatgaccaatatgtacaatattttcatgatacctgaagctgagtacttggaaaattccctagttgaaaaataaactaaaacagatggctcagtttgcttgaagaacacaataagaatggcatacataactaatgtgtttgtagagcagagatactacaatactgatcatatgagtgaggatgactggccacataagaacacaaagttaacttatcactgattgaaactgtttataaaattctgacatccatctagtacattttttgttcagcactgttctgattgacaaaaggtagagtcaattcaagaaccaccactacgtgccttgaactactctatgtacagtaacattagtacaaaaaagactctctctatactcaaagaagcgtacattcttggagaggagggaatacagagatatagaaaataacaaacatatgtaaaatatcaggtgaagagaaatgatagaaaaaatgaagtgacgtgaaatattaaataaacgaagtggttgaataactaaaatcggaatgctgtctgagagacagtagtcagggaaggcctctctatcacgcagtatttgagcaaagacctgagctgggggaagatctgggggatgatcaggcagctatctaggcctggaagcatccagattcatgtaatggtaagcagaagtaatttctcatctgtacacatctacaagacattcactagacagaaaggatacatccgccttttaagaaagtttattcacatcaccaatgaattcttataaacattaaattgtatctgggatgcagaaacagctgatgacagttatcaactagggttgaaggaattatattcaatttaactcagttccactgagacaaattatatacatctggaaaacttagagcatgattatgatataaattaatgacaaaaagataggtaaagaagatacctatcaaactacatagcaggagagatttcataacattttaaaatatattttaaagtgtgcaataaacatggattactgaacaaaacattacaaaggtgaattagttgtagaaaaaattgccaatatttttatttgaagtttagaacttatacaaattgtcactttatgaaaaatctcttatacattaacataaggtaaaaatattttcatgtcttagcatattagttttcaagctataatatatacatcgaaattctcaaaatgctttttttattcctctaggaatttgatgaaatagatttttattcaacaattaagattgcagtgtatgcattttacaaataagttctcatagtgtcaatttacatttgaatttcttttgaattttaagcctactaaataattaagaacaaatatgatagtttaatttaatttaaagaactctgaacaattctcctacatctattgctcaggccagcccaagtcactctctttacctacactcaaaattaaatgaaactataatttaaaaaatttcatctaataagtactcacatacatgacatcttttcctagtccttcaagccccatcaaataagtcaataacttttataattctaaaaacaatagttcagtttagaataaaattattccctttgcctcaccctgaatattactttgctgtttcctttttacatatacgacgaatttctaagtgccaaaaacttagtgtaccatgtaattaatgggaaaaaaatacttattgtacttgtcaacaccttcttataaactctctttatatttccaaagcaattaagttatcttctggcaactcataaaaaaaaaaaaaaaagaaaaatcctaaataaccttggcggctttgccctgctattataacaactaaatttgtccttttctttgatcttttcttactgtccataatttctttatgtcttttaaatgaaaatacttttataaaggtcccatctttacctaaaaaaagtgcataagaagatagaattcttcttcttttaacaaattctcttaattccatttcttcctgttttaagacctcctcccatccccaaagaaacaaatgtctacaaaataaaaatattcaaacatccatagtattaagaattctataattaccaagctcttaaaatctgagtcagtgaaaaacatgattatttacaacaagccccagttaatcatctgctgaacttgctaaaggtacctctttagtatactgatttcctcttctataatgacgcaaagcccgccagttgtacacacagttaacagtaatgcgataaaaacccctgcacaggaatcacccgggggactttccaaatgcagatgttctccttagctctggagtgcagcttgagatgctgcatttgtacccattgcttaacagagctcccaggcaaggctcagactgcttggctacaggccccacttcgatggcaagagaataaactgcagtcttcttgttgacataaatgagcaatagatcaacataaagttttcctgaactctagatggatggcttttgataagacaagaaattattctcttagatttgtcacaaaactgtattgacatggcaaatatcttttattttctttgagctctggcaaaaagagggtctgttttctaagaaacttttagcactgggggatagaaattgcttttaagttcaaattgtgcagcaatttacaattgtactcattttcataggctgagtagcgaagttccttatctaaaaaagccaacaaaacatgtccttgtctaggaatacattaggcatattttagaaggaaatctgaaatttaaagcacataggaaatggaacaattgaaatcatctcttacttgcctacacagtgcaactccatatttaaacaacctcctgctctggtattagttggtgttaaacaatcaagtcaggaactgaaatgtctgagattttatagcagttgtaagctaacaagtaagcctcctacagtgtcatagataaaaggcagaaaaaatacaagccctctgagtcagagacaaagagtttattactcatagcaacagaggagcagagtaacatctttgtttgcacaagctgcccaaacctcaattcccacaggatgacaggaggacagccaggggtcacctgcataggtagtgagatgggtttccagccaggagtcccaagatgaggaagtccctgatcttatacaggggcttctgatggcccacactcatcctcccctccagagagacacaatagtttaattactctgcattgaaaatctcttcgggagaaggagaaatctctttactatcctggaatgcaaataaatctgaataaattggctgttaatgcttagacttaaatgtgaaagattcataaagaaatgtctcccaacagttggtggaaaaatgttggaagatgacactaaataacaataatcatcatcataatacatgattacaatatataagcactttacatgtgacatttcacttggtactcaacaacatttcagcaagttaaattatcctgtccatttttaagataaggaaactgacagaagccctaggttacttgtgtaaggtcataaaactagtagtttccaaagctgcacagttattcctatgcaattctaccagtccatctaagagacagggttgcctgtgaagaatgagtcaaaccagatgtgagcttactaacactgtccatgcagggataacgtgttggcaggatcattccatcgcgttgctctttacttgatataaaccaacatatattggctccttgaaccgcatactgtgggaagcaaagacttttacaatctttagaataccatattcagaattattgtttatatagacaaataataagcacagacctgtctcacacagaggtctggacccaggaaatctgcaggcttttatagcagttgcatttagggaaaagcttccagctgggaaagggctcaccttcctttccagcctcctatttagctatggttcttcacttttgactttgtacttacatttataaactgtcacttctaggactgctgcttagcgactacaatctggacaaaaggtacaactaactttttaaaaagttatttcctacaagcaagagcaaagatataaggaattatattttgattatttttttttctggtaaaaaatcaaagacagtattttataatgactgtgaattggaaaagcttccacgaggaaaactgactcaaagatccttaacataatcataacatgtgcatctaattctttagtaagaaatgtgtggttttattaaaagacatgaagatctcctttggttgttaacttttagcatattgtctgcaatccatatacattttcccatcatcctccactggcttgcagtattttactcctaaaatgtcaaactccctcacattcataaacaaattcaaatccctgtgtcaacacttgaaattctgcctgcaaatcagaacacgctgtgattgaattgctgctcctatcatctaccactgactcctatcaaagcatataactggattagtgggaaaacagctacattatgcttgcatttcagctttgctaacagcaggcttcctttctgcaacaaagaacaaccctggagatagtagaaacactcagaaatgatgcagcgttagttctgacatcttatacatgatttaagcatgaaaaattactgttatttttaaaaagaatgaaagaaacttagaaaaataaccctaaaaatgagaggctacttgatttttctgtttggtggcttctgggcaactttgggaaagtgttaatatagattgcatcctgagtctttggatgacccacattcttttgggtatgaagataaagagaaatgcatgaggtctctaaggaaaaattacggtcaaagttaactatagaaccactccctccttcctcagtgccttattactatggattcctgaagttacaaaagctaaaggtatattgttgctttcctggactttcaaacagctttagagagaaaataaaatacacatgcacacatgcacgcacacatacaacttgacattataaatatattttgaaggtttttttcctgagaatttccatatcagtaaattgttaaatctgtatttaatgagaagggcctatatgttaaagataaaaatgtaattttacttttttcttaccagaatgttgcataagaatcaattctctttacctgtatcaatttcagacagtatatactcaaaataaagcagactaactcataagactgaaaaatttctttaaaattatgaatttaacgtggttgacactaaagattatatataatgtggttgacactaaagattataaatgcaaataagaatatatgaagtttcataagagcaaaagatacacggtaaagaaagtaaataaatattcctgaagatttagcctcataactttttggttaaatctagaatcatgaatgaagatggctacactccagttctttctcttttcttggaaaaattgctaagactttttctactgttttcttatccgcaatattaagaatagtagtattatcaacctcacagggttgctgtaaagactaaacaaattactatgaaaaacacttagaacagtgtctgccacttgaacattgctttaaaaaaattaaatggcctgtaatcccagcacattcggaggcagaggcgggcggatcacaaggtcaagagattgagaccatcctggctaagagggtgaaaccccgtctctactaaaaatacaaaaaagtagccgggcgtggtggcgggtgcctgtattcccagctactcaggaggctgaggcaggagaatggcgtgaacctgggaggcggagcttgcagtgagccgagatggcgccactgcactccagcctgggtgacagagcgagactccgtctcaaaaaaaaaaaaaaaaaattaaataattacctatcaattatgattaaatagaaggttaatgcacaaataacaaaaataatgaacacgtgtttactttggattttatttgtactgattttctgaggagcaaatctatgtctcaatgtaatcacttaaaattatttagtgagttttcaatcataaaaatgtattaatgattattttgaaataataaaattaaacaaaagtgtacagttaacaaaacttcagagtgtagttgacaaaaaaatgatatttttatagtaaataagagccataaacaagtaaataagtaaccaaaactaattaagcctaaggaggaactaggagctgggaccagtaataccaggagctgaaaccagtaatacgtatctccagaagcagagtggaaagtcactatgacctcatctttcaaatgtcttcctgattatttatcttttaagttccattaattgtgcgtgtttcaatattacttttctgccctgtttatgacatattaatggaggtattttaataacttttaacttgaggtactgaggtgcatacttccaggtgaaatgtattcccagtttttcctacgagtaatatattctgttttcccatatgcttttagctcacacattcaaaccacaccaaatgagtacacccagcttaggatttacaaagagctgtcagtgcatcagtaaagtctgtattaacctggttcacagaaaccacaagaagatatcctgcagttgtgtttcttaagaaattagttaacaattttcttcaaataaatacacgtttaacaacatattttttttaggaaaatcaatggcctttaaaactggcaggctttaagaatcccaatgcccattctaagttctttaggaaataaatgttagttgctgactaaatgttgacagtataaaattcattcaaagcttgcttaatcagaaatcattttaaagcattttattgatagcattattcagtttctaatcaagctagatgatattgatgccctatccatttttccattcatgtcaacccaacttttaactgcctgagattgcagggaaccctctgctgttgcacatggtggtctgggaatgccagagaattaacattacttgggaatagtcatcaactttatatactccagcatatttttccccttggaagggataactctaattcatgaaatctatacttattcccagagaaataagctgcactcactcacagtggaaacttgtttgaagatgaatcatttattaattctctgccttgttttaattcccacatttctctaagtctttcctagagttactttccaaataaaccatttaagcttgaatccttgtctcagtgactattctggggaaaatcaatctaagcagataccaaccagtgttcttagtaagcagaccttcagaatgggattccagaactgaatcatttcctaaattacatacggcaacaaagaccctatttgtacctgggggcacagtcatcactggagtcaaaaaactcctcagatgctatggcaacacaattgctaagattttcatctgcagtgatcagaataaaatactgattaatggggatgcacctagcatttgagagacatggggacaacagtaatcataaaactatgagttggctggttgttgaatttcactgaagaaaatgatagccttatgtcagccaactatcaactaaggccaaagtaagaaagccagaaaacctgtgtggcaactaattaaaagattctcatttcccattttgggaaggtcagcatgtgctagaaatttggctcagaattttcttttgagaatctcagaattataaagtacgctgcattcacaaccttggcagctttctatgcaaaagtcagaacatcaataggcaaggagaagcaccctttgtactaggatgaggacatctaagtggacttcagaatataaaattctggattcccctataccctctggacaggcaaaagtaacctgtgacccttagttagagggcagtagcttctgcgttcctagagaccataaaagatgatgcatactttcctcatgatctgatcctatctcatctaatggctttagacaacaaaaaggccaagtaccatttgacccagccatcccattactgggtatatacccaaaggaatataaatcatgctgctataaagacacatgcacacgtatgtttactgcagcactactcacaatagcaaagacttggaaccaaccgaaatgtccaacaatgatagactggattaagaaaacgtggcacatatacaccatggaatactatgcagccataaaaaatgatgagttcatgtcctttgtagggacatggatgaagatggaaaccatcattctcagcaaactatcgcaaggacaaaaaaccaaacactgcatgttctcactcataggtgggaattgaacaatgagaacatttggacacaggaaggggaacatcacacaccaggtcctgttgtagggtggggggaggggggagggatagcattaggagatatacctaatgctaaatgacgagttaatgggtgcagcacaccaacatggcacatgtatacatatgtaacaaacctgcacattgtgcccatgtaccctagaagttaaagtataataaatatgtgtgtgtgtgtatatatatatatatataattttttaaaaaaaggaaagaatcccaaaaggttacatgacaataaacctactcaaaagttaaaaaaaaaaaaaaaaaaaaaaggccaagtatcaacacggcccaccttgaaaagtacagtctctactccaagaaaacaaaagaagatatttaacaaaagagttgcaggatctgcctaatatgaaccagaagatactgagataatatgccagggaatggatgtttagggttattgaggcaaaatataactggccatcaatatgttgtggaaaataagtaacctacaattagaaaactcatggactcctatacagttataaatggcatggctggttgtccaaagtcctaaaaggatcaagattagaagatgttcctcatacatagttttggagaagcaacatgaggatggacctatggaggtaggcatgaagcataaagatgtctttgttttgcatcaatgtgtgctagagaacattcgtcacagaaaaggcactaaacaattgggtagataagatgatctgtccactggagatcatccagctctgtatgtgtcaactgtactgcttgcaaaataggcccatgaatggaggagcttgatagtagagagagaggatacacatgggcctaaaagctcctccagtttgatgcaactactgccactggtaaataaccaacccacgggaatagtgtgatgctgagtcctcattatagtaccacttctcaaagaaagcaaccagcaactcgatgtaaaaaattattatattgcattttacccccttggagaaggggtcaaatttgtttttcctattatggatacaaattccagttatgggttcccctttcttgttcacagatgaggtgtcatcaagtatcactaatcctcaggttcacaaatactgactgatttatcgtgggatactgaataacatctcaaactaagcaacacatgttatagtacagggagtccaataataagcacatgaccacaggactcacagggtctaccatatgttgcatcactagaggctgccagcctgataacattgggacagtctcctctaaaggtacaactaaggctccagcttacagatgaaaatctgatttggggatgttgtcttcaaaatgcgatatgtattttgaaccatggtgctatgtgctgaagccagcttgtaactgctaataataattttttaaaaatggttgaaattttcacgaaacttaaaagccagttaacctcacattggtagcttaaaattggtcatagtgggaatatttgcatcatgaaaattggcaaatgctacacatcaattttctcctccacccccctggctttgcccctaaaaggcagaatgtatcaatatgaaaaccaagggggtaaagtaggaaagtcccctcttactataattaaaagtgacccacttgggaaaggtgtacttcttgtcattgagacttcaggctccactgaaataaatgttctgctttccaagtgtgtatgtgttgggggaaaggggcaggtaatgcagtgctcctatcagggtcccagaaagaatttaactaaacctaaatctatagctactatctgaatatgcttcaattctcatgccagtagacctacaagaaaaaaaaaaaataagtgatgctactggcagggttccagttgacaagaggaatatcatgggtgttgctgctacataatggtaagagggaacttgggattcgttcaagtatgtctgtggttggagataactgtgaatggacaactgcagaaaccaccatttgaatgggcacagaaaccatggattcataggccccaggaggagtaagagtctggttcctcctatcaggcaagccaccagcacaggagttggccaaggctgcagggaaattaggaaaggtattagaggaaagaaaagatgagtatgaattatgtccttggttctaaatctagaagtccaccatcctgatgttccatgtttctttgtttaaagattgtgaccagtctccatctttaagaatcattgactggatagactggatcctgggccaggcttctaactaccagcacctacaactttttgtttcagtactccctcttgtgcccagtctgtttttcccacacacagggaaggctgctacctaaaacctcagctcctttgcatttggggcaggttaactctgaagtgaatattacgtatggcttccagaattcctcagagaattaagttcctttaaattaaagtaagattctgtcattgtttccttccatccactgcctgacttctttaagtagtagtgtttcctgtgatcacctcccaaatacactatttatatttgaatctgcaagtgagattcagcttctcgaagaagtcagaataagacattcaccacattgaatatctgctagttttatataaatttcacctagatgtcaaatctgcactggatttaagactttctcttttgctatgccacagatagtatttttaaagaactatcccaatggtttgttatgaactatatgtttatatacaaataaagccaaataagtatctttcctgatgatcttatttgagagatcaagtattacattctacttgtttgcattctgttgaaatacgtagtgagctgacatacagggtcagatagattgtaaaatcagacttaaatgaatcagagatcttatgcagtatcaagttttaataaataatgttgagaatatgttgagaatatagacaagctaaaggacttctgaaggttcagatgaagtagatagaggcctcacacggaggagggcttcccagctcctccttcctgtgctgaacacattcttcttgcccacatgaagggaaatcacaaaaagagtttcacagggctccttgtaaattataaaatacttacagtttattccccagagaattatatcacctgtgagagtgttttgccaggaaccttgccttataggtatcgtgttttcctatacctactcttaggccgcgatacaccactaaaaacatttcagggataaattctcttcctcctagtaaatatcaataatctagctacctggagcttcaggtgagaagggactaaacaaagtctcctgccttcttctttctagtctcccttggtgagtaaatcaatttcagaccagctactttaacttcttcctcccaagtcatttcagagacagatccatttttcaatacaaaataacccttaccacaaattcctcgtcttcacatctctatgaatatatttacctcaagtgtaaatatatcttccagaaaatggccatgaaatattttgcctaaattctatgaattaaaatgacacatggtaacatttgtttgtcttatttcatttgcttcatagttcagtactttctagctatgagtaggagggtctatgatggttctgaggagactttaataagagcacattcaaatatctattggtttttatgttaacaagaaaaacatactataaaaacataatacattatagatatgtgtccaagatgaaatgaggatgataatgaatagaaaatgccatataatcatactgccaagttgctattttctaggagtttcaacggtgtccgtgagtaaaggggctcatattacttatttaagctcttctgagtgaaggaggatatgtggaatgctttttatttatagtcattacttcaattactttaaccagggataaattcttagaaactcaaaaaggctcctggcatagaattataagaagatccacgcggcactattcacaatagcaaagacttggaaccaacccagatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagatcacatggacacaggaaggggaacatcacacaccagggcctgttgtggggtggggggaggggggagggatagcattaggagatatacctaatgctaaatgacgagttaataggtgcagcacagcaacatggcacatgtataaatatgtaacaaacctgcacgttgtgcacatgtaccctaaaacttaaattatatatatgtattatatatatataatatatatatataatatatatatattatatatatattatatatataatatatatataatatatatatataatatgtataaaaaaccttaaaaaaagaattataagaagatcagtcgctaaaataggacaggtcagtaagatagtcttgcaatatatcaaaaatgtctcagcctctataagataaaagtataaagtacctaaagtcaggagaagatagaaattgcaaatttaattcaggaaaatgcagtcatcttatacttactgaagctacattcacgaaatcatcatctgagagggtttctaacatttcggagacagatgttcggatcagtttaagtgtcaatccactaacacttccactcctagaaatagacaaatgggtccatacatgttactcatcatgtatttaatcaagaacatcataaggaaagataatgtatgcactgaccctagatcttttatatattatttaaataataattttgcccttgaaaatcagtttaaaaagttacattttttgatagaagtggaaattataagaaatcctgcctttttttcctcccaatatcagtatgtgtacatttctaactgaaattatcaaaattacatgttaagtgacaattaaaaaaaaatatggatactgatggtatagtcactcattcggttctgttagccaagttagaagagaggagtagagagattaatagacatagtcattgctccagggaacccattgtttgacttgattaaaacaataattataaatccacataacaattatgataacagatttgcaagaaaatgccttgttctgcatcctaaagtaaatatcctctagaatttattcttcatttttctttcctctacatattctacaatacttggtgacttcacctatgtgcagggctggctcaactctaggcaactaacccccacttctacatctctagctcccaacactttcctggttttatccttcgagctgcctgctgaaccactacgactgaatgtccaaaatgacacattacttccaaacatatttttcattcctatttatgttcttggtaccaaagagtctatgtctcagccatccaatttgttcttccctctcaaccttcctgtgcattcaggcaaaatcccttattcattccacttaagtgttccaaggctatggtcccctctccatcctcactcctctctggctcagtcttcattatacgaagatgctgagctacagtaatagccagtcaacccagcaattagtctccttcacatgctaacaggtgaaagttctagaaacacatcctgacctaatatttttaacagctcatagataccgactaaatagccagaaatctcaatagccctgtattccaatcctttcattttggcattttctctctctcctccctgtaaccacccaacaggttcttcctgcccgctgcactaacaaagaccatggcattgcagtaaagaaagagtttaattgatgccgggccagtcatgccagacaggagatggtgttattactcaaatcaatctcatcaaaggctcggagggagattagggatttttcaaagacagtttgatgggcaggggactaggatatcagtgctgctaactggttgaagatgaaatcacaggggtgtggaaaatggccctcttgtgctgagcccacttttgggtggggagcacaggattggttgaggcacaggtccccgtgggaccatctgctagaaatgcaaaagcctgaaaagatatctcaaaagccccatctgaggttctagaatagtgatgttatttacaggaataataggggaagttgcaaatcttgtgacctccagaataatggctagtaattatttaactacatctacatcttagtagaattcaagtttctcttatcctataatttggtagcctttcattagttttataagggcagtttcgttttagggaagggctattatcatttaaactataaactaaatttctcccaaagttatcttggcccacacccaggaatgagcagccaatcagcctgtgaagctagaaacaagatagaggcaaccatgtcagatttgtctcactgtcaaaattttgcaaaggcattttcaatcctctacctcctccataaatgtccccagacttacctgtgcagcttcacttctggcaattcttccacctgaaattccactgtctttcctctcccctcccatgcttgcctttgaaaatatgagccatgaggattcaatcccaattttatctccttaatgctttcctgatacattaaatcaagttgctatctcttatgtattcctttagtgctatgtcatactttatatctattaatttctacaattatttttgttatttgttaaggtctagtttacctaatacatttgaattatctttgagatcaggtactatgtctttttttttttttaatatactttaagttttagggtacatgtgcacaacgtgcaggtttgttacatacgtatacatgtgccatgttggtgtgttgcacccagtaacttgtcatttacattaggtatatctccttttttttttttttttttttttttttttttgagacaagctcttgctctgttgcccaggctggagtgcagggtatgaacacaactcactgtagcccccatctcctggcctcaggcatcctcccacctcagcctccaaaatgtagctggaattacaggtgtgtgccaccatgcccagctggtttttcttttgtatttgttgtagaaatgagatattgctttgttgctcaggctggtctcaaactcctcggcttaagccatccacctgccttagcctcccaagtgatgggatcacaggtgtgagtaaccacgtctggtctcagtaactatgtcttaatcatctttgtttctatgttactacactgtgtgtaggaagacctcaatacatttctgttgaaagaatttttgaaaatagtatttaaatttcatatacactttcaagtttgggatataaatttggcttctatagattttgaaatgacattatttctggatattattatacatccaacaggattataatatattgcattaatatattgatttatacttaagaagaatatcaaggattagcatataagatccataatttaattaaagtaacatgaggcttaaatgcatcttaagaaataaaataagaattaacatttaaattacatttgttgaattcatttatcttctctttctcagactgggttatgagggtttggacaactaaattaaattggtttacttgagcttaaaatggggaaaattcaaatgttaatacttgcctgtgggatttagctgtccccaaattactagattttgtttcttccaatgagacaaagatttttttttttttttcctcagggaaaaacatgagcatttcttctcttgaggaaaaacatgagtaacctaagcattttacacttcatgtttattttaattccttgattattgctctttaaaaaagtaaatctccatagcaggatataatcttttcaatttctacatcttcaaccttattagaaaacatgtacacttgcaaacatacacatatatcttgaattgaagcactataacaaagagaccaacataaaaactcaaggaattattttttgtatatcaccatttcacttttaaaagtcccagatttttttttttttcttttctgagacattgtctcttcacccaggctggaatacagcggcaggaacatggttcactgtaaccttgatctcctgggctcaagcaatcctcccaccttagcctcccaagtagctggaactacaggtgtgaagctaccatgcccgaacaagttccaacattaacttatttaatatatttcatatttaacattatatgatatgtaatattaatatatgaatatccatatagattctcttcatgtttaattaaataatttgttttattattgtcttgatatggcttcattgcctgaatataaaagtcatcataatttttctttgtttcttttttaacctatcaaacctttcttagtcccaccatactactgttatctacaaatcctcccatattctcaatatataaataagtagtatttaacaactcacacatccaccagaataagcatgtctttaggagatgcagctccttggatgtacctgaaacaaatattgtaataaatgcttttctcttccaaaatatcaaacactgatatttgttgaattgatatttactgactctgagacaaggtttttttccccaagcaaagacccacttctatctaagtagacaatggttttccattcatattcttcaatgtcagtttgataaaagcaatatccaatataacaatagagatgtcagaagcataatatttaacattttttgatatttataacagaagatgaagaaacatattttaactttgagaagaacatttttcctggaaaaacaattatctaaactccaattgttgaccacaggtttaaaagtcactttaatgaaaaatagactatcatatttttaaatgtaaaaaataagcacaaaaaatagataagttgcttaggaacatcaaaaagcaatatcaacaaaaaagaaatataactggccaataaagagattaaaattaggcaatatgtgatgttattaccaagaacttcaatggctctcaaactttacagtgtttaagaatcacctggggaatcagttcagaatattaatttccaaattcaaccccgtggaatcagaatctctgcattttaaagagactctagaagagatttatgcagatggttcagtggttgtggagagagatcatcttgattgtgtatgactgacccaaaagctcactcacgttgcctggccaccgactggaatggggcctgacttctccgacaggaagggctgcacctgacatcaatttttttacttatttctgaagccatcactgtaaatgtaacttctcaggaggctgccagttaactttccaattagttttcagacaacatacagcacaattagttctatgtgttgaggaagcagttggagtttgtaacctgcacccttgcttgataagaaggtaaagtggcagagtggcaggtgaattttcatggacagcaaacctggctgatgcctagtatcttaatgctggtccaggtatgccactcagtgggaagataagagaagacaggacatgtctgcctctactgattggcacccagcttctaagtctcctccaaaacaaccaattcctgaattaaaacaagactatatattagtttttagctccactcaacagccccatggctccacaggaagaatatgtaaattagtaataattgtcactattaaacatggttggtgtagacataaattgctactgggatatttaaaaggacatctaaaagcctctaaatacaagtctttggaatcaaacattatgctcttgcaatttgtctgaagcctagaaaaaagttagaaataacctaaacgtccaataataagggatttcataaataagtttccatatagtcttcattcaaatgatggtatgtgtcttttctcatgaatatgtactcaaaagttattgatatgaaaagtgtgggatacaaagcacttatactgtatatgtgaactcatttcttaaaattcacacattaaatacatttttaaaaagcaaataaatacaattaatagttttaaaaaacccaaaaatagttgttttccagtaagtccaattacaaattattggtatttttccagttttatgttaggagaacaagttgcttcagtagtgaggaacaaataagtcttcattttggaaaaaaaattaaacctaagctatatgaatataactaggggcagcttttaccttggggccaattctcattagttcactgccagaggcaaattatctcctactctatctcatctctctgttggagctctactccaagcaaactggatccctgccatagaaatccataccagctaagaggtgtagtactgagattaaatataaaacttaaagtagtccatttgaaatgaatgtgataaatgggttcacctatattaattagcattacccacttgaactcatcattttcatttacctttacctatatttacttatttttaaaaatcagatcactttcaataagtagttaatactcatcctaataataaaaaattctgactttttagcaaatatatatcttcttgcctattttatcttttcatggctagctaaaaattcttaccatggtcttctgcgtacatcataaaggtcaatcttatttggagttctactattatcaacccatggtgaagctaaaaaaaaaaaaaaaagagagatattaaatcaaaatattagatatgctctaaaaataatgagactttaaaaatcacaaaaagcaatagatacataatttcacttacgtacttcaatgttcaaatgagagatatcatttttaagcccttatattgctttaacatggaaaacaacacggcagtacaaaaaggaaatcaatgatagtcgattctctttttacgagttatttcagaaataaatttacacatacagtttttccgggtgctaacttaatatgttttagtaggtgtccagaggttataatttttttcctaacagaaaatttatgtgccactaatgaaaattgtgctttcaattatttcctccttatattttcgttcaatgccatattctcttggtctatataagacagctgtttttcttgggtttttatgtaatagcataattttactcagtccatggtaaaataactaaaaggtcagctataattaaaacaactccatagaaagctgttttctttaaatttattgtaatgatgtgaagtaattcaagcgcagattcaacaatcttgtatgactttcacagcctttatctttttgcaataatcagaaataacttcatctaattgtattgatttttaaatgcaattaatttaaatctattctaattaaattgatacttactttaattaaaatgctttacaaagctttacatgcatgcacaccttagacctaatgaaaaaaataaatgctgatgaattggatgataatttcatgctgaagtagtccccgtacttggacatgtttaaacatatgactcctgggcaaatgcctagttcatatgacttacgttccccaatcaatttcgcttttctgagaaactgtggaaattatgaagaactttactgagagtcaggtttattagccaactaagataatttggccaattaggatatgtcaaaaactatatacaatgaaactcttccttgactgtgaaatttttttcttattagtagctatattaaaaaatgatttatttgttctaaatgactaatcatatttacaaagaatagtaagcttaaatatagcactcttccaaccattattgacacaatcaatgtaactgaaatggtgagtttactgcaatttgttcaatttgcacttgcagaaagtgagagtctgcgatgtaaaataatcctttttgtgtgtatgtgtgtggtagcactagaattaagtaacaagcatgctgatacacacatcagttcactttcattatccctctatgatatctgactctccaagatagggtcttagtaatacctaaaattttatagaaattgtatcctactttcagtaccatgctatgctgataatacatttcctgccactcaactccaaatgcatccttctaccttgccctatgaaaatggatctgggccctttcaatacttttcctttatcagatggcacaatttcaaggtttgcctgcaaatgatgcaagacagacactgaatgagaaaaaggatttttcttccttgttctggtttgtttgctcacaggctcttgcagcatgtgctgctgtctggtgtctgtctcctgcactgtctgtatattctccagagctcagctcctacagtgttgcagtttccccagattgcccacttccagcaacatggccagcttcaccaggctcaggctctaattttgtcacctgtacccctccagccccgccccctgccccagatatttttgtagaggagagcttacaaggaaagacctggaacctcagagggtaaatttccagcaaatcctatcagtgtggcataacagtgacttctccaccttggtgggccatgaccatggcctctacaagatgttaacctcagcccaggggaactgggggattaggacctctgccttgggcactctatctcaaccctagaggcagttgttattacacattatataatattatatcggatattcataaatcctttagagttctctgtacttctagccaatccctcattactccaatccctactgtagataattttttattgaaaaataaattttccttgttcaaaatgctgtattttttctctcttctgattgaacccagactgacacaaaggtagatgagagaagtgattagttaccactgccaatatgacagcagcaatcctgagttaaaagtggtctgcaacgaatctgataaacaacttaaagaaattggaatttgaaagttatgtttcaattagatttttgaattgtttaccgatcacattcatctaggatttctgttgtcactaccattgctaattgaaattaactgtgatatatattactatattccataaaatgtatatctttaaggaaagaaaaaagttaaaaggctataatttacagtatgagccagactattacattttaatattgtttataaccttaggtggtttatatttcaaaatattaataatcttctcttagaggctttctgagatatttactcttaggtagtatcccttgattaaaccaaattaagatattaatgttatggtaaaattgaacaacataatttcttctgtgatattactaattcccttgttgtaaaatcccatcatgtcatttaaatagttcattccttatataggctcagaattatgaaagatcaaagagtaaaaaggctaataaccatacaagttaattccctgaaataatcagtttcataaccatgcacagtgaaagctgcatgtttagaaagggaaagagaacttccaaaattcctgtaaaaagtgaaatgttgctcagtttagatgactttttagtgtttcaggaagatttggggatgggcagaaaagagaactgaaaatgacagttcacaatgtagacgtctcttttttgaatgtcatcattaaaggtgataacaatgatttacaggaatgttttcccctgatcaaaaatgaactgttagtgtgtcctttactaaatctactggtctaccatttacttcacctgatacataggatgtgttacgggtgttatcaaattgttgatttaagcaggtatttacttgtgcattaactcagaatactgatatacgtaataggaaaatattcttgagaaagtacgcagattttagtgccattttctggttaacatggtctaaaaataatagcgaagtaccccttttttttttatttcagctgctaggaaagaataaagcaaataatgatgcattgaggactgattctctcggtagaaacatcaaatgacagctaattgcatttcccaattaaaaagttcaaatgtattttttctaatcctaaaaacttcacagtcttagtctcatgataattttaaaaagtaaatttcatatactcaacaatgcctttaaaagtcactcctggtcctttgcctagatctaattggtggaccattattttcggtttgtctcaatcatctcctatagagtattagtcatggctctgaactgcaagccaagataatcaattgggactattttcaagcccaaattatttcactaaatgtgtactgcatagctcacaaaatttccataaatttcagtgttgctcaattactatcatcccagaatggatcctccacagtccctaatttgcaccatggctccaataaccaagttcagggtagatgactgtcattagaagaatgtggattatacccacacaaaggtgccaaaaaatctaggaaagcaaatagctggccttttcagattttgagttatctgctcccgaataaaacttttaacctgggaaatacttgacatacaggaacaagattctatgttacccatggtggcacaaatgccttaatgaaaaatctgaaatcttttgtatcttagtatagtaaagtacttctaactcaaataacaggctaagttgcgcagggtgtggagagtggtagtgcatggatagattctgctccaggcagttatgcagtcttaaagctgggagatcttttgcctccttcagcacttggattccaagggcatccaggacattgggcttgcagctgctagatggagggaggaagtgtggagaaagcagtctcaagtcctaaaagtctcaggctggaagtgacacatattactttcactcattctctattggtatgaacttgtcatatggtcctacagagacaaaaaggtgggagaaatgtagtccctggctagggagtcttatttaaaagaaaatttcccaatggaatgggaagacagaactttggtggacagctagcaaccttggtcacaggtacaaatggacaatttaaaaatgagtaatatccagtacctatttgaacatcaaattttctgtactcagcaatgtcttcaagtaatccaccacagagatgacggagatgaggataagctaaatttagaatctaacaaataaataaaacataccagtattaagaattatttctagactaaattttaggactgaagtggcttgcacaagaaatttactgatgaaaagaacaacaactagaagtcatctgggcattgttgttgatgttgtgttactaacgaaaccacaaacctgatctgcggcaatgctgtagttgaaccctaaagcaacttttgggctctaaacctgcaccagtaacagcaagcaataaaagctgtttagcctcaagcacacccctgcagatgtgccagaaagtgttttagacaagatagttaatcctagagaatactaccagaaacagtgagatgagctaaccaagaaacgtagctttatgcaaaagaaggatatctttgtatttcttgcctgatagaatgagatagggtgaatgggtcagtgattgttctgtatttctcactctcattttgcagatgggagtttttatcgtagttacccagcagacatgaccaatgaatattatatatttgggcagcaatgggaatagggtagagaaaataactggcataattctgtattataggtagtcaaatgaggaaacatcctacctgatggagagaactgcgtgtgacccagagatcctggattttattcatttgttgagactttgaatcatctatggggaggagctgaatatgttctacacgtggaaaaaaatggtatgcacagatacttgaaatgccagaagaatggcctgtaacagggcttcaatatgcatttcctcctccttccttctagtaagagtcctcaagactgccctgccagaaactatacttttcagtttctcctgtcatgatgtagccatgtgatcaaattctagtagataggatgtgagcaaaagtgatatatgcatgactcttcaatcactcttgttgccttctactaattttcctgtcttcttttggcctcaaaagttttacggtggtattgagcccattttaatcagacagatgaggacaacaacctaaggaatggcagatagctgaaacctcagttgctggacaacatcatggaccagggttaccctaagcactgatttacctattcggtaggaatttttcctccgagtattttttaaatgtttcctttgttatatattattaagtaattgaatcagtaccttgatacaggtcaggacttttctcaatcatgccaacatgggtcaagcattaaagctttgagaatgcaaaggaggcaaaaccttcatgtggtgtcttgaataactgatggagtacaattggaatgttcataatacaaagagatgatgaacacttgaggtgatgaataccccactcacccttatgtgattattagacattatatgcttgtatcaaaattatatacctgctatgtgcccataaaaattaaaaataaaagtaaaaaactttttaaaagtctgcttcactgtattgctctcattcccatgtatttttaggagagtattattttgtccccaggaaactgcttattgctatataagacttctagtgagtcccaaatacatggtcccaagtaatcagttacttttgaaaaataacaatcattcccagatgaaattttcaaatgctgaatgtctaaagctttatggcttagaaccatcaaggagattcacaagcagaagacaagacaggaaagcaagcattccaggtgagtaaatattaatatgaagagtccattctgttgtcattttgaaattgtcttccctggttggacctagcctagtgtagaaattaaaatcatgaatttgggaaccagcctacctggatttttcactgggtgcatgaatttggataaattaacttttttttcagtaaaatgggactaataatgccacttactaggattacagctaagacttaatgaattttacacataaacacttagaaccatagttggcacaaaataagcactccatttacagatacctgaaacagtaccactgagtcactggaactatagattatagatatttaaaaatagatttttataagatatgcttagatgttaaccacttaacatgttcctgtgactggggcttgaacatgatactattttcccatcccattccacctccctgatgcaggctggtgttacacagtcaataaaactttctaggaatctaaaaactgacttcatgatattatcctcagaaacctcatggagaatactgacatagatgagaggacaggatgggcaagatgtgcagacagggacctagaaaacagtaactctatgttccttaacattctccaactgcttgttctccttgtttcatttttatttagaaactgatcctctaaaattctactctaaaactctctttcagttctagtacttatgatcttgacttgtttatccagcttaaaaaaatacctattatacactatatgcacagaactgtgttaggtgatacgaggcatacaaatatgtaattaactatttctcactgcatagattgaaatggtttttaaaatggcatatgcaaaataaattctggaagaaggtaaaattcactatctattgtaatatacataaaaacaaaattatctgtgagaacaaaataaagaaagattgctttgggggcaagtcttcatatgttggtattttatttattttattttaatttttttgagatggagtttcactgttgttgcccaggcgtgagtgcaatggtgcaaccttggctcatttgaacctctgcctcctgggttcaagtgattctcctgcctcagcctaccgagtagctgggattacaggtgcccacaaccacacccggctaatttttgtatttttattagatacggggtttcatcatgttgaccaggctggtctcgaactcctgacctcaggtgatccgcctgcctcggcctcccaaaatgctttgattacaggcgtcagccctcactctcggcctgcattttattttgaatgaatgataagatgcacacaaccagagatgggctctaggaactaggcacatagagacacgaacacaaaaaggcagatttgtagaattgaaaataaaacaaaaaaattaaaagtggagaaaatataatacaggggtaaacaatgaagtttgaactgtacattaagagataaaactggaaacgtagattgagttagaatctttggatggtctgaatgtcatggtaagagagccagatgccattaactagacaatgccagcttgtataattcaccagacagctgataatctaactctaccccacatcacttttattacttttttattttttgagatggagtctcagtctgttgcctaggcttgagtgcagtggtacgatctaggctcactgcaaccttttcttcccaggttgaaagcaattctcctgcctcagcctcctgaggagctgggattacaggtgcccgccattacgcctggctaatttttgtatttttagtagagatgaggttgcactatgttggccaggctggtcttgaacttctgacctcagatgatcctccctccttggcctcctaaactgctgggattacaggcatgagccactgtgcctggccctccacatcattttgaaataattttactagcactttgtttgcattatattttaatgtgtttacaagttttccttttcatccacctgtgaactcctctagagaaaaatcttctcttactggtattagaatcctcaggatatctcagtttcttcagaaacagaagttctgccttgttcttatcagtctttcctccttcgtccagacttaattacactgatctaatcaaataattttgaattttaattttgtttctgggcagtgagtctcggtatttaggatattcagatcatatcactatattggttggagagtgactttgatatttccactgtaatatttccagaatttttttttaattaagttctggggtacttgtgcacaatgtgcaggtttgttacataggtacacatgtgccacgttggtctgctacacccatcaacccgtcatctacattaggtatttttcctcatgctatccctcccctagtcctccatcccctgacagaccccagtgtgtgatgttcccctccctgtgtccatgtgtcctcattgttcaactcccacttatgagtgagaacatgtggtgtttggttttctctatttccagaagttttctcaaacttcttataaacaataggcagaaacccatacacagatacatggtattacagctgaggataaatcaccataattaaaaaaaaaaaaacccttattacaaagtggattactggtaatactgaagatgccagataacacacttaaagcatttttatttaaaggggtatctgtctgtcagcaggagtagcagtcaacagggaaaagtcgggtagttaaatgaaatactcaataaagtaaatggtacacaaacatttaatcctttagatgtcccataatgcagtcattaagtgacttggaaataagcgtgagcacagtaagttctatgaggcaagtgttggggaggatttactgggaaatgatgttagatatgtgctacacagacaaaaacgtgaagtctgacagagaaacatgtttcttatttttgtaagcaaataaattcaattagatgacaataatgacattgctaaaaacataaaacaaactatgattctacaggaacaagtttcctagttctgtaagtgaaaatcttagatgatggtgatagtgatagatttctttaaaagtttatatttagcatatctgagaaagtgcttgaaacatctgagtttttgacaaaaaaatctttttaatttttcataatcaagtatactgaacataaatgaattacacagcaaagatgttctatgcatctaaaaatgaatggcataagtacagaaatttggtaacacagaaagaaaaaagaaacagattgagagatatatcttagaagttgaaaacagctaaatttttttagcaatacttatttacatattttgcatataatgttatccccattcaaattacaaatggctctcattttcatattaccaacctgtttacctactctaacctgtgagcaataaaatcaatcatttagtcagtttaggtatgactgcatccttggttgaccataaggtgaacaattattacgaccattatctgtgaaaaataagacagattcaggtaagagataaggttatacaaaatgcaacaaaaatgctacagaattgccttcataatcatgatgaaatcagaattttaaaacagtatgtcatccttttgtgtatgtgtaaaatgcatccccacacaacacaattgatggatagtatacagcaaagaaaaccacgtaatatgaaaccagtgcttgagcgtaaacagagctatttgtaccctcttgtcaacacctcaaactttactgttctaagttaaactcatcacttttctcccaaaataagaacttttgatttttaattttggtaaacagctttgatattctcatccattcaacttaaaaaatgatactcaactgacactctacatcagtcattaaattcatgtttttaaaaaataaagtctgatatcatcatttctatttaagaattaattcctatttgatccctttttcagatctttaaaattccacatctgaccattaaaatagcatatcttctggtcaagcttccccaagtctttctccttctaatcataatattaagtgctttaatcattgcattacagtgcccaaaatgtttgtggtactttgcctacacattaaatcccaaaccattctgacattcaaggcgacatattctaccattaataaaccttttgattcaatattactttttctataacaaactattggattaactgacctcactagtctccagcagtggttattcatctccttatatttttattttatgccattcttccctccagaaacattttgccttctcttcttcattgacttggttttcaatccaaagttcataaacctcttatatgactctaatccataattacctcttctttttcaaaatttctatagcaaatctattgctattctatttaagtgacttggcatttagtcatttaataatttgtattgcaatctaaatttaagatgtatttaatttagatgtataagttgactacctaattaaatttaaattttctaaaaggcagaaacaacttgttattttaaaacacaaatgtccatatagtaaccatagcagagatgctttttgttccccaatatctgttttccttttcttacttagtacagccccctgccatttagctggatatatggccattttgaaggtaactatgaccaagagaccactaaattctggccagaaacaaatgaaagaaaatgctttatgtgatttccgggaagttcccttaaaaagggggcaaagaagaataccattctttgctcctaataaagagcacaagtaacaacaatagactctaaggcagagcccatgctcagagaatgacagagtagtgagatctgggtgcagaccccttatttgtgtagtttccctacctgccccagtctacgttaactctgattgacatgagtaaaaaccaaacttccatagtgttaaaaatcactattattttggatttgcttcaactggtagctagtaagagtcctaactaatacactggactttaataattattagcataaaatgtaataaacacttcaatttaaagtttatataatgatcaacaactatatacatttatagttgaactatgtgtccataaacaaatgttaaagtaaaaaaaaaaaaaaaatcaggcatttttagagaaaaccaaaagcagtacttctataaatactataaatgttgaggctccactggtatcccattttcttctagttggctaaaaatagatcgaacgcttcatttatgactaaactttaaaaagtattctttggactaccttatcatctgctatttgatgcttaaaatattcctaaattattgttcaaaaagtggtacacaatttaagagctattggctacctgtatggaaaaaaaaagtcattccatatactttgtaagagattcttttgcattttattccagcaaaatcctagcagaaatagcaacaagaagatgtctctcagaggtctactttacattaacttaatacacattaggttcctttattgtaatctcatagttttgaaattaacaaacgaggcagggcagagaaagaacaaataataagacattaagtaaacgtcatacggagatgaagtagatttttagttttctcccttttttaataaatacaactaattgtctaaaaaaaagagtaagtgctggctacattggcatttcaatgaaccactgattcctaataacaatcccaattactgcaacaattggtacaatttcaggagatattaacaggtgaaatgaccagtttgtacctatggtttttatgatgcataagaattcacaaagttgatagctattgaaagcagtttttaatagctttaatttatataaataagttaagagcttctaaaggaaagaacttgcaagataaactgattttccaatgagcacatattcaaggaagacatcattaaatatgagttcctaatcatatctatgtcatgagctagctgtatgactagggctagtcattctacttatcttgcaaaacaaagactgtggatgtagcaaatgctacagcaggctataagcagataaaactagtgcttgctttagaaatcattttgttcaatcatcccaagttactgatgaagaaacaggtacagaaatataatatgacttaaaagtacaaagtgacggtgatgacagcttttataagaacctagaactcctcatagtctacctgccttccaagaaggagaggagaaagaggaagaagaaagagggtggagaaagaggaaaaaaagaaaaaagaagaagtgagaagaaaaaggacagacaccaatgattttcttagcttatttccatatacatcaatgaaattataaagcaggttcatgttcagtccaaggacagacattaagagtttaaatctccattaattacggaactactgttttgagtcagcactgcataggtacctttatattacgctagctctagagatctcactggaagtcagtgtttctatgtattttaaataatctgataaatgaaaatcatgagagtactctaactttcccctacatctgggcaatatgctccaaacagatttaatgcttcttattctcttaacaattataccatctaagcattgttatcctccttgtttcacagctgaggtcaatgaggactttccaaaggtcatcatcatacaaagtatactggtggaggtggggtttatattctggctatctgattcaagaatataattactgtggaatctaaaaaagtctatcttagctgggtgtggtagctcacacctgtaatcccagcactttgggaggctgaggcaggtggatcacctgaggtcaggacttcgagaccagccttgccaacatggagaaaacccgtctctactaataatacaaaaattagccaggcatggtggcatgcatctgtaatccctgctacttgggaggctgaggcaggagaatcgctcgaacccagggggcagaggttgcagtgagccgagattacgccactgcactccagcctaggtaacaaagtgagactctgtctcaaaaaaaaaaaaaaaaaagttgacgtcatagaacacagagtctataatggcggttaccaaagactgggttggttacaagggaggaagagatggggagatgttggtcaaaggacgcataattacagttagagaggaggaataaattcaagaaatctatcatataaacggtgactttagttaatgatgatatatagaccataataataactatgttaggtgaggctttgttaattagctagatttaaccattctacaatatgtgtgtgtatgtcaaaacttatacatattatctttcaatttttaatttttttatttttaattattatgggtacataatactgatggggttaaaaatatatatgtgtgtatatatatacgtatatatatgcgtacatatgtatagatgtgtgtatatatatacatatatgtacacctatatatatatacacacctatatacctatatatgtatataggtgtgtatatatataaaaataaattgctcacctgcctctttgtatgtgactctgctttaagtagcatattaataatcaacaaggatattttttagcttctattgtgaatcagaaggttctagttcctgcaaaatattttattttcaatagctctgtggcaagtattcacttacaaaaataaaaataggtagcttacagaagttaaaaatgaaaattataaaattctatatatctggacgaataggctttgcttgatctttacaatactgtgaagtaatggggaagctgactttcccatattacaaatatagaaactgaaagcctgaaagacaaggttgatgaatttagcaaaaagaaatacaagacaatcagttaactttgaatttcaataaaaaataaataccttcttagcaaaagtgtatcacaaatattgcatgaagcatacttacactaacaagttattcattgcttatttgaaattgacatttaattggacatcttttatcgtatctggcagccctacagaaaagtgacctaaggccatcagctacaatccgtctcctgaccagtttcactacgtggtgttattgcctgactttatggctcagtcatgtttagattccttccagagttctatttcagtttccttgtcaactcactgtaagcttcaattatgttctttaatgtctgagataaagagaaagctgcatttaggcaaaattattctagttgacatgcactattgtagaaatgcctactgtttcctattttcaaagtacttttcatcatattatctcattgatcacaataacccccaggggataaaatgaggagttattaatgttccactttttcaaatttaatgattaggtctcagagagtttaggagacctacctaggttctcacagctagcagggagagcctagcctgagggtcaagtcttccatgtaaaagttcaattaagtagaagtaacatatgtgctgttgccatttattgttaagataattaaaatactaaaagactatttttgacctctggtttaacatacagtaaacaggggtgagtccttctatattattttgcttctatcaaaatgatatgatcagagaagtatatatagtctccccaaaaattttttaatcatgtcatttcaacaaagctgtgtttttgtgttaaaaacacagtcttacaaaaacagaaacacaatcgcccacttttaaagttatgacattgtctcaatgtctttactaaatacttggttatattatatcattactgtcataaagagcaactcagtaacagattcactaaactaaaatccattcaagtgtattccctagcagtcaagtgggctattttaatgaccttcctgtaacaggtaaatgaattcagcctgttatttggtgagtcattttgcttgccaaactcttacttaaaacctaggtattgtgagtgggcacatggttgcttccacagctaatgttttggaaagactagtgcaggacttttcttggtcactttgccagccagagacctctggccagtgacacccctgcccaggccttgcttgggtccgggttcaccgcaggagacaccccatctactgtgcctgctggtcagcacccggcctgcactccagcgtggttcccacagccactgtgactgtgcacccagcctctggtgggagggggtgtgtgagcaagtgagtgcaggctccggtccgccattccaagtgctggcacagaagcgggctctatgtggggcttgtggttagaccaggcatgtcataagtgactctcatggtggactctggcacctcaaatgcggaaacgtggtggcacccaggcaggggtgcccctgaccctgaagcatgtgttacagcatgctaattagttctttaagtcccgccatctgcagcctaatggatggtggcaggttaacaactctgtcagtcccttgctccactctggcccacggctctggggctggctcagccctgccactgcttcctgatgtatggggcagctgtcctccaccagcggagggcagaggaccatagtgttacaactttctttgtacccacatttcatgggttcttgtcacacttccaagaagaatgaggttacgcagacaactgaagggtggggagagcagagaagaatcttattgagcaatgagaaagctcttagagcagaaggaatgtatgggtcatccctctacctgatgtcaggtggtctcttactcagtgtggttgagtctggggcttttatggactcagaacggggagttcatgttgattggtttgtaagtatgcaaaaaggctaaaacaaaggcacttctcaaaggtgggcatgacagtgtaaaaaaccaattaggaaagggtacgtatatgtaaaatagatgaagggtggggatcaatcagaggaaagcacatcaaacaagaagggaggttctcaatctggtctgaggatttacccaggacttatagctaggctttaaaccgtcttctgcttgaaagtaatgtttcactggaaacccgtcccatcttcatagatttttgtctgtctcctgcctctatcaagaccacatgaattctgctaaatatctaaatatgttttccaaaatgaagtgaacaaatgtcaacacatttgaaaatatatgattagcatcaaaaaattaaagccatcatccctcaattagcatttgaagttaaagaattacagaatatgttttattagtaatttttaaagttaactgctatttgttaaaagagccatttttgaaaagggttcataatacaacttatctttccatccatctcttgatccccatgttttctctcccattttgcatgcattctttccttcctctcctcttcttgtttttctcttgtaacccttttctctcttcctctatatcatcattttctctccgatactgggctcttgactgctcattatcatcctaattttcttttaattatcatttccctctttcccttacttatatatggaatattgttatgataaaggatatatgaaaagacttgaaagctacataatgctgtaagttactgacaaatatattcttatatttgtatattataggataggacatcagatatctatttcctatattttaaattatatcaggtcttctaatttataattgttttataagacctgatacaattttaaggtttattacatcaggtttattatgcgcatgagcagtgttgtctttttcctttatgttgtcttatataagtattatataatataatactcaaattttaagtcttctgataatagtatttaacatgttaataaactaacaagattatgtttagaaaggttctactaaagtgaacaatattccataaagggaaaattccactattataatgataaactatgtaatatattcccatcagataataatacaaatatttaattataactcattttttcaatatttaaatcaaacttggcttttcctagtgtgttggacttatgcggaaaaaaattattactgattttaccatctggcatctgcaaccctgcagaagttatatggtttttacctaatttgagtaccattcagtccattgatacccagatactttcattcattgctataatattacaatccaaacttatatattttctaatttttatttcacccttatttactgctgtgactttttatatgaataactcaatttgttaaacatgtttaggacacccaagtctcaagaagaattatgctgtttaaggtcatactgtagcaatttaaagccaaattacctagcacgtatcccataactcagatcatgtttgagaaagaaaacgcattttatgtttttcagcttgctctaaaaagtggagaaagtaaaaaacaccagtagacatttcacttaaagtgttttcaataggttttcaggatgtcctaggaattaatttttcattttgttatagaaattactatttctccttactctttttataatacatatttataaaaagatgttttcactttaacataaaatatattcatcttcattgagtatgtatgatcactgagatgcactcagaagtgatataacctgacacataagaaaaactctattttctttgtgatttcattttatttcttgtcctactcattttaacagatccacgtctactgattaaacacattaaacttttgttacaaatttcaatcaatttataaaaattcaattcaattctctaatgtgactcacagcttggtgcatgctgagcagttgggcctttatctcagagctgttttaagattgatggtaatttcctgttccaggtatatacctaaggatacctgctcatggtctcacagcagcatggcctgattccaggtaccaatagctccacaactgctccttaggtatttcagtttaaagtgactgtggtcaatccaaagccatgtaaagaggaatgttctttccttataaaagtagtgtgatatagtcatatttttcttacagtatcagggaagataacagagtattctccagaaacattgaggctggaacttgacaatgattgaatcactaagcacctacctggataatatcgagctaggccagtggcactgccaaaaacctgccacaataatgaagggtcttcctcgcgattctttttgaaaacttcatctaaggcacttgtccagttgagttcatttaacacaattgttgctaacaaaaaagagagaaaccattaattaattcaaatttgtaattaaaaactgaatgtcttcatttatttacaaaataatattaaatatgttcattgttctacctataaaataactctaatccagtagttatcaacaagttttcgacactttagaggacagtttgactggatctactaccaacatgtacatagtattcatcgaaagatgtttttcaagaggtttatactctggagagaatttctgaaaacaaaactttgtatgacagtgtccctactgacattttggcctcggttattctttgttgtgaggtctaatcctgtgaaaatgtttagcagcatctctggcctctatccactagatactagtacctccccacccccaagttgtgacatgcgaaaatgtctccagactgtcagatggcccctgcgggcaaaatcactcctgcttgagaactactgtgacacatagaatatgaggagaaatgagtggtattcctttttatcctcagaggtagttctgaggaaacctatggggcaccttaggacagagttttaagaccacagtaatcaactattgatgactctctgcggcagagcaacataaattagcctgctaccttaaaaaaaaaaaaaagaaaaaaagtcattgggcatagctaattaactatgtttatacaacaaaaatgtacatattttagtaatgggaaaatttactcagaggcttgacaatatccgtgttagaaacaaactagttgacactttatcactaccttcataaacaatagtttttttttttctcctggttatttctattaataattagagcatggtgccgataagggccaggtgattgattttgatacgtatttataactagaaactaatcttggataggtattacaaacatataccactcattacaatgaaagagaagcaattataatgtaggatataatatgggttaagtgtaagatataatatgggttaaaatagtgcataatttataactgacccttcatgatcataacttctcaagtctagcatactaaaaatttaattggcctaatataattttccctttacacaaaaaaaggcataattttctatgtaaaatatacaccatgtccccagagattagcagacagggccactttgcatttgacaatctctgaccaagcctgaacagtggaaatgtgcttaggataaagactggagatacagcttaacgtctttctatttttttctgtgatgacagcaaataaaagaaatgaatgccatcatggttaaatcatgcacaagcctttttaaaggtaaaattaaaaacagcgcctgtgaaacaagatgcacggcctatgtgtttatattttaaagttgtatcatttaccaaaaaagaaatcaacaaaaacaaggtgattgtgaaactcttctgggaccagcatgctaaagcagtcctcattattgaaaactaacaagattttcatctttatggatgcgattactttcaaaaagatcagttgtgtgtgtgtgaatattcatgagctgcatcagatccatcgtgcatctgagatactagagaattcatattcaaaagcatgatccaatgaacactaagcagccagttatatgagaatttatattcacacagataacctgaactgatacccactattcatgaatatttatatcaatatacaaaatagcatagaaagaggaacattgtgttttctcttaaacatttatgacttttatagtaacattctactaaacaaatgtttatttatgatccagatagacttcattaatccccaatctattctatctctttaatttccttgattctttcattcatattaggcaataacatctagttatttttaataaagttttatttgtttttaaggctgctaactttttcttagttttgtttgataactcaacagctactaagtattgggtactgacacactgattgtgaattatacttttataaactgagggaaaaagtcaagctctacaatattcctattatcctggcaatatgttttaagatttccagttgatgctttgaaaattttctttttcagacaagccattactaaggtagatttcaaaatatttctctcaaaatgtgttcatctacaaatgagcaaatcatataaagaattcccagactaggcactagaactgattttaaatttgactcagaatgaaagtattggcattgcacacctatcacatcagtacggtttataaatttgatatacccaatgtgtagtaagatgtaagaatacagacacttccatgtgttagtatatagttgcagggacttttaaatgcaaccattatcctattagtcacagtctttttatggatgtctagaaatcaaaattcaaagacgatctgccataggaatgcaaaattactacagcctttgtagagagcagtttgactggatctacctaacaacatgcacatcgtgttcactgaacaatgttcttcaagagatttatactacggagagaatatgtgtctccagttcttcctcagagtattatagagcaagaatcattcattcaattccttaaaataccaaaactagaaagtaggataaaactgcttcactaggaaagttttttctcaaataatattgaaagcagctaaaaaaaaaaaaaaaatggaaaagaaaatatataaagcatcaaagccaacaaggaagaatgaatactattttagaccttgggttatctgcctatatttttctgatccacattatgcattatatttgactaataaacctatattactctggtaccttgaaaagaccagactttttttcttcttaaccttataaaattaaatagctcatccaagattactaaagtgcccaacatttctccatttttatgctattagcacactcaggataaataatgctgaaataaaagggtaatctgtagatgatagataatataacactaaatgcacaataccggccatgctaaaacaagtttatgtcatttcctggatacgaattgtgctctgccatttccattgtatttatacacacattatctctctctctcttcccttgtctctatctctccccaggatgccccttagcccctatctctgtttctgtctgtctctctaaatatgtgggtagagtttatttaggaagttttttttgttttgttttgtttttttgtttttaactattctggttacaaccgggtaagtcaagtgctttttaaagttaaaagttgtttttcaggagatcttttgttttatattataaagagtttatgtggttatgctggtgcctttctctattcttagacagtatttttagtctctcctgttttcctgacactgtagttcttaaaaaataaaaggtacaaaacgtcattttttcataacaggaaaaataaaacaaggccaaattccttggaaaattattttcagcaaatattactctagattatgaaactgtatttttcattcatataaaacctaatctcaaaaaataattgtggaactctgatttactgaagttcaataaatatcaacaaaattcaacaaaaagtttcatttgtcattgtatatcacaaagactttaaaatgcaattattattttatgtcataatctttatttgaatgtcaaagattttatttaattgtggaaatatcaatgtaaattagtagccaaataatgtttaatataaaaattccagaataaattttctttacgaaaaaacttaaaatatttttgaccgtaaaaatcctttgatttggcaagatatatttaataatatgtataacaggtgaatggtattctataaattggtattatttaaaattatattgtattttatattctcaattatatattctatgatctttttggcacagggactggttttgttaaagacaatttttccacaaatggaggtgggacatggtttcaggatgactctgttccacctcagatcatcaggcattactagatatctcataaggagcatggaacctagatcacgcacatgtgccgttcacaacagggttcatgctcctatgagaatctaatgctgctgctcacctgacagaaggcagagctcaggaagtaatgctctcctgctgcgtggcccggttcctaacaggtcagggacccagaccggtccatggcccaggggctggggacctttgttctatatgatattatttattatatattgacagttgccctctttttcctccctacccctgacaaatagtaatgttttacattcacatatacttccagtttcttgcttcagatgagattagaagtacatgagtgttcaatattttttcactatagaagactgctcagtgacaatctagccttgaacctactaccagttgctgacaaatttagctaattgtcttagattaggagtaaaattagttctcattttctgtcaacttttaagaaatgaagatctttatccctgttagaaaattcgattttgtaaaaattaagtcttttatagatgtccaaggccaagcctactaaaagcagtgaatgcttggaaatcaaaccttgactttgaggcctttattctgaacggcataataggatttcactgataatcgattcagaaagccaagcatacatctctattctttgtttacttagttttaaaaaactggccttggtgtcagcaattctcccttttagagtattctattgttcagtctggattctcaagagaagaaagaaaaatctaatttgtaacagcacaaaagaaaccccttatatttgctgctaattcttctaaaagacacgactcttctatctatatcttgtttatgacaaggaatacagaatatttgacgagctctgaatccagtgttcttctgcaaacttcaaccaataaaatgttgcactattgctccctcttaagtttgaattaagtttgtattaagtttgaatacattttcttgatttattcagggtccaaggcctcaccatacattgatggcaccatatgactatttgaagaatcttactgttatttataatgtcaactacagcttttgtaacagctttgagatgtcattgacatataaaatagtataaagtatgaaatgtgatgttttgatacacctgtatgttgtaaagtaatcatcaaaatcaagttaattaacttatccatcacctttacataactaccattagggtggaagttgggggaattaatttaagatctatccctcctagaaaattacaatacaatattgttaactatcctcgccatgctgtatattagatctccagaagttactcatcttttaaaactgaatctttgtacccttacctatagctttctaataaagcagatttatgcaagaaaaaaagagaaaaacatttgttaggacttactgaaaatataaaataactctaataagtctttaagagatgtagctattaaagatatgtaagggactagatactaaaaattatttttgtttaacaataccaaatatcatacagttaaataagagaacaagcaaaaatgtttaccatttcatgtaatttataatactattctattacagccttgcattgagataaaaattagcatgttatttaaactattgttactaatagtttagtactattttatatttaagtactattttatatttaagacagtatatttaatactgtctttgtgacagtaaattttgtctatatttcattctacattttggcactctttgggttgggcaaattttcattttagttttggaaacttactattccttaaacaagcaagcaagggtttcaaatctagtttttaatgcccttaaatgttacctcctccacacctttaatttttggacaatcatagaatattagaaactttgtttagttttagattcaacacttattgtaagtatgattctaaacaaaagatatcttttgtggcaaacgttcatttcacaacatataaataaggtagtcatttatatgttgactaccttaagaaaagtcatttatatgttgactaccttaagaaaagagctgcattatcagataagctgagccagatgtcactaattttattcaccaaccctaatctctgaaaagaaagatgttaataagaagaaacctactgatctaattaagtgcacagggaaaaaaagaatccactttaaggagtagacagtgtgcataaatattaaaatgaatgaatcttttcagtggatttggctaatggaatctcatctaatcccagtgtaaatgaaagatgaataaggtacagggagatgggaagaccaaatctaatctctctaatcatgtctcgggcaccagaatccacctcgcactgaggatgggagagcagaaggctccaaggcacacaaggaccttgatgaggagataagccttattcctacagttaatttggtacaaatatgaaaaggcccttgtccttgtcagttgtctagcccctgtattactgagatttctggccttgccccctatcactttagtttcctgcggattgagcacctggccaatgcccagaacacagctgttctgctttaatgaaatctgcacgctgtggagcacagaggaggagctcagaagaaatccactttattattaaagaaaacaagggtaatgcaaggggaatagaagacactagtatctaatatcatgtctactaattgaatgatttaatgtcacttgaaataaaatgataattgtaagatttgaggagggagaagggctgtattttgtataagaaacctcagaaatataggagccccaaggtcaaattattgttttatcctttaagcattctaagcttttctctccttagtagtatcaaaaccaaataaattattaatgactttgatagcctagaatcacaatcactggcacaacatactacttaaaacaaatcatttaacttcttgtgcttctgttctattcgtctaaaaaaatgaatatagctatactaaggatcctagacagcctatagggttggtgtgaaggtcaaataaatttatgaatgagaactgaattagcaagcatatttttattccagttctttcctcagctagattaaaatactgtacggtgcacatctccctaagtgtcttacatagacaacaacttttgacctgtcagcatactgttttagtccagtcagtaatttcctcttccttgaacaaaaacacatttcttttacatagagcaattagaatgtaaatctgtttatgttgtgtaaagcaatattccttctgcttaatctcctaatttatttaaacactcacatcataagatattcttcattagaatcagctagttgaaaattttcatttcaaatttaggaacattatgtaatttgtaaaataaagtagaaactttagcataattatctgaagaaaatacaatatcttctattgatagtacttcacagtcattttttttttcttgagacagagtctcattctgtcgcccaggctggagtgcggtggcacaatctaggctcactgccaagctccgcctcccgggttcatgccattctcctgcctcagcctcccgagtaattgggactacgggcacccaccaccacgcccagctaactttttttttttttttttttttttttgtatttttagtagagacagggttttcaccatgttagctgggatggtctccatctcctcacctcatgatccacccacctcggcctcccaaagtgctgggattacaggtgtgagccaccatgcccggccacttcacagccatttttatgagaaattttagtatttgtaattaaatgagtaaataaattgttaaatttctattctatattttagagtaatatttcagtaaatacatagcctgctaaactctcggtaaatgaaaacaacaagaaataccctaaagatctttcatttagaccttaaaaagagaaataaaatgtgtgcgtttaaaaaaacatcagaaactctgagagcagagaaatgaagccggaagccatagaagaatgaatatgcaattaagaccaaatttaaaggactccaaattaaagtgtgtggtttttttttgttttgttttcatgcatactatagattttctttctggtgaggcctttttctaagtggtatttttaaaatgagcatgtgaatgtatgtaatgtgtgcaaaaactattctcacccattatccaccctctcacagactgcacgtctttctgtcagaagtaaccacttgatcttgggaaagtgttttaccctctctaaacctcagtttcctcactcgtacagtggggataataatagcatctgcatcacagggctagttttgaagattatacatacttagaatactacttgtcatttagtaactgcacaataagtgttacctgctctcatcattaatcatcattattttctctgtctcctaatactcagcatttaaaatatatttttaatttatcttgataaattctgatctgactcctaaaatccaagtatgagtgactaaaacctagtattttctttttcctcaaggaacttttgcccttcttaccccaaccccagtaatgtccaacaacactacttaattttcttgctatgaatctcatgaagaaaggttaatagtctattaacctttccatttcaattgctataagacaatggcaaactgaaaaaagatttttaatatcttatgtaacttggtgagaaaataatttttacaatggcatattccaagtgttccagaaagcaaaccacactgatgaatgctgcattgaatacagaatagtcgcactaagattctagtaaaagaaatgaaattatatcaggtctaataggcataacagacaccacccacacatacacaggcacacacacacaaaattatgcacatacaagctcctgttaatgctgagaagaaactctggctgagaaatacagaccaaattagataagggaaatctcttggctttgctgtgagactgcccaactgcataagaaatttagtgtctccatataaatctggactgctgaattcacaaagaaggatcaaaagtattagaagtgactaatgagatatggttgaagaaggataacaaggctcctggggacaagggtgatattgtcaatgaggcacacacagcttggtactcaagggtttgtgtcaaccagttttagagcaaagagttgcctggtgattttaagatggaaagatcagatccattgaagcacagtacatagaagtcggctataatcaagaacagtgacccgttggtttaaacatgtactgcttcagaatgaaaagaaaaaaaaaaactatatacatctcagaaattgaactacagattaataccgaatcataatatataaaggtatgaatgaactcaagcactatttctaagacaacatgaggttaatatccttgtatctctagttgcacatgtatagagattgtccacatatacatgtatgcatacatacatgcagaacattacatgttttacgtacacagagagatggacatctgtatacaaaaaaatcaatattgttagtattcaggatgcctacaacatagtgagcatgacttgtttagattttaatgtactcattagagttgacacattaaatttacaagtccttgctcgtgtattactcagcagatcttaatacagacaggaatctttttctcttccaataaatcatgtatttttaattttcattcacaactcaatatcccacaaaaccttagatttttcaaatagatttaaaaagctcaaattattctgacatgatcaaaacatgtacccataagacttttctaaatgacttaaaagttttccaatctgacaaaagataatagaggatggtaaacaaccaagtcatgtcggttctaatgccagtgtagctatcctcgtttctgctcctagccgtactcttgggtcttttgtgtaacctttaaataccctccctccctctaattccagctcacttccatccattcctcctactgctgccacaatattctacttggcaaatgtcttccctaattaaaagtatttgttggttctccataaaagctggtcttttatgactggcttccatccatccttctggtgtcctctcctactgctctttcaaacacaacaagcccaagccataacaagacttttgccattctcagaggatgcaaagtttactcctgcctcaaatgtcattctgtatgctgtcttctctgtctggactgagttttttcctatgcctacttgttaaacttctcccttcttttttattacagttcagcatcacctgctctacagggtgttcctcgattttccccacaccatctcccctcacccagcagagtatcaactccctccccactccttatttttttctatattcttctattaaaatacttcctacgtttcactatctttatgtgtgtgccttctattatactgggtagggtaggcaccacgttattttccctgatgcctagaatatagtgaaagaggcaatgggatgtgacaaacctgtgtttaatgcacagttgtaccaccttgagtaaactatacaattgcacagacttctagttttcaggaatgaggtggagaaaacattatgtacaatagctagggttgtgaaaattaaaatatgctatacttaacgtataacaggcacgccataaacagtaataactagtatgttttggtacatactaacaatatctatttgttaatgaatgaaagagtgtgtgaatatatgaactgtacctctctgttggatatttttaagttggaaataattttcatcatatctgaccaagtacaaatggtagaacatttccttttctttccttcaaccaacaatgataggcggtggatgggtatcatctgaatcagagagatttcatccattcaaatgtccatttaatcctgtttttagtttaacttcaagttctgtgataaaatcaccccttttaatggagatgttctgaagagcgtggtgtaaatactggcccaatttttagataagtcctttaagtcagtgaatatcactatgaagcttcttgttaagtatttcccaatgtatgtgcttcattttctaatcatctcatttctgtcagacattcatccaataaatatttactaaacacctattatgtgtctggaacctttctaagctcttgagcacgagaataggcacactttttcttaaagaaccaggcggtaaatgttttaggtctatggtccacatggtctctgtcacaactccctttacagcagtagcacaaaaacttccttagacaacacataaacaaatgggtgtggctgtgttcccataaaactgtatttataaaaacagacagtgggccatactttgcagactcctatacccgagctccagggcctatcaagacagacaggacttctaacactttactggaagagaaacacaataaacacataagtaagaacatcatgagtgctctttaaagaattaaatctggagatgccatagagattgactaggtggctaccgtaaatcaagttctcaggaatatcctctctgaagaactgtattttaaactgggattttaaagacaactagccatggaaatattaatataaagcatttcaataaaccagtagacacaatgatattgacaaataggaaatacctagatatcaacatgatggtatgatctagtatgatattgcaaggacaaactctcaatatcaaaatatcctgcaataacaaaacatccaaacagatacagatggcacaaaagagtattgtgacagattacagtttcaattttttactgtaattgatatatcctagaaagaaaaaggtctaactccagcatcatatttaatcatttttaaaaatcactatttaataattcttcataaggctcttaaaattcaatttcaaataagttgtgatcactatttttgaagatactttgagtctaattgagaagacacatagataaagcatctaaatcaaattttgctttgcataacagaccctatgagtaacacctgcctatcagaaactaagcaaaggttttgaggggcagggtagaagtagtggtcacaaaagattttctgaaagaggtgataagcagtattaaagaaagggcagagaggtagtagaaggaccgcatgcctgatccagtgaactcgctgtacaggcacacaggcagaaatagacatagggcattctgggagttgaacattgttcaaaacagctgaatggatgaggaatgtggggcaattgcagggatgttattagagagacatgattataataatctaggaatactaaagttaaaataattattctgagaattacagagggccataataagctgaagtatgaaataatcatatctgcaaaagccagccagatgtgaatagagaagagagaaagcaggtaccatcagactggtgaggagtaataccattctgaactaaaacagcggtggtggatatagagagtggaaagagattaaaaagatgttgagaaaaaatctacaggccacagtaacaaatgtgggaaaggagaaaacaggaagcatggttttctgacttgggttcttagtgttattaacaaagatatgaacattggaagagaggtacacttggggacaacagtgatacattcaattttgaacataacgtgaggtgcttctgagatatccattaaaccgcgttgtttaaaaaaggcaatcagagtagtcaatctgcatcttagccatgaagtgtataaggaagaatcagatttgggaatcatgtttcagtgacaattcaaaatattgcttgactaaaattatcactaaaatgacaccaataatgtctatgaatcctcaggtttaagaggcaagcaaggacaggtccagtagctcacgcctgtaatcccaacactttgggaggccgaggcaggcagatcacttgaggtcaggagttcaagaccagcctggccaacatggtgaaaccctgtctctactaaaaatacaaaaattactcgggcatggtggcatgcatctatagtcccagctacttgggaggctgaggcaggagaatgacttgaacccacgaggcagtggttgcagtgagccgaggttgcaatgagccgagattgcacaactgctctccagcctgggtgacagagcaagacttcgtctaaaaaataaaaaaaataaaaaaataaagcaagaaataggaatcagatagaagttgctaagaggaagcaatgtagacccaactctcacaaacaaaaacataatttcccattaaaaagtgatcagtgactggtacactttaacattgttttcatttaactaaaatggcaaaatgtgccttttgcattaaaataaatgtactgattataaattccatgtatctatataaaactcactctatcaagaagagataatatgaaggatgttgaaaccaatacaaacccattattttctaatgcattgttttatttgcctttttcaaaatcattattgatgtaaatcatgtacccagggatagaacgcctgcatatcttacatgtacagcactttgactaatgcttgctgtgcacttggagaataagcaatttccctgctgcctccattagaatgatgaggtaatctactgtgcctttacacttacagcaagcctcaagagactgaggcttgatgattacatggtcttataaggccataaagttctaccacaggagtcatatatgtattataaagatacttcaaattgctgacatagtctcctcaccatcaatgcgtgactcttctgcaattcacttgcacctctggctttctgaaatgatttaaaactgcatcagaactcaatgcatgcatgccaaacatcatcatcagaaggcaggtctgacaagatttaattacttagaaacttatcagatttttaatcctcaacaataaaactataaatgacttttcagtaagatgtaataccaaaatgcatatttctcaaaacacaaaattagacatgttaagaataaactcaatttaattttaaaccagtagttactctgatgtaaacattgatgttatactgaaatgaattttaccattcttcccaaaacgcatttgccttcatattaatcttactcatggttttaaaagaatcctttactttcttgtcagtttgcattctgtatcaaactgacggaagccaagatctttcacattatttgtcagtttcactgccctttccaaatatatctgtagcaaaaccttttcatttgtctgatccagttgaaaatcttttatattcattttactgagacatcagtcttcaatttttcccttccattcactattcctagatgtgacacttctaacaatttgtagttaaaattaaaagccagtacattttattactgtttaatatattctttctttttctatttttaaaattacatactctaaaacaggtagcaataccttctttttttttttttttttttttttttttttttttttttttttttttgagacggagtctcgctctgtcgcccaggctggagtgcagcggcgggatctcggctcactgcaagctccgcctcccgggttcacgccattctcctgcctcagcctcccaagtagctgggactacaggcgcccgccactacgcccggctaattttttgtatttttagtagagacagggtttcaccgtgttagccgggatggtctcgatctcctgacctcgtgatccgcccgcctcggcctcccaaagtgctgggattacaggcgtgagccaccgcgcccggccgcaataccttcttaaacaggaaggtaggagtgtgtgtgaatcactgtaggaatcagatcatattattctgttctctatgtaaactgatgtgtacttaatacatgtacaattaatgacatttacatcatttaaaaagtagttctacatggacacagggaggggaacaacacacactgaggcctgtcagggggtaggagaagggagagcattaggaataataggtaatgcatggtgggcttaataccaaggtgatgggttgcatgtttacctatgtaacaaacctgcacatcctgcacatgtaccctggaacttaaaaaaaataagaaaaatagatttcaaaggaaaaaaaaatttagttctgatacatctacacactgcaaaaaccttatataattttttgtgtgtgtgtgaggacagaaaaaagtgagtttttcaggcttttagagattccaaatgcaatgagattgaatttactgtttgtgttagtctcaaaggggcttttccttaatgcaaatttattttcttgattccaagggtatgccctgtgatcttttctacttcttgaaatgtcttattatttcatataaagttttttattttaaatcaaaaatcaaattttttatctagaattcacatcctttattaaaatataataaatcattcacaggtattattagtgtttttagagcataaagatgtgttcattaagatgaaaactttcctgaaacccctggatgttatttgttatgtccatttctaaacaacttccttctttcaatttgttcagaataagttgaaataaatgctatcaacgtcaaaatacagactatcaaagtgtacttattttctagcttaagaaacttttatctggaatttgaatcaatgcacagcttgctggaaagatttctatgcatgaaagatatacatatatgaagtgtatacacatgtgtatttatgccaagtaaaacagagatttagtagaagatttgaaatggtattctaaatatttcaattttgagaatgttacccacaaaggtatattttattttagaccaagattgatttcctgaactttttaactttttttttttttctggcaaatgctgtaatgctattttctaagtagagcttagaaatgtttaattgtacaaatttttgaaatgtacaaatcatagtaagaccataattttgtggataaactctttgaaatataatggaattagaatatttggcaatatttcatgctgaaatctagaacttactatttataccaaacacaaatatagatacagatctgccaaatgtgtaaatgtcatattcctttgtagacttttatcctggaggattcttatttatataagatattatataagtagattaaatttgtagtcaccacacactaacataaaatgaaaatctaaagaagaaaacaattctgcacaagtaccaactgtatattaccaacagaatttgaagtttggaaccaagtgggtgggtattggttagaacagacttctcaacattcctgtaccaaagtctccaatattatcattaatattacaatatagcagaaggtctacatttggcatggccaaagtcttgggggagcacacaggtgatgatgggtgacaaatgccttctacattatttacctagaaattcaacaaatgaaagtcagtaaaacgttacatgacagatggaagtaataagacaaatgaaaatctaaaagttccaaagtaaaatttccaatatattttaaagtatactttattgataaattgaaaatcaacaaggcacataatagtcatacttagtccattgataacctctaatttattttcggtttccatttaggttttatcctttgtgatcttaatgaaaaatatttcaattaaggtgagtatagcaatgctatagttgcagtaatggtattagaatatgatacatagtttcccataatgcaaaaatgtcttattttattgatagtttaaatatgcttctttccgttttttaccgcaatctaccaattcaggttaaattcaatctcttaatttgattttggcctctaacctatgattatatagtacatgttagttcaattatttttgtcataaattaagtggtgtaactgtatcagtaggaaaggttaacatcacatactgtgggtcacagattttgaattttatataataaattggagatattatttcagcatataagatttatgtattcaggtaatatattgatctgtggacatggaaaggaacaaaaatgtagacttaaactatcaagagcctaaaatcaatttctcctccaacctcctaagagagtaagctgtgggtttttgttttccctaacctgccattgttttaaaatcgggactaaagagaaaaaggatagaagattgaaaataagagaagggaagtaacagttctattgtgcagctcctgaaaatctgattgagaaaggttttaagacttgaaaaaaataagctttaaaatttattttagagataaaacttttagataaaaattttgattttgaaacatcttggggaaaaaaaatcctgagaagcagaggaagccagatttaaatcaattcattagtaattttataaatagaaggatgacacaaagataagtaaatgaataatatttcaggaagatttaagtggaaataccatatttgttgtgtgtatttgagatatatatatacacatgcatatatacatatatatacacacacacacacgcacacacacatatataatttaagtaggtaaaaacatcaaagtagttggtttgttgctgtttttcactcatcctacaacccactgcttgctgctggtggaattcaggtgtggaaagtggggcagtctgcagtatgttttcattcaacgaaggaacttagactgatggagattccatctacaaggtcatggggcagaaagagagttccagagggccctgtgctggcaattaaatccaccagcttgaaagtcatacatgtcacttccacctataaccaatggaaaaatgtcaaccacatattaccaccctgctgcaggttagaaagggtgcataatcctatgtgttgaaaggagagattcagattcctttgagcaatgaagtatctactaagccttgtcacagcacaaaacactaagatgtattcatgaaatgattatttttaacttcattacagacataacctatatactagaaaatccgtgacttttaataattatttatgtggataaacaaaagaggaacaacttggccaggcgcttgggctcatgctggtaatcccagcactttgggaggctaaggcaggcggatcacttgagggcacgagttcgagaccagcctggccaacatggtgaaaccccatctctactaaaaatacaaaaattagctgggcatggtggcaggcgcctgtaatcccagctactcaggaggctgagagaagagaatcgcgtgaaccaggaggtggaggttgcagtgagctactgcactccagcctgggtgacagaaccagactccattttaaaaaataaggaataatctaacaaaaaaacagaaagtctggaatgtgtttagaattacccatgttgttctaaatgaagcaaaaggtctattttaattaagagaggagaaaagattatgtgttgaaagtcttgaaaggcagagaaaggaatattataacactgtggttatggcatttttttacatagagtcctaatggctacttttgtacataattcttaatgtcgagttttaccgaagtactataatactcaacaagacacatgattaccagttactcaaatttacattttatgttaattttttattatttgtacaagttaatgccagttataaaattagatgcttgccaaataaacatttgtgtgtgtatatacatattcagattttgatagaatgcataaaaatagaagtcaattttaatcttagcacatcctttctgagaaaactaaaaacagtatatttaatgctctatgagtaaaatatatttaactccccaacccgaatatgtatagttaattctactgatccataagaactggctttattgtggcctaatgatagtttttattattgtattttcataaacttaactgaactttatttaaaagattataaacaaaaaatatactttattacacacagagggaggctgcatattcataacttgaaggccatcaaagtgaataatttcatattcaaattttcaggttttgtctattcattaaaatataaaccatctcaaaatcagctactaaaagttttattcacaagctatttagaatactgtaatatttgtgctaaaagaaccatgaaaagaatctaattaattaaattaatttgcatttgagcaaatttaattaattgtataattcatcacgttttccgttattttaatactgacttttttaatttaatgaataaatgaatgaaaagaggatgtttatatgtacacagttccatgttcaagaacttgtattaacagtagatgacaacattctcattagacagactaaacaaaatgatttatacttgttttcttatgaaaatgaagcatactgataaataaaattagactgattttggtttaaccatcatctaagagtgatctagtcacctcatacatgttttcttttaatccacattacagtcctttgaggtattattataaatattatattcttatgaaagacaattttgtcatactatttttacttaaggactgtttattcaaatgttcactgaatatcaccgttttccttttatagtttaaaaattttatttcttaccccttatttttggaaccattccacttatgtttaaaaaggctatccagttcacactatattacttcttccctgacttttccacttttaaaagcctttgaggaatcttcaaaagcaacccacaacatcctttaaaaaataagtatgagacaatcaactaatagagtaaatatgaactcctatgtgaaaattttaacagtacgatacgatttaagaatacatgttgtaattgaagtgatgtgactacaatatatcaatagtattcttcattaaaatgattatatataacacttgcatggtcttttaaaattatagatgactgcctttcaattataccatctagacattagagggaagattctatttctcaaatattcttggaaatccttattttgaattatacttgaaattgatgacaaatattttggacccttcaggaattatcttatttttcaaacagctataactcctctagaattaagtccgatgaaaaacactgtcttattctttttaaaatatggtaattattttccctagactaaaaaactgttactgaaggtaatttcaaaagagaattgtaaggttaaaataccagaaatagcatatatgcaaaattattgtgtcaatcttattctcatttaaaatactaagagaaaatgattttatataatttaaaacttggttaatttgagaatacacaaactgttaataatgaatgacaaatacagaggataatcaattttatccatttacccttctatcacaaatgagaaaatgttggttatatatcctagaaaattaatcaaaccagtttttgtcttttttttttttttttttttttttagctttgaggtggagctgaaaatttatgacggtcacaaattaaattattctggaattaatgattttctcctccaggtcaaaaaattcctctgacttataaaaggtgtagattaaatagaggagccattttgagtataaataatactatctccatataaaatttgtttctttcaaatatgaagccttccaccaacggcctgtatgactcatctggggacttctgctctatactcaaagtggcttagtcactgccaatgtatttccatatgagggacgatgattactaaggaaatatagaaacaacaactgatcttcacagacttggaagtgtagtaatggcacacttcttcaatcacatggcaatctaggtgaatacaagataataactggccccagtgtccatgacgcctacatgaacatccacacatgttccagtgactgtcatttgaaagaagcaagcaaaaacagagccacctttttagaagactgaaacaatattagcatggcctttagtactattttatgatactctataactcaggtagtatttttttaaaataacattattcattaaactaaaatttacatataacttcatttgatctaatgacaaatgttgactaaatccaatctgaatgtttgcatatctcataacccggtatctttaaagtctgatcttcgaattttgagacaaaataaacatgaaatctttatagtccatttaaaatctttgtcgttttaataaaattttagaaatatcttttaaatgcctttctacctctagggagaaatcgagtaagattttatccacgaagtcaaatgccaaatgattaaaaaatcctcatctcaaattccagacccccatttttttttccagttgtcaatccctttttaatttgctgtgaacagtactgtcagcctgttttggaagctattttaatttaagattatctctcttcttcaacctttgaatggcctgtcatttgttatacgcatcataaaagctagccaagtgcacttctgatttccagctgtcaatttatagaggcactgaattttgcacacattctttttcatgtcttccctctgggtttccttttaattttttttttaaacagtaaatttttatttgtattccctactaaacagtaagaaaaaataaagcaataactggattttttgcaaatccctgaatattcttattccataatagactaaaaaaaatcacaatattttctttaaacattgtgcctaggtaattgtgaaaaccaaatggaaatgaagaaaatctagtattgtaaaatacttgagctccttcttaagaaaaggcactgagaaatatcagctctgagaagtacttgtggaaaaatatatgatatgatattcctttctgacttatgtgcacacactagacagtgtgctaggatttatgtgatctgcatgtgggcattgttctcctaattagatagaaaacatgggttcaataccaagattaaccatatatgctgacatagattcttaaaaacttgaagtactcttaactcactgaatgtcctccatgaggctttcctaagaacagcagaatttcctttggctgtttcttatatatttggccaaatatataacatgagataaatttgtaatgaaatatagtacaagagatacagagtaaaacattaaaaactatccaacattttatgccttgattttggcagacttagtagtgtctactaaggctggcatgaagcatgtaagattcaatcattctcctgtagtaccctaggtagttctggggagcaaatccaaaatgctcccagggccatggaaggaatggacaggaagttttcacatacaacagagatgtgtgttgcctgggtcaaaggaaccagaaaaaaacagaaatccaaaacaaagagtcagcataaactagctacaaggcccgccatctacccagccctgccctaagttatccagacaggtaacgactaaccatccttgttcttcccttcctctctctgcttctccctagtttgggcaaaattcaaagagcagctatcaaagcccagcctccactgaaggcttccattagctcttcactaaggtagggaagaggagttaacactaacacaaatttggaaatttcactattacaatgaaaataaactttttttttttttttttgagacagtctcgctctgtcacccaggctggaatgcagtggcacaatctcagctcactgcaacctccacctcccaggttcaagccattctcctgcctcagcctcccgagtagctgggattacaagcacacatcaccacacctggctaagttttgtatttttagtagaggcagggtttcaccatgttggccaggctggtctcgaactcctgacctcagatgatccgcccgcctctgcctcccaaagtgcggggattatagacattagcgtccgcgcccagccggaatttcttaattgagacatttttattgagattgtttttatgtctaaaggtaatctagatcattttgttattttgaatctccaggaaagtcatccttatccagggtcactcactgaaaaggtttaataggctatcaaaataaagttggattttcacaacaaaccacgtcacatttgtacaaagtgattcatacagaaagcaaagtgagttataaatggtatcaaatttagaatatgcccatttcttaatatacagctatctgaaaaagtgattatgtgaattaactgaaacatacttgtgagaggtaaatgttacatagtcacatacatatatgaaaaatattgggtaaaacaaattttatttattcctagcagaatttctttgaccttttaagggttagtgtgtactatgaacctccaaagaagtagctataaagtatagctacttacagatatcctcatatctgcatgtactcaatgaaagagaaggattcctcttcatcgtagaaggccaccaaccctttcagattgaggcccgcttttgtgacctcatttaatcctaattacttcttaaagtccctacctccaagtatcacatcacattggaggttagagcttcaacatataaattggggatggagggaacacaattcagtctaaagcaatttacaatatctataaagctattactaattggtctgctgttctgtgatctgaaatgaattaaaaaaccactatctatatgataagaatactgtatctttggcatttgggttgataagtagtcaatattctcttatcagaaagtcaatagtatattgttctctatgaatatgcatgtattacataaatgttattttaaaaagatagtgaaagtaaaggccatctttacctcagaagtagaattgtttctctttgtgccaaacttattaattatggtcaaattagcctagcttaaaatttatattctctaactcaggcttgtcctcaatgtcttatgatgttcttaccatttccctgctcgcacctaatgagaaacaatgttaattatgtaagctaatcactttattacaatagacaatcactttgttacagaagcaattgtactttttaaaaagtgccctttcttagcacttaatcagatttctggttgcatgagtcagaatcaagactttataatttaaatagctctttaaaagaaaaaaggaaaagctactctgctaatatcagaaccatgacaacattttactgaaagttctttaaaaacattcacttttttagtcatttaacatacaactctatatattatatataatgatgtactttccagaattaaagaacccttttttttgcaaattatctggttttaaaaaatcaataaacacaaaacttaagaaggtcctactgatgaaaactcttttatgattctattgtgatccagattcacacttgtgacaaataccaagcatagaaaacaattaccctgaaaaataccagtgggttggaagtgtagtggatttttcagctcttcatctgagcactagatatgttaggaaatttgtcacggtgaggatattcatatatggcagctcatgtaagtcatgtcctgttagactaatcagcaattttaacaagaatgagtcagcatcctgtaaaatttagaacaattggttgaaagcctgttttgatttctaccatggtaacaatgaaactatcaaataaaaaaatattttttggaattatttgactgttgttcatgaaacaagtttggtatggtttagattggaggaacatggtaatattttgagttagtgagaaaaattgttctgttttattcatcttaactttgctatttggggatttaaaaataggaagacagaagcatttcctattagatagattccttgcattacttactgcatgcaatcctcactgcaccctaacaaggtatattcacctcctttgattgtaaagaagttgaatatgtaattcagcaataaagccaggacttgcatccacttctgttaggttctatattcttgtccatgatccatagctaaaccctgatgaagtgaatgacgtcgttttttaccccaggattgtacatgtttaaaattctagcgtttggaggctcagatttttttgtataaatgtgttatttcagcctacctgtccatcatacctcctgttcttataccttttatgcctattcttatcaacatagtatccaatgtccacaactttttcataaagatggaaaagattacaaaattcttcctccagaaaacatcccgcagctttccatttatgttatggattggatgtttgtatactcccaaaattcatatgttgaagccctaaccaccaatgtgatattatcaggagatggggcttttaggaggtaatttccatgaggtcatgagtgtggagcacctacaataggattagtggcctcatgagaaaagagcttgctcgctctctctgctagtgcagaagaggtcatgtgaggacacactgagaagacccaggaagaaaattcttactgggcaccaacctgcacctcgatcttggacttcctagcctccaaaactgtaagaaatacacgtctgttattttagcctatctgtctgagataattaagacaatctcaaagtaaatatcagagtctttgcaatcgtccatagggctgtggctgacatggcgtctgctgctacccctgctccccgttcgcttgctaactctgctctggccacaatggtctccctgctgattatgagcccaccatgctcctgcctgaagatctttgagttttctgtttccatggccacagccttcttacacaggtgatttttatggctcacttgctcacaaactacagacttcaattacaaaattgccttagccacaaggccttctctatctacccattataaaatttcactcttctctcttaacccaggcactatcattaacctcttctctatttttatcgagagcactcattacactacgatatacactattattttaattgtttgttttacactccactcccctccaatagaatgcaggctccatgagtacagagaattttgaccatttagtcagtgctatattcccattatctggaaaagtacatgacatactaggtccttaataagtatttgctaaatgaagaaatgtgttaaaggcaaaataaagagaacatttaatatttttcattcctatgatatatattttaacatacatatatatttgaagttagttttaattaataaaatttcacttgatgattgactgcttctgaggtaattaaatggtaataccatgtctaaaaaagctattttcctagttatgatgaacttttccttgatatatatatatacacacacatatatatatgtctgggtatatatatatatatatatatacgtgtatatacgcatacacgtatatatattcatatatatgtgtatatatgtatatatatattcatatatgtgtatatatgtatatatatattcatatatgtgtatatatgtgtgtatatatatatatatatttttttttttttttttttttgagacagggtctcactctgtcacccagactggagtgcagtggcacaatcataactcactgaaacctctgcctcctgggctcacatgaacctccaacctctgccttccaaggagctgggactataggcgcatgccagcacccaaggctgtttttaaaatttgtttagagagacagagtttcactatgttgcccaggccagtccctaactcctgggctcaatcgatccgcccactttggtctcccaaagtgctgggattacaggcatgagccaccacaccaggaggagctttctattccaataaaagatagtaacagtttttatcaaggtataattacaaaatagatatttttcttaacacatataaatataatccatattattttgttattgaaatcacagaacaaatgtgatttactttctaacatattgttttttaaactaatccatcaataaatcaaaatatttgttaaataaaatatgccaaatacaggtcaaaatattgtacacttccaagttaactaatatatatcaactactataatcaatatagtttgaaagaagataatatttcagaaacaaaatcattataagaaaaaataaatattaactctatagtttctgcctaatatcatttttcattaacttttaaaaaatccactttggttataaaccaattacatcctaagtaatctaccctacacatattaatcattgtaagtaacatcaaataatcatatatctctcgtggattgcatttcctttaaatcatctgttatccaaagaataatttcactctttaatttcagtattttaaagttgctctcacgtcttctcattatttcaaagctaattacaaagaataacattatacaccagaactgaatggtctaccaaaaccatgaacaagtttcccctcttacaaaatatatttgatgacgcagtatgacaagctagtatcactccactgaagtattttcactgagactataattttctcaaaaatatgcagatacagactttagagcacaactattccatctgaatcaagccttttgcccaagaacaccaaacaccttaaagaagcattgttttcctctgccttttatacaactatcagatctatggatttagcctgatttatgtacagcatgccagtcaacttgaatactaacttttttactctgttaaaggtatactacccacactggttcttggagtaacaacaaaatgggctgtttacaacagctaaatgtaaactattagcaagtggtggaccttgttggaacagattagttactaaaatttacaggagattatgcaattgtccagaaagactgcaagcacctttttcctctgcaattttgacactgatgtcatctaagatacagcggctatatcttttaagataacacaattgaatatcaagataagttacaaggataatgtcagtgattattagcttaaattacaaaaatcaagcacttttagtaaagcatatgagacatcaaaagataatacaactcatgaaaattgtcttcttttatcaaaatgaagatatcttcatgataaaagtatgttaggtatttttacttctaaaacgtaaataataattgccttacttaaattatagggtaagtataaggacaaaagtatctggtccctgaaagctttatgcaagttggggtttcttcctattattttccctcattaatgttattcttatagaaatataattatacaaagaactatcaatacaaatttccatttaaaataattatacaatattctatgaagacagccctacattgagtctaaagtgattcaaaaattaataaagttctgagattaaaaacaaattaactcagaatattcagcccttgtttttactaagttatatgcttgtcttgtataattctaagcagataaattagatctgaaaattaagtatggtttgggtgtcctctaaaagaaaaggagcaaccagtgaaattctcaaaaatggagattttgagatggggctctaattaaatacagtactctaaaactttaaatatatcattgagcagaaataatcacatttcaattcaagggactttaaaaagtaatcatctttgtgaaattagaacacgaggtttcttatgagagtgtagctacacaactgtcttaaaatgaaaaaggctgtttccttcagttaagccttcaattaaagtgcattttcatattcattaaactcagaagccgagaacaatcctctaaatcggatatgttcccacacaccacatgaagaatactggtaattattaaattttccagatcttgtggacatttctgatttcattcctgtcatttattcatgcagcttataacattggacatgaattttaaaggagtacaggccaggaaaggttagagtcttactgatgagatttcagcaaagatgaagatgccaatattaagatgaatgggactaaataaataatccaaagacagagcttcttttaattatgacatatcccaaagaatgcctatgacttctgaaaacatattaaatattttattgattctcaaaatgttaagttgtattctctgagactattaaaattatctgtagctatttacaaatagtttattttaaattggaaagaaaaacattgtttacacaaattaatttgtgtatgtaaattgtagcatactaagatatatgtatgcctatgtaaacatttttaaaaaaattttttaaaaatttacgttcaaatttgtgagtcagatttcatatttgttctagcatacaacagatggatgcttaagttataaagtgatttcaactcagtaaaggaagcaaaagagtaagagaatgcagattctaatgcaaagtaagtatcttactgcctcctgtggacaattctggctcacatataaccaaacaataacctataaacttgtccagacaatctgtcttgactaccaatactagacagagaacattaaagtaaagagggccggcgtgggggctcacgcctttaatcccagcactttaggaggccaaggcgggtggatcacgaggtcaggagtttgagatcagcctggccaacatggtgaaaccctgtctctactaaatacaaaaaaacaaacaaaaaaaattagccgggcatggtggtgcatgcctgtaatcctagctactcaggaggctgaagcaggataattgcttgaagctgggaggcagaggttgcagtgagctgagattgtaccactacacttcagcctgggcaagggagtgagactccgtcccagaagaaaaaaaaaaaaaaaaaaagaaacagaagaaaaggaagtaaagagaaagcagctagtgttctggccacaccacatttatttcaggcacactggttttggctttaacttcttttacacatcagtcttctacgtaaatacatgttgtaaacaaaatgttcatagagcaaagctattagaaaatcactgacttaaaatatcttgtggacatttataaattactaaatttagaaataaaaagcctcccagatatcaacaatacaaaacccaatcataaaagatttctaataaatgaacaacattcaagttggcttcagttttcttcaacagagtaacgcaggttgaaaagcagtgccatgatgtacagagtactgacaaaaaatattttgactcaaagcttctatacccagccagtttttcttccaattggaattcaatagaaagatacagaaggagattattattttgttaacatatccaacaaacaacaggtgatagatctgaaactaaagtggaaaatatattattcaaaaattgagaaacataaccatatagcttagcattgtctgaacagttagaataatgacaaaaacaattacaaatatcaaaagtaactacagaaaaataatacaatggtcaaagaaaaaatattaatatatgaatccaaatctcaagtgattttaaaaagggcttggaattaatagtctcagttgtattgtaaagaagttaaattatgtttaaggctcatgtaaaaagaaactatatctatacacacacacacatatatatacacatacaacgtttctattattatatgtaattataggtttaaaatcaaagaattgataggatgaaaacagtggtacttttaaaacacttaaaaggagaaacaaaataaaataatttgatcaaagataaaatttataataaaaagaatcatatatgcattaaaaattgtttttaaaaccaataatctcaaagtgaataaaaaaaaaaagctcatatacaatgtgagtcccttaatcttgtgagtctaaataaactttaactgtaaataataacaacaacaaacacttacatagcacttactatgagcctggcactattatgagaatttaaatacattaaacttgctttatcctcaaaggacatttcaggatactaatcttatctccattttacagatgagaaaatgcctactcagaaatttgaaggatttgccagaggaaataatactgctaaaatttaaatttggacacaggtagtctggttccagaacccaggccatctggataatctggattccaaatacactctaccgcgtctcaattaagaggaatacaagaaacacgttctttacaatcgcaagcagttctttccccttaccctttactatgtgagaaggcagggaacgaggtgcaggatggggtggagggatgggttaaagaataaataatatggaagaccagggatatgactgaacaaataccctgtttctggtcacagttcattctcagacatgatagagctgtcttttggaaaattcctagttagaattctcaggctctgctctgattaatgcaaagcgtgtctctaaaaaacaacacctgcgcaagcttccgccactattttcctaaacactttttttaccccatccctttttcacagggaagccttctccaaccaatatttccagtcacagcttttctagtttttaaggtctcttccttttacccaagcacttcttttggctggaagcccacaatacattgagaggaaggtactctttacctatatcctagggtaaggcagaaaaacacagaccgggagggaaaaagagagagagactgacagacatgagaagtcataagaactggaaagaatctgaaacatacaattttctccctttacccatttatgcaagaatatttttgcatgtgtgtataatacagctgcacagttttggcttttgacaaatatatctatatactttgtaagttatgggtggcaactgggaaagcagaattatttaccaaacattaagttagaaggaccactccatggatgcaggctgtcctacaaatattcgtttagtgagggtatactcacataaactgttcatgaaaatcagattgattctttcacataaatcagagtttaccacagactcttatatgacaaacaaaacaatgtcacatttgctcttttttttccccctcaaacatgggaaacataagacaggcgagagcatggtattccaacagatgttaacattcttttacttacagccctcatagatgtcagtaggaatatggactgctgcgtgctgataagatatttgtcgtccaaaattagcatcttcaatgaaaacaggttttatcctctggctgcctggctcactgtcatttttctcaggctatatagaaaaagaataaacagaatattacaatttttgctaacataaatattttcacatgcacttctttacttgccaaatgcatatttttcaaaaaataaatctacaacaattgtttaaaatatagtaccttgatagcattggatacacaaatttccattcaggtattagcactcacagtatatctttattgtattattcacattataactaaccactctcctgatttcctcaatgttggagtcattcaggatcatctttgggggacgagggagaccagacttccacacatataatacttattaagatgtaaacttaaagaattggataggccaggcccagtggctcacgcctgtaatcccagcactttgggaggaagaggggggcagatcacttgagcccaggagttctagactagcccaggcaacacggcaaacccttgtctctatgacaaataacagaaaattagctggacatggcagcacaggcctgtagtcacaggaggctttaggtcaaaagatcgcttgtgcatgggaggttaaggctgcagtgagccatgatcacatcaccacactctagcctgggcaacaaagtgagaccctgcctcaaataaataaacaaacaaacaaacagacaaataaaataataagaaactagagaggtgcctttaaatacaacctaactaatattatccacttgaaataaatttcacaatttatttaactaaatttatattgtgcagttgaagatgattctttgacaaataatggtacacgtgacagaaataatatggcaatgaaggattatttaaatctcatcctcttgctttttgcatgtttttcaggtatatcaatttttgttttaaaaaagaaagtatgctaggaaagaagcgatctattctaactctaaatacaattaaatcctaatttcaaccaatttgactcttgaggcaggaatgaagatccaatcaataatgattcaagaaaacccctcaggagtctcaagtcaaagattaattttctatctattggaactatacttttgatactgaattacctggttgccttcccctggtaacaaactaagaatttcattcatttatccaaaatgcatctataacattttttgatatttgtgttaaactttttttgttcagtcaaaacaggttttaactctaccctaactgtatttgtttttaaatgatatgaagtttaaaaattacgagttaagtaaaagtgaaaagagaaaaaatcctatttgttttgggtagaaacaggtagagggagaaatgaatggatgtatacatagcaagtgttaccagtattattcctggctttgcaattttaagaaataacttgtgctttctggtttttccaataatacaatgagaatatattatatttgtgataagaataaactattaaggtttaagtcttttctattaatattataaagcttgtcttacataaaaattacttctgtttcctctgaatcctctcacacttaacaattagcagttttaaattcatcttatggaggctcttgctcttttaaataaccatataaatggcttttagaaataactttaaaataataacgtacttctcaacttgtaaaatcatgtatcaagactccttaaggtacaattgttaaacatattttaaaaaagaataatagtgctatttccatggttctccttttctagtttatataaattaaaataacttcataaaaagatgagaatttctcaattgaactcatttattatctttaagctactggaaactactgttccttataccatcatactccatgtctttacttatctttatatattatggcagtatatttttaattgaaatacagtaaatattatatacaaaggacctgacttttatgaaaaaggctacttaacacagaatgtctcatgtagtaattaactatttcaaataaattctccctctgaaacaaagaattccagttcttcagaacacatacaagaaagaacatctatgtctccttccagtgttttcttttcaaaatatatcttctgaagtctacagaccaccatatacaaatgtgtacagagaaaatgagcaagtggattctgaaatatattcaaatgcatttgataaaacgaaactgacacatgaaatgcataattctcagactattcttctcaatataatttcagctattaaataatagattagatcactcagagacagagatacaagctaatgttggatgaggaggtcattcaattttacaaccagtgcatattagcaaatttaatttggaaagtcataatgataattctttgacaggtacaaaaagctcttgcaaatttaacatatttgtctcacccttagaactgatatttataaaaagcattgatttttaatattttgttctttttcatgttaacttaaaaaatattcctacttatagcaaaatattcaaaaattaaagtctatatattttacctaaattgcaatggaaatttacttaactattttgcacaattcagatttgcaaactgataaactttgcttgcaatcatactatggctacgtttatgtccccagttctgtattatttttgtgtgccacaaagttgtaaaataattagttgatatagaataaaatggctcactaaaactctctatggaagtatcacaatttgtatttctatctcactagtaaaggagttagatcaacagtcttggctaggtccagtggctcatgcctgtaatcccagcactttgggaggcccaggctggacaatcacttcaggccaggagttcaagaacatcctggacaacatagtgaggccctcatctctacaaaaaatttaaaaatgagcctggcatcgtggtatgttcctattatttccagctattcaggaggctgagacatgagggccttgagcccaggagtttgaggctgcaatgagctataattatgctactccactctagcctgggtgacagaatgagactgtgcacgcacgcacgtgtgtctgtgtgtgtgtgtgcatgtgtgtaggatcctgtgtgatgaaacaagccttgcatgcaattctccaatatgtatgtatgtacgtatattttcaaatttcaatctctaaatacatcctggttttttgtagtttttgtacagttgttatttacattagggcttgcagcttttacaatacagatattactgattttagaattttttaaagtctcgattactatcctcaatatcaattttggatatgtaatatgccttaaggcatggcatcacggtccaatgtaaagcattatcaaagataggatgtgttatatttaaggtggactttcatacaggcatcaagtctgaatattctggcatactgggatactggatcaacactatggattaaaaagtaaagtttaggccaggcatggtggctcacacttgtaattctggcactttgggaggccaaggcaggtggatcacgaggtcaggagtttgagaccagcctggtcaacatggtgaaaacctgtctgtactaataatacaaaaattagccgagtgtggtggcacatgcctgtagtcccagctactcgggaggctgaggcaggagaatcacttgaacctgggaggcagaggttgcagtgaaccaagattgcaccactgcactccagtctgggtgacagagcgagactctatctcaaaaaaaaaaaaaaaaaagaatgtttaaacattactttaaacattactttttaatatacagtattacattactctgttatggctagttcagcattggaatttaagcatcctgtgctgctctgctaattaaagattgttaccaggtctgactcacacagaggaaaagccttgtgattttttgtttgtttgtttgttttgttttgaatcaggatcttgctctcttccccagcctggagtacagtggcacaatcatggctcactacacccttgagttgccaacctcctacctacctcagcctccagagctgctgggactacaggtgcattccatcatacccacctaggttttttaatttctattgttcagagccagtgtcttgctatgctgtccaggctggtctcaaactcctggcctcaaataatcctcctgcctcagcctcctgagttgctgagattacaggtgtgagccaccacgcccatcttgaaaagcttcatttttggtaaatctcttggatcaatgagaatgaagactcaacagaattgcaggtgatgatgcccaaataaagaatgaatagaaagaggtgtggaactttcatccagtcagttgttctaagtcaagttggaaggccaggttgaatattaaatgatgaatctagtacaatgacaataagaacataactgagccttctgatttcattgatttaagctgctattttctcctatgacttagagaagtatttggtagatgaatagatttagaaagtgtatgagttggatgacactgaatatgcacttaaggacttacacataatatttgtacttttactgaatcataacaaaaaataaaattttgaaattatgtatttaatgaatagaaatattgttcttgcaaaaaaacatatgagcttaggtaatatatttgatgaagaacaaattattttatggattcagaagattatgcccattcttcaggtaataaaaatattgtaactccttagatttactctggaaaaactgtagcattgattcttcagaagcaatttatttaacatactaagaaaagaaagttttaaaattaacatgaaaagtaaatttataacatcagtggcgaaagaaaggtgaagaaacaattctagtttttaaagattagattcagtgtaaagtcttcatgtattattctactaataattatgatgtataaaagagaagaaacagtctgagatatgtagattttggggaaaagtgaaatcacaaagcagctgaaattgagcagtaacaaaaagaaagttaaaaaacactgtagggaatattaaaacaaagaatatataaattttccaaatgacagtgaaagataaattagaactaaattaagttaaaatgcaatactgatccctgcaataacttgtttattaaatttaaaagacaaaattgacattcttcaaataagattaaagtcgctgatgaggattataatgatgcattcaaaagatctgaaatacagaacctgaggacatccttgaaataaaactgatgtaattttagtttgcatgatgaataaatttagtttgcatgaatgcccatgaattgcctatcacaagacctagcagggagtaaggcgagccattagcaatacaatacagttgagtatgatggaaaagagttggaggctgatttaaattccatatgtagtatgaagttttcaaatatccagcatcagaaagggatgtaatacagtgctacaaaagtatacccatatctacacattatatctaaatatgtaacctatattttgggaagagagtgatatttatcttctgctcaaggattgtaaaaggcactatgtgatttttacagagtctgaaagttcaacatagcactccccatggaaaccatgtagtagcatgcattatattataaaaggaaatgttttaaatgaagtcattctacttctaaaaaattaaaagaattttttatattatgatacacaaatatacttttcaaaatattgccagggcaaatgaggtttaaaacaacctaccaccttgaaaggtacgaagatcaatgatattctcttgatacctgaggcaaagactggctaaagtcatacaactaagatctaatttaagagatcacacagtaggactccaggttcccaccataaatgccactaatccaggacgactgggaacccatgtttaaaccatctttgcaaaaggagcatgtgcccaagtgtgtaaagcattaaaaatatatcaggacaggcttgaaaaattttggaaagcagccccaaaaacataaggcagaattcttagaagacactgagtctagtctacctttttattggttttatagtttctccccccagtgattcctgagatggctacattccatacagagatgcacacattaattttaagatattcatggtaaacatcactgggaatactggatcagatcagcagaaacttaggactcaaagtttaacaagcttatacatcacccacgttttattttgcctactgcaagaacactgtaacctcacaactgtcaatgataaaattagttggatgaaatataagccaaatgcatcaaaattaaatacggagagaataatggatagatgtaataaattcaaattttaaatcaaaactgtctccaaaattttacccttaagtctcaatttacagcagctccttcacaggccctcttcttcctcataggtgcccactgcccaggcagcacagcatggtgacacagtgttccagctctggatcatacagactgcactgcattcacttccctactctgacaaatccaaaatgtgtagcactggacaagcagcttaagctcattaaattttacttgttttgcctgaaaaataaaataatatatgtgccacaaagggttctcgtgaattgtaaatgatacataaagttatagtaatagctagtatatattatacatacttattctatactaggtagtaaatagactaggtagtatgctttaaatgctaccacttagtagagaataagcatatgtatataagcatatatcatacaatcagtatatatatgtatatataatatatgctagctattattacccaatccaaacgtatcacatcaaaaatatttaaaccatttattttagaagcaaaaagaaccaaagcaattatggatacaaagcaattaatattctacctgtatgccatcctattcaaggattcaatattggccaacatcaaaaattgaaataaagattgcaaactgtaaggtaattttttaaatgttagaaaagaaacctatgaggcaggagaatagggtttagaggcagggaacctaaggccaattcatactgattttctagaactaaatcaaaaggaaaactcaactttccacacccaagtaacaaaaggatcacagactacttcctttgcaaaaccctccaccctcttcccagggcagaggcaaaatggaaagtacctctgattggtcccctcccacaaccaatcagactggtcacagtctttatttgcataggagtgtaactttgtaacttcacttcagcatctaattggtccccttcagcagccaatcagactgactgcaggccaaatcttcttctgtaacttcactttcagcctctgattggtcactttctgcaaccaatcagaatggttgtgggcctctacttcatttacacagagtgtaaaccaagtaagcaacatgaaacctctagagtgtatttaaactccagaaaattctataactggagctcttgatccacttgctcaagcccgctcctactctgtggagtgtacttttgtttcaataaatctgtgtttttctttcattgctttctgcattttatccagttctttcttcaaaatgccaaggacctggacaccctccaccggtaacacctagactctgattctttcttcaataattagacttcatcaatgtttgatacctaaaagtgtaaaataaaagttacatactataagacagctttttaaaaaaaaaatgctagaaaagaaacctagatttttcctttttctttaataattagatttcattgctgtttgatgcatatccctactagcttattctagaaccaggtttatttattgctataaagtaaaatataatcattaaagattgggcactgaaaaagacatttagataggagattatgttggaattaattttaatgtagacaagactctgctgctaagaggaaaataaatagcaacgtaaatatgcaagggaattcagcagactagccaaatgtcccagacaggagaaattttgaacatgatcaataaaataaaaaggagcaaataaatcaactcaatttaatgacatgggaattctaggttgaacttacttcatttgaattttagacagatcttggaattgggttaataaggctttgtaatgatctgctttctttttgcttactctgggaattaagaaaatagcacagtttgctggcacaactgaagtcttctgaggaatttgcttcactaatcttcagggaatttaatgacttattgggtcagatgtcttttgaaacctaaactaggaatccaaataaatttcaaaactaatgataacttgaatttgggttttcatagataattgttacattgctagcttttttttcccctcagtttattttaacatctactttttctttaaaatctgaataaacagagccagaaatgatggcaagtgcccgtagtgccagctactcaggaggccgaggtgggaggataccttgaggcaggagtttgaggccagtctgaacaacatagtgagaccctgtctctaaaattaaaaaataaaattgaacatatgaaacctataatgatatgaaaacaatcttccccgtttgtgtttgcatttttaaaatgtgttttgagcatttaactttgctttgtattttgtgcatgcattatcttaaggttttcatacaaagattaaattcatgacaataaaatgaaaaatatctcaatataatgccctttcattattaacacattcagatacacaaacacgctccatttgatgctaagatcacttccacttaagttgtaatgatattaataattaatgtttttcacaattacattcattaacatttctagactgccctctatgatccaggaaatggtctgtatgttttatatgtgttaatctaatctttataataactgaggttgctattactatcacctccattttaaagaccaaataactaaaaagcagagagattatgtgatcttgccaatatcacccagaaatggcagagctaagatttgaatctagctagcactccagtatataatctcaattatcacactctattgcctctactgtataacaaggcatacagcaattgtacatgtatgccttgttatttagaagaaacaaaaatagagtttcatgtagaagtatttggaaataaaacattgtctctatcttaaaagacttaagcaacagatgacatgattcattatactatttctctcttctgtatatttaaaatctttttcctgataaaaataatcttacattgaaacattatgctcatttgaatgatgtaggctctttggaaataaaactcaacttttttttattaatactatatgtagaataagaaagtgaaatccgcccaatttcctcaaagaattaatgtctgcagtgttttcgaataaacacaaaaattgacccagctggtcttaaagcttgaaacttgtatttatcttctctgaattcctttctcaggaaaccaaccatcaggcctccaaggaactgaaactcaccaaatcaccacattcagacaatgagacaccagaccctctcctaattcctgtttttcctgcatatagctacattcctttcatgctatataaacctccaattttagtcagttgagtagacagatttgagacttatctcccatctcctcagctgcaacacccaaataaagctttcttccctggcaatattctttgtctcaggggctggctttctgtgcatcaagcaatgggacatagactgaacccctggtgttttgttaaaagaacttggttctgatggaagaatataatacgcctgagttcatgtttcacaaatattcacacttgaaaccaaatatcttgatacttacatcacttgtagtaattacagacaaatattctaactgcactgcttattctccaatttcaattaattttggacctagggaaactacattgtctgttttaactctcctcttagtcctgatggctgtccccagggacaaaacagagaagatgagacaacactgtccactgccactctcatctgcatccaatcccattagatgaaattaaggaagcaaatgtctatcttaaacattaattcaaatatcatccatagtaaaagctagctttattatttcctctcttcattttgcttccactaaccttgaagcaaaattaacattttcatttccaccacgcttacaatatagcaccactttaaaaggtgaacacatcttcacaaacactatgaaaatatgggtatacaaatttaacaagcattatttcagcaattactgtatactataaaataaactaaatattatttctacctcaaatcactaaaactttagtagagaagatcaaaccctgtacacatattctattgtataaggtattataccattaaagccaaaaatgcattacaagttgcttagaacgctcataggaaggactaccatttgctacctacaaaaaaacaaggaaggtttaaagagagttattatttaaattgggtttttaagtaaagcacttgattggaggaattgtatggtatcatgatcaggtaattagcatgattagtcatgttaatattatctaggataagttaactggacacagcaaagattttcttacatatccagtaaggccatatgtgccttctatccttccatgagaatcacggctcatccaataatttatcccagttatacctgcatagtttgttttgttttctgaggttttttgtttgtttttgagacagggtctcactgtcaccctggctggagtgcagtggcacaatatcagctcactgcagccccgacctactgggctcaagcaatcttcccacctcagcctcccaagtagctgggactacaggtgcaccccaccatgcccagctaattttagttttttttttttttgtagagacagggtgtcaccatattgcccaggctggtcttaaactcctgggctcaagtgttctgcctgcctcagcctcctgaagtgctgggattacaggtgtgcaccacaacgcctggccgctacctgtgtttttaagtttcaagaggaaaatctgtttaaatgactaaagccataatttttatattatacaatcgtaaggagacattaattctatacttaatttcagccactgctttagctaaacctggctgtatttattttatagccacaaggtgaatataaatagcattgctctaagtggaggaacgtagataactataaaatgcccttgaggaattgtcttataccagagtccttgaagagcataaactttcccacaaactgactaattcggatgcagctaatagaaagctttcactctaaaggaagcattgatcaactttaaatacttgttttaccttggaggccatgcatcatcattataatgaacaaaatcaatagattacactcgaatgtatccttctttctacacaaacatgatcctggtgctacaccagcctaataaacacgaaagaacagtagaaatcaggaaattccaaattttgtcctgatgccaacatgtactaatctcatgaccttctttgtatgatttacttctattatgaaggctgctactacttcatctctactcatatcccatactcccctcccctgcccccacgttcccctgaatgctggtgttctgaggagtctatcttgtattgtcttaaggtattttttttaatgttgtgtagatgtgtgaagcaggctgaaagtagacaataaggagtagtggcattacagcaggctgcagaatatgttatatccaaaggtattcaaattcattttgtttttagctttgtgtaagcatgccaaaatttatctgtagatgaatctggccttactatatatgtaacttcacacttgctcaggaaatttcagccacttgttttcaaattcccctcataagctaaacataaaactctattctaggccactctcctaagcaaccaaactaaatacttagctgcctactagaaatctcctcttgaatatccttgagcaagtttttggtataaatgttcttgacttttaaaaatctttgtctgaaacactgcaggccttccaaatctacaattatatacagatttcttggcagacctgaatgtttccttccattaaatccttgatgattatatctgatacatgtgctttgacttgatctctgggaagacaggacttatgaatacacctatgaattctgaccttcatatttattaactttgttcccacattttttacttttctggcatttgaagagtacttctcaaacttattctgaggattattgataaacaattcacattgtcaaatttgttagtttctccattgagaattttgtttcagtggttttcattttgatggttttagtctactttttatagatcattgactctttctttggggacagtaagcatatattcaatgttgtttttctgcctgacatatctgaagtaatactatcttagagaagaattttcctctgtgtctttaatacttactttactgttactgagtatctcatggatttctccattgactggattttactttattagtcttaaatgaagaaaggcctatctagtctcaagactgggaagtagtctttcttccccaagtgtttgtccttggtgctgtcatatttgtaactacagaagtgctaatgatataaaacatttggtcctgccactggtcaacaatagggcaagcgttttcttcaaggtatgtatttcattgccaatcctctagattatagagacctacacaagtctggactaaggttgggatagtagggaaaggatctctctaaaaattaaagtatggggaagtaattctagaatataactatgacgtgttcttaaactatacttcagaacattccttttacagttgtgtgaaatgaagctttaatatgaacttagatttattgggaaagaaagtttgagtgattacaatgtgtactcgatattgtaagagttacatcagctgctataagtgcataagagctgctctctgggaacttatactcttgagggaccctaagataataattcacaaagattggctgtgccttcaagaaggagaaactttcatttcactgccaaacattatatgttccgcttagggaagttactggtaaagtttctgcacggtattaaacatcaaaaaaagagtcagtaataagtgacaaagatcttgacaatggaaaaagatatatgaatataatgtttataaatttatataataatgtatcataattaaatgcatttaaaatttataatcataaaatgagataatttcaatagctcttaagaacatatttgagaccaatgtctaaacttagatgattgtattagagcagtgaaaggaaatgattgatatgagtactaggaaatcctggaaatgatcactaatctactagtcttaggagttggaaaacaaatcatctccagcagaactggtgaaaaagttaaaataaccagagcctcaggatttataatcttttagttatacccaggaggtataatatttaaaatagaaactttatttagtgcttgttttttttgttgttgtttttgtctttttttttttttttttttttttgagacagagtctcgctctgttgcccaggctggagtgcagtggcacaatctcggctcactgcaagctccacctcccgggttcacgctactctcctgcctcagcctcccaagtagctgagactacaggcgcccgccatcatgcctggctaaattttaaaaaaatattttttagtagagacagggtttcactgtgttagccaggatggtctcgatctcttgacctcgtgatctgcctgcctcagcctcccaaagtgctgggattacaggcatgagccaccgcgccggccagctcttataaactaaatttgtcctaaggttacatttgtattttgaatttctttacagtaaactgcagcctaacttagtatgttaacaaactgcaacctactttaaaagtatattcttgtaactaataactgagtctcagctaatcatagcagctgagtttcagccaatcacaggctgcccactgatcagattatgtccacagaaggcaaatgctacatatgcccaagtaaggtaaatgcccagctatcaccatgcccaagtaaggtaaatgtccagctataaccaatcaagctgtttctacacatcacttcctttgtctgtctataaatactgcctggccatgttgctgggtggggctctgtcctaattttgagtactgcctgattcatgaatcattctttatacaaataaactcgggtaaatttaatttatccataatttctttcaacagccctcggatattaatccccattgaaacatactgaggactaaatttattaataatgttatcccagcagttagtatgccaattagccccactgttttattagttgatgtagacgtatgagattgtaaagttacattttataatctcaaatgacaaatttttaatgaagaatatgacattgtagaatttgaacaataaaaatacatagctaaactagcatgtataaaagtgagagcaaagaacagtgatagtagccaaattcaaacaaaaacaatgtgatgatatgatttgtgaacacctgatatataaaataccagccaacgcatatataaagttgtaaacaaaagatccaattaaatccaccctgtactgcaaaacttttggtgagggtgagtaaatttcatcatccataggagtctaacttcatgagataagtaacaatctttttttaaaaaaaatgtaaatactgaaacttgttaactagaatatcaaagtacaacatgtatttacagttcttgactttcactgtaatatagtaaatatttctattgcagaaaacaatttgatcattagttatcaaaatgcattaggagatattagaaaaaactcagtacagcacccaattttatattcattttactatagaaaaattatctcccccaaagggtttgattatatttaaaagataatagtcactcagatgaatgagtagagtgtttgcactaactttaatatgtcaagaagaacaaattgaagatatgtgcagaaactgctaattaatgatctctcaattactatcccttctctctttagtaatgtaactctacatgttagttgggtatgtacacatgggtcaagggttgggaggaaaagtactccatatcctcttgcaacaaggcaaggctggtcactaagttgtggacaatgggcacacatagaagtgatgtatgcaaactctgagacatgcccctaaaggcaaagggcatgtctcccattgtcacttgcctctctcctctaatctagaacgcaaaaagaatcatggatattggaacaccgatcttggagcacaacatggaagagctacactgaggaaagcagagaatggggagaagaaccttgagggctggaaagacagggagttgctgtattagccagtgtatccagaatgttcctagagaggaatcaacttctgtctaatttaggccacttttactttaggtatctctctaacagacaaactgatatactaatcaatacaacataatttgttttgattcaaggtttaagatcttataagagcattagcattatgttctaaagcactctgagcttgtccaatgaaaaattttcagtatacaataaattatcatatagttctttacaaattctcagaaaaattcacatgaaatattccaaatacagaaaactgaatgatgtcacaaggatcaactttgtattttacactcaggttgatttgacatgataatttattggttttttattttataaagcattctacaagtagaattatatttcctcatgtgatttctcccattttttctcttaacaaattacattcttgctttacttgagcaatgacagccttaaacatggccaaatgcaataaatatttacatactgcttacgtatatcagcaatattcagacttgtgtaaaataatattttacccattattatgaaatccatattaatatacagatttcacagatatgtaaacaacctcactttggctcagaaactttcacaagtcagtgagcctgaaaaaacatgggtttcccatgttgagggcaaaatctgaatactggaagacaagtaatcaaaacagtgaaaaactatttgaatgtgttagattatcttttaatataatgctgagcagcctgtgaggaaataatgtctctgtaccttaatgatggtagaacttggtctggtcctttttgtaagtgatatcgcactatgtatcaaaattcattaaaatgtcaaaaattaccacttttgggaatctatcctaaaaataagtttaaaactttgaagaataatatttatgtgtaaagatgtactgatatttatgtgaatactcacaaaggaaaattaaactccaaggtagaagtggagttaaatgaattgtgttatatcagctcaaaagaatgatccaacaactatttcccaagataaaaaatgattatgccacttaataacttgtgtacttaaagaatcatgcagggccgggcacggtggctcacgcctgtaatcccagcactttgggaggccgaagcgggtggatcaggaggtcaggagatcgagaccatcctggctaacacggtgaaaccccttctctactaaaaaatacaaaaaattagctgggcatggtggcgggcgcctgtagtcccagctactcaggaggctgtggcaggagaatggcgtgaacccaggaggtggagcttgcagtgaaccgagatcgcaccactgtactccagcctgggcgacagagcgagagtctgtctcggaaaaaaaaaaagaattatgcaaataagtaaacatatatgttcatgagaaaatattaaaaatgtaacaaaaaaccaacatgcttatagtagggtaaaagtcatgaatgccatcttcttccctccttttgactattaaattctataatgtggtcatattctttatccatttaagtatattctttatgtataagtatatattttcattagaatctaagaatatccagaactgaaatgaacgttatggatcacctattcatctgtatcatgtcttagatgagagaataacagttcaaattttaataggtgttaaagccctaggatgactataattttagggctggattagggcatgaattattctgattcctattctagttcagtttgcacgaaacaacactctttgcgaattattctgataacgttattgtttgtatataaagcaattgagttttcttcaaatgctgaccatcatagttttaagttttaaatttaaatgtggacattttactatttataaggctttaatttgctaaatttcacctcatggcagaaaacagagaaggaatccttatcctaagcataaatatataacccacagtagtagtagatactatttttttagatgagaaaatgggaaaaacaagacaagtttaataagttcacttacacatttttttctctctcaagagactttgatttaaacatttgaatgaacattagtgaaggcaaactatgtaacaatattagaacaactgaagtattacaaatagtaacacgtgcacttttccacttgtagtggacatatatgctcaaatgggcaactttgaagcattgattgaaactggagtgatagttactaaaaagtcatattgacaatttacatattattgttaaaatcttgaacaaaagaaaatcaccaatttcaatgtaaaataaaaattactttctaaataatgagcaaacctaaataaaactgtttcacatataaatgtaacttctttaattagtttagagaagaaatacttatttgcagtattggtttcattatctttatgcaatccttaattggaggattgcacgtcaatgccattcactttattctaaggctttgtcatcgctttacaaattaaatattaaataaatgttgcaatttatgtaccaggaaggttgatgaagattttgtatatatttttaaataagtttaaaaatatcaagtgctaattataatggtgaaactaaacatctcttcaaaaatggtacttattttgatatcaataaaccattaaaacattttgttttagttgacagtttgtacttaataagcctcctacatcattaaaataatatatacaatcatgacaagaggaaagatgtcatgggaacgccacctatgtctagaggaaaaaaaatactttttaaaacactcttagctcttcaactataaactggagaaaataaaaccttcttcattaacagtattgtaggaactaagtaaaataagttgtgtaaagtggttagtagtatggtttgagatggtggtggtataatttgttataatttgggaaactgtgacattatcaagccattatgtgttttctcattttttaagaccagatagacttgttttatgtattttttcattttcttcttttaaatagctggaagaaaattccatataatagtatataaatacaattattttgattcggatgagaaatgtgtgaaagacatgtaatacttttattatatttgtttgctatgtttactgaaataccccaagctcttaaaataactaaaatataggatgagcttaacaaataattttatcttaagaaataagtatacataggcatttttttgatctaagagtcaaatacaagaattttaaaaaattaagtgtaacctttattagataacttcgcaactctattcaccaacactaagtaataaatgtgtcctcaatgtctatccagatgtagcaatattagaagtaactgattagcactaaaataatccatgttttcaagtcatttaaatgtgtacattagagtcatttatttaaaaagtcatatggagcaactactttgtttcaaagactgtacaagcagggcaggttgttgcacagcttctggggtgtcattcatattgtagttgaagtaaatggttctccctggtgtgcaaagtttaagtcaaagcagataggcgtggtgaccctggtgacaggagccaggatacagaagtagatgggattggatagctattttcaatattgctaatggagtccagagtatcacagttggtacagaggactgtggtctggaaaaagtgcagtgagggttcagatccagagaaacacatggaatttttacttaggaagatgccaagaataagttgttaaaaatcacaaaagttcttcattatctcgtatctaactagtattttgctcatgcagtctaacattgtcttaaaaactaaaactgctagctcaatttattctatataaggccaatcattttactataattttcttggaatttaatggaaaacatttaatactcacatcgagatcatcctttgcattgtagtagacaacttcattgctctacaaaaaaaaaagaacgctttattgattttaataaaaacaatactgtatcaaatactgaatacattttatgcatattataaaataaactccttgtcatctttctttcacaatatattccacaatgatccataaggattagccactatttttccaggaacatattaaaaccgtttatcagtgatattacatcttgcattgggaaaaagatcccagtgtaagtctgagacccatttgtcaagaaaaaaataagtgaaaaattggtaagtaaaataaattatagacaaacacatatatacactgatatattaatacacaatgaacaggataattcaagaagcatgtaagatacgtgtcttaatactttgttgaagccatgatttttatatacatacacagagtgttgaaatgattctggaggaaatgtgcatctatacaatattggcagaaatttactcatggagtcagaaaagaaatgatgagcaccagggaattcagatagtaaaaaatatcagattatctcacactaatactctcatattctagcaaagtggtgaattagcattggtgttctagcaagagtaaatatatatggatgactctgctagccatcagtttcctgaaaaataccataaatataaattagggctacaaactatgttagaaaggaaaaatggaaatggattaataaaatgactgtcaggaatttaaaactcctattctttgtgtctctgaggctagttctatgtagtgtaaaaataatccacttagactgatttctctatcttattccaaactgattgaagatatagttcatcttccacatgtcttcaagtagtaaactcactacgatgtgaacacatatttttccctgcctcttaaacatccaaaaacatagatgctgtaaaattttaggctgacgcggtggctcacgcctgtaatcccagcacttcgggaggccgaggtgggtggatcatgaggtcaggagatcgagaccatcctggctaatacagtgaaactccgtctctactaaaaaaaaaaaaaaaaaaaaaaattagccgggcgtggtggcgggtgcctgtagtcccagctactccggaggctgaggcaggagaatggcatgaacccaggaggcggagcttgcagtgagctgagatcgcgcgacagagcgagactccgcctcaaaaaaaaaatttattaaaagcaaacatataatacacaatttttaaaacggaaattacttgggaaaagttcactaaattagtgcttctcagtgtattccctttccccctccccgcaaaaatcactacttcttcaagatattaatggatgtcatgtgggcaaaagcattccatgatcatatgactttagaatataataaagttaaaattgtctcttttcggcagaacttcacagagacaatgtataactgtacattataaatctccaagaggaaaatacattgtgttttctcagtttatttaccacagaaatctgcctgtttttgtttgagaaacataccacgagactgaaactctaaaatataggtctccatgaagaccaaacaaaccaaaaatgatataaatatcacagcatatgaatcataatagagactgaaacccatgaatttgaatttcatttagaatcactaaagttttacattatttgattttcaaaagaattattcagtagctaaaaattttaacatgcataaaaattctaattcctgaaacatttcttatagcattagttttgttttttttgttttttttgtttttttttttttttgagacagagtgtcgctgtgtcgcccaggctggagtgcagtggcgcgatctcggctcactgcaagctccacctcctgggttcacgccattctcctgcctcagcctccaaagtagctgggactacaggcgcccgccaccatgccccgctaattttttgtatttttagtacagatggggttttactgtgttagccaggatggtcttgatctcctgacctcgtgatccgcccgcctcagcctcccaaagtgctgggattacaggcgtgagccaccgcgcccgaccttatagcattatttttataaaaaagcagagctcatcacatgtgcaaagcaagacaatcttctgaatccacctgagacccaaacctaattactagtttattgatcctgcttgtacctctgcagtttatacttaggagacgattttcaatttaaaatgtggattctacgaaaagttaaagcactgaataagttcatcttcattttagactttattttctgccatctgcttgcttatattaacagaatgggaacacgtagaaaacaaggtgaggctgcattgaatttcaagcagttcaacatcgtcattttcaacagatactcactaatatctatatgcacacactgttgtgccaagaaaggcaaaaaataactcaaacctatcaactcctactcttttggtaaaataatggatacaaatcagttgcataaaacaacatatgtatgtaggattacacttggtccatggtactagaattaatgattagtcaatgtatttcctagtaataaaatataaataaataatcatcaaggctaagattaagagtatttcacctagtgtcagaagggttacaagtatgattttttaagtgccagtattgatataaactaagtattttgatcctgttaagagctatgcatgaaactaaaattaagtaaaattaagaattaaaaagatctaagtttatttgagaatttcccaatggttttgtttcccttttttgtgtactacattctacaaaatctgttacttatctcttctttcagaatgagggtccatggtacaatgatgagcactctaaactctgaaactctatgttgcttttaaaactgtcattgaaaaggtgcatttcaaagttcagttaagtgttaacgaatttgtacaaggctttctggattctggattgcatataattccaaacgctgagtttttaagtaaactgaagaaacaaatatatattagttataaaattatattgcaggtcaaacatccatactcatccatactcctttcttgttactaagtatttgacatttccttttttttttttttctttattgagatgaagtctcgctctatcgcccaggctggagtgcaatggcatgatctcggctcactgcaaattctgcctcctgggctcaagcaattctcctgcctcagccttcctagctggaattacaggcatttgccaacacacctggctattattattattattattattattattattaacggtgtttcattatgttgttcaggctggtttcgaactcctgacctcaagtgatctgcctgcctcagcatcccaaagtgttgggattacaggcgtgagccaccatgcccggccttgacatttccattctaaaagagttctttctcaatatatcattcatttatatggtcaaaatatcaatgaaaaaaacaaaactgactttttatagaaaacaacaaaatgagaaagcacttactcaaatatgcatgcttagacaggctgtcacattttaagaagagaacgtagaccttagtggaatttgcaaccaattatgtcccataccgtaaaactaaatttcttcttcaccaataaatgggatattgcttttggcttaggagcatttttacaaacctcatatgataaatatgcttttctttcccaaaccccaaattttcattcatagcatatacatttcattattcccttatttcatgaaacagaaaagctcacttgatcaattttaataagaataaatttatacagggcatcaggagttggagaaactaactctgcatctgctctgtcaaccaaatccacctctatggaatatgaccttaaaataaatgccaaatattcaaagagcacttaatttatatcaccacatcaaaatattttccaagtctcagttcatattttcttataaaaaaaaattgcaattggctgggcgcggtggctcatgcctgtagtcccagcagtttgggaggccgaggcgggtggatcacaaggtctggagatcgagaccatcctggccaacacggtgaaatcctgtctctactaaaaatacaaaaaattggcagggcgtggtggcgggcacctgtggtcccagctgttcgggaggctgagacaggagaatggcgtgaacctgggaggtggagcttgcagtgagctgagatcacgccactgcactccagcctaggcgacagagcaagactcgtctctaaaaaaaaaaaaaaagaaaaaaaaattgcaattattcgtttgtgatttttgtttgaatgctttcagaattatttggctcagaaacaatttcaactataattttgagaaaaatcatattttggagaagcagtcattctctttcctatcaattcatttaaagctatctttttgctatttagaaatatatattaagatatgtccagctatgttaactaaatcagtctttcactaggagttattcaaatcactgagtcaccacaatatatccagaaccaatcttaacagaattgggaaaggacaattcttaggaataaaagatgattcacaccaaatcaactaaattctgttctgatgcttttatagatatgagttttacttaaaatgaattctgtgctaatagaaaattaggggaggaaatttaaaaaaaaaaatgaagttaaatgccttaagtgggtaaaattaaaggagaagaggaaaaagtctcagctgaattctttctcccttaacccagtctcctgttcccatcccacttagactttgtacagggagattttggggtttcaacaacaatcgggggagccacaccactcattcaacaattattttggcaaccttctccgtgctacgtattggagaaacgaagatgaataatatctacaccctgaccacagggagcaagtgttcaccctacaactcgtctgtggcaaggatctgacctcgtatatatgaaaaatatctcattatggttggatgacatgaccacataaactaaagctttctcagttttcaaaacagttgagaattaacaattttagatagtcaagacattgcccgtctgttgatcagtttgagcatatgtgtttctttcttaatcatttccctgtcttatcactaaaaattccctcagtcccttctctagaaagtacagttataccagtatcatttaatactttaattaaaactatggcatataaactaattaccatgggaacaaatgatagaatagagtaatcttgtttctctattatccttcagcctaaatgtctttatgcaaattattaaacaacatcatcttggaaggtttcacactcaaatacacaggttttcagtggatttcaaggcattatgtgcagtatgatagaataaagtcagcaacagcttcaaactagattcagggattaaacctttggagagctatttttcataatttaagcgccaccagatgacaagaacaaattgttttctttctgatttttaaccatgcagtttagttatttattatctccttgaaacaaatttgcccaaatggtccatgctaatataatactgctgcttactgaaatttcaaacatcccctagcaagttgagagataaattactttagtcccacattgtctcttgggagtcaaaaattaaatctgagcaaaatagacctttccatcttaaaaatgtatattgtgagtgacagccccttgcatgccacttgctcacaaatgtgggcctctgatgaatagattatgctaaaaatctgaggcacacatgcaaagcttccccatggaactaagatgttgccaggaataaggcttaaatattgcaactgaaaattaagattttatagtcaacaattaaaatatatgacacattcaaaattcaaatagagactaacttcctgtccaatttactaattctctttcttggctatactcagctctgcacatgattcacagcctgacaagttttgggcaactgtactgtctgataaagtcacttttacaaaatattgcaatcttattgtcatttttatcactcctgagttccaaataccaagtcaattggttaaacattgtagatactcttcattaaaaataagttatgttaatgattcatgccagccaacatctacactgtttagctaaaatcatttatagctcaaattttctggaaatacatttgtagcaatttgacttagcaaccactgctattttgtccattatcaactgttgtacctgggatgagttcaaccaacagcactgtaacactgtgtgaataaaagaacttaggaacatgtatgtgtgtgtatggctgtctgtgggtgtcagtggtgaggggggatatgaatgtgagtaaatcattttcaagacagtgctccaggaaaaaaagtattttttcctgtcattatatttgtttgaagtttggaaaacatgaacatattgagaaagtatgtaatttagaagatgaaaagaaaaaataaagatggacacaagaccatctagagataagtgctaccatataactgaactgaagacgtgataaacctgcattcatattatgtgacaagagacaataagataattgatataaagtgttaagtacagtgcatggcacacaatatatgccccgtaattgttaactactttttatatatgaaaaatatcaggaatatacatccatagaatttatcaattaactttagttaatacctacttatacatgaagtaaattataattttattttcttagatcagttaggatgcaatgtgtcttttaagtgctatcttcaaagattccacatagcagagtggagaagaaataaaattactagttgttgtcatgctttttaatctgataaaccaaatgagatgatttataagaaagcctaatgcaaatggtaattaattggagtggaaggggcttatacgcatcctgtccaccaaatgtgttgctgtgctccagacctgtgtgattctgtaactctccagtctacatgtacacctccacatatcaatcatcattcattactgcctataaaaactttcaccttgtattaatctaaaagtttgcttgtccatcccaacatccaaactgcccaatcttgctggagaaaattacacaccagtaaatcaggagtttctatgttttaaaaactctaacaaacatgtagggttctttggtaaaatgtttttctattcagaaatcctatagcttttcagaaactgtttattcacccaatctaatcatgtgattctgtctggctagtaaatcacatcaccccacttatctgatgacacaaattaacaagtacctaaatatattcaaaaactgtattccatctctctatttctttgggtgtaataggtctaggagtagttacggtcataaaagctgagctggttacagcctgaatccttgaggcttccttcatctgttggcttcttggtgataggaaaaatcatttttttttcttaagctagtaagaatttggtttccaacacaatcgatagtactgatactaataccatacttcctacaatgttttcttcgaatctgattttctattactaatagtattatttgcttaaagtttaatttttatttgtagctttacaaaaatttcagtgttctagaaataactcctaaatctgtgtcctagatgctagctcctgctgattcattaagaattccatttcttcatcatcccctttttctcccctgtgtatccatcttttatttaatcacattcaggtaatttgcaaaatgcaactaagagaatttgtggaataaaaactcagatgtgttctggcatgaaatattttttcacctaaaatttaaaattctagcagaaggttaaaaaaaacatcaaagaagccaagttcaatgtttccttagctcctatataaagcattttaatatttttctaacatttctctaatgaactaaaggtcaaaaatcacctactgccaacttaatattttataagtggtatatcagtaatcattaccatttttaaaatgatggatcaatttttttacatcaactcttcactagcctttaaaattagttgcataataaaaaatcaaataactctacattttgattgcatgcttgaatatcagagttttatttaaaaagattaaagtaaaatgattttgctagcgtggttcaataatgtatggattataatgaaatcataatctgttccttctttgaattctcagcattctttcatacgaataaataagcattgagctttgtacacatgctcagcctgatttaggttagaaacctaaacacatgtgttttttgacaccctgattactaaagatgacccagtgagttaaatattctcaatgtcattttatgtattgaaaagctaagactagcaacagttaaactgagtcttcttatcctcaatcaaatacttatacctcctgtgtactgctattatgaatgcagacatgacctacatcttagagacagtgaattttatatatatataaaatataaattatataaatatataaattatataaaatatataaaataaaataaaaaataaaaatatataaattatgtaaaatataaattatatataaattgtatataatatataatttatatattatatattacacattatatattatatattatatatgtattatatatattgcatattatatattatgtaaattatatataaattacatgtataatttttatatatgtttatattttatatatataaaattcactgtatagatacagaatgtgtgtatgtatgtatattctgtatatatacagaatgtgtgtgtatatatgtgcgtatatataaaatttttacatataaaatttatatatgtaatttatatattttacatatattataaaattacatataaaaattttatatgtaaaaattttatatatatgcacatacatacatacacacacattctgtatatatattatacacaattttatatatatatacacacacatatatacctatatgtacaccctctaaatagtttacataataaaatagttaatctttgagacacattcattcactttatccattcttttaactttgtcttataatctacattaaaatataaatttaaaattattattaatttatttcgcttactggaagaacaacaaaaagctagaaaataattttggccttttgtaagcttgcttctgttacttttgccacatatcactttacatttcttcatccggtattttccgttgcataattgtaatattttagtctgcttattttttcagttgtcattatggtgcctgtaaattaaagtatcacttcataagttgtccggcatattaaccaatctacaagccaaagccatctaagaggagtggtcacatcgaaagataatagatccatgtgtctttactatgtttaataacctaactgcaaagatactcatgtactacagcccagagctgaactatcatgctggtgacacaaatggaaatacctccctagaagaaagaaacattcatgacgttcactaaaaggaactgctcatttcttctacatatatatatacgtgtgtgtgtgtgtgcgtgtgtgtgtgtgtagaagaaatgatatatatatatctttacatatacatatttatatttatatatataaagatatatatttatatatatctttacatatacatatttatatttatatatataaagatatatataaatatatatctttatatatacatatttatatttatatatatataaagatatatatctttatatctatatatatatcttttacaggtaagaagattaagctactacagtttgagtagagacaatgttctattgtgcatatactcaatgctagcagtgtctggaatgctgtatgaagtgctactgaaagggctgataaatgattaaatgaatatgataggcctatgagcaactattacaaattcggccaggcgccttgactcaggcctgtaatcccagcactctgggaggccgaggcgggtagatcacctgaggtcaggaatttgacaacagcctggccatcatggtgaaaccctgcctttactaaaatacaaaaattagttggccatggtggcacacacctgtaatcccagctacttgggaggctgaggcaggagaatcacttgatcccaggggcagaggttgcagtgagccgagtcagcaccactgctctccagcctgggtgatagcaagactcccatctcaaaaaaaaaaaaaaaaaaaaaaaaaaaaaaaaagcagctattagaaattctaataaaataacaagtacacacacacatacctgcacacatacacataattcataacagtcaaaaaaaaagtgtagagctttacaaaagctcgaataagttaaaaggtaggctactttcactctcataggaaatcaaggagaaattccaagtagactgatttcagagttcattggctcttgaacttcaaaggagatcaattcttattaaacattaagagctatatcaatttatttattcatctgataaactttaataggaatctgcctgtaagctattttggtgttccaaatgatatcaataaatatatgatttaaactctatgagaagagcaaaggtagaatatgagaaggtaaatatattattttcctcaggcaccaaatctcccagaaacctcattccagaactgaacaaacacattcataatgctgtggaacttgctttaatctcctttaatctgtaattccaatgaatctttagatataatcatctaaagcattaaaatttaatcttctaaaacatttcatttcttatgtttcttcctattgactcagacaccccacagatcttcttgactcatgatccaggtcaacagcacttgatcataatatatgatgtcttagcaagagagctgttaatttgtccaatggtaatattagcccttcctctccagattaatcattatcaactccagattattatcctactaaaacaaaatatgaggattaacactatggtcagtgaataacttagtttaaaataatctgttcaaaattggagcctcaaagaacattaggttggtaatcactacatcaatttcattcatctttcatcgggcttatagggatatgtaggataggaaataaaggtagtacagggacatttattatgtgtctattatgaaataaacattcacatatatacagtactccttgctcatccccaggagaaacatccaagacgccccagtaaaggcctgacactgcagatacagataatattaatatgtatacaaacttataaggtttaatttatatattaggcacagtaagagattaacaacaataatcaaatagaataattaactttatgctggcatcactattctgtgaaagtggtaacagctaaaacaaatatatcactgttcagctcggatagtgcattatgttcctataaggcaatagtcttaaaagcaaggcttgttaaagtagaaaggagatttgtaagtttcaaaaacagatgattttacatataagacaaaactaagaagtctaaatgatgaggcatagttagaaaaaaaaaaaaaagtcaagggatgttcctccctattagaaaaaggaatattgagaatttcctaaattgaaagagcaaaagaaaagctgaaggagagagctaaaagtgacatgtatatggactggctccagttataggtaggaaacagtgggagagcaaaggaggtgtgtttgggagaaatttgccacattttctactaggagtctggaataaagacttttcattattaagtaaaataaaggtgcatccaggaagctttctttgccagagaaaactccccagcttccctgcttcatgtcaaaattggacaaccttgttttttgtttttttggagatggagttttgctattgtcgaccagctggagtgcagtggcacaatctcggctcagtgcaacctccgcctcccaggttcaagtgattctcctgcctcagcctcccgagtagctgggattgcaggtgcctgctaccatgcccagcgaattttttatttttaaaagaggcagggtttcaccatgttggccaggctggtctcaaactcctgacctcaggggatccactcacctcagcctcccaaaatgttgggattacaggcgtgagccactacacccggctggacacccttcttaatgcctctcatagaatcttcttgtatttccccactctataaatcagagagaagagtcactacacatcactggtttgttgtattgatgaaatgggcaagtatctgggtcaaggatcggctgcattccctgcctcagtctgtgtactcagcacagcatagtgtgatcacctgcctgagccctgtgagagactacaccttagccatgtttgagctcaatgcctggcccatcacagcttagatgtcattaactactaaacaagccagcctccctcataaggttgttgaatcatctgatgaattatcttaatattccacagacaagatgttcactgactggtttttaacactgtcctaggtttggttacctagaaatagacactgagactaggatttgagcatcatttatttgggaggtgatcccaggagacaccaataggagagtagagaagtgagacaccaaggcacacaagctgtggtcaagagcaggtagacaactggggctgtttccctaggaaccctggggaggctatatagaatttcactcaaaacggtcacatccaaagaatgaggaggctcaggtagtatccacccataccaactgtcactcggagtgttcactcctgctcattctggccacctgagaaagccctcaaggccaagatgtgcagatgcttagaggaggaagctataagagtatgtgcttggccgggtgctcacacctgtaatcccagcactttgggaggccaaggcaggcggatcacaaggtcaggagatcgagaccaccctggctaatacggtaaaaccctgtctctactaaaaatacaaaaaaaaaacaaacaaacaacaaaaaaaaaaacattagctgggtgtggtggtaggcgcctgtagtcccagctactcaggaagctgaggcaggagaatggcgtgaacccgggaggcggagcttgcagtcagccgagatcgcgccactgcactccagcctgggctacagagcaagagtatgtgcgtgtctctgtgtgtgtacatgtgcgtgtgtgtgtgtgcatgtgtgtgtgcatgcactgaggagatgtgggcagggaaccaacagcatctactataggcatgcagtgagtgttttaaaatgcttactgagcacatggctaaatgcttaaacggctttaagcattgactagttagtaatgtggcttcccgaggctttggttcctcccctgtgacataaacattcagttgacaaatacggtctctagaatccttccacctttaaggtttggtgtttccactaactgctttgctttagatcaaattaaaaaaaaaaaacaaaaacaacaacaaaaaaaaacaccctagtagctgggttcatctactttttttttccccccagtaagccattattttgcttctcatgtgagcacccaacagaacttaaagagccatctctcttattctgaaaacaaagcaaagctttcccttaaaaaaaaaaaaaaaaattgaaatctctagtacatatttttgtagaagcatgtaaaactgtaaaaaagaaaaacctttgcatcattttttttctatcttgaaaggtcaagttaaggtgtattcatttattcctgaaaagtaatgactatgttccaaggatagatgtttgcaatagaaacatccacaaactaacctaaatcaacccctttgcacctaccaaatacaagctggcaatttccccattatgatataaattacctgctacagatcaattgctgctctctttcattaatataattaaatgacattcatttgtatttaactgaagtagaaatcagtgtttttatagggcatagattacagtttaaatctgtactgcttctttgtaaaaaaattttgttaacagcacaaagaaaggaaggctgttgcagaaggaaaaaaaatgaaatggcttcacacattaaagaagcacatttgaataatatataattgcttggaaacaaaaatttctaatagcttatgtttcattaccctagttttagtaactgtatttaagttatatttcaaatagctttttaaattcaaactgtttactgattcagagataacctgtctttagttaaaacatgcataattgttaaaatgttaatttctgaaagcaacaatccaaaagattctcaacaaattcaaaagactctcaacatagccctagttaaattgtattctttatttcatctcttgtccaaatttaaaagaaaaaagtaaaggagaggcaaggaaagggaattctgtggaccatgcttcattcctcaggcatattttcataggagttattttaatttcaaaatgcataattgtttagtaaatgcaatcttttcttttctttagagtagtaaatgaagatctgtatacttttccaaaaaattacagacaaagttgtaccaaggaaaggctgaatcatggcaatacagatgcactgaatgtcaaatttaaaaatctacattcttttccttggtgcaattcttagtccatggttgctaacaaatcaatctatcctaagttgttttggcttctcatttatcaattaggcaaagaattccaaattcagagcagtataaatgaagaaatttggatggtttttaaataagaaattgaggtaaaaagaagataaactgaatagctaaagaactaaataaaactacttcagtcataagaggctggtgtcacttcggtggagagcaaaaatactgcagagaagctgagccaattacagagttgtctacattttcaactgtgattccagatgtgttatggaacaaaggaacacatcaacatactcatcttttgatcatattaacttctttctagcacgtaagaaactcagtatgaaaaatattttacatttaaagaatcaagcaatttcaaagttaatatccaggtgagaagaataaagagaatgtattagcacctaattaacctttacagacacaattccctctctacaaaactagaaggaggtattttttcctccaacatgttgtatatttttgtccactttcatggactgtttagtaaaaacatagcagatctagaaacacataagaagaacaagtgaactgaaagcagatcaagtgagattatatctaagctttatattccaaagttaaatgtatcaaactatatatttacagaggacaagctaatcctaaaaatgattaatcaatgcttataagtattaatataataatatgccttccatttaccatcatgtaaatgatatgaaaaccacatttatattaatataattcgcctattgtctagaaattgtttagagactgcccccccaccccccaaaaataaattagatcttaatatacaaagttgagctcaggctaagaattttcttaaaaccttaagaaaaggttaatacttgagaaaaggtaaaaccttgagaaaatattaatactaataggtttatcaggaaaaatacaggacatccaattaaatttgattagatgatgaattctttctagtaaaagtatgttccaaagttctacaaaaggtatagttacttgaaattcaaatgtaactgggaatcctgtgtttttctgtactaaatctggcaactttcatttatgagatagtattatatcatttatatggattttacattatttctgataaattttaaaattcaatattgttgcagaaattggggagggggagaatgctacatcactaaacactagctttgaaattaagtcaggaacatgatcttaaaggaatgacatcaaaattgcaaacagccccagtccttagaaaatgtaattacccagaaaggccaaggtgtatttctgtttttcaaaactggagtaactctttagttaaatgcattatatgtttcgatggttacttccaattttacatatagaagaattattgggcattgttcatttaatttctcattttgaaacatactaaggcaatatcaaaatggctgcattggtaatttagtaatttattaactttcgagaacattcataagagggaaacatggctgtaatatctgccatcccactgatcacctaagctgatttctgtgaactgatcagccaggcagtaacattcaaagtagattgtgcaatccttctaaacttgcacactagatcaaatgaaattactttcagacaggcactattcttaatgtcaaaggtatatgaaaggctgagaccttggcaaaacctacaaactcagcattttaagtgatccttaaataactgttttcctttttgaagttttcttgccaccagttattctgttgagatgaccaggagcctagctctctcaggaattaatgaagaattaaaactgagataaaaaaatctggacactaaaagcaaactagttatatataaacaaaacaggaaacttgaaagaactaggtggcagattatatatgattaataaaatattttttagatcttatttctaataagtttaatcattacaaactcaaattcaaatttccattaagtagaagacaaatgcccaattgcacaatctaaagttgctcatggaaacatttttctccagtcttcatttaaaagacccttggatctaaagtggtatctaaaattgacaaattatgtaatagaatctctaactatataatataaatttatttgtgacaatcatcatgactacgaattccaatgccttaaagcttttaactatagcttcgtatgactacttcttgatgtttaattgaccagtcattgatttataactggattatgtatagggataaagaaaattgttttaaaatgttctgatgaaaagttgtcaaattcctccctccacccaccaaaccttaccaagcatcattgttctaagatatacaattctacccttagagcaaactataaaaaaaaaacacccattgaacagcacagttaaaaataaatatttcaatgataatagttttaaagaaaaacacttaggaggaagaaaaagataactgttgcagagcttgtaatcctgtaattaagcattaaatcttgtgttaagcttcttgacagactgggagaaaaggaaatcatgatcactagcatgattctctgtatgtgatgaaaaggataaatgagattttttgccatgagcaataagcttctgcttataaccaaagcctgtaggaccgtgaaaaacataatgtgtgtagttctcaacaaacagaaaaagatgcttcacataacgtctgtgtgtctcaccctgccccatatatctgcatatgtaatgattatctatatttgtataaaaagcagacaatagtctaatatcacttttaattttttaaatatttgtcagcagaacgctcaaatgcttcaagaagtatgtgagttttgtacgtgtacagagaacaaagaacctgagataactggcactcaagtttccttccattagtagaaaggtatggtatgtactgttctcactcctaagtgggagttgaacacatggacacaggaaggggaacaacacacaccagggcctgttgtgtggtgggggacaaggggagggaacttagaggactggtcaataggtgcagcaaaccactatgacacatgtatacctaagtaaaaaacctacgcattctttacatgtatccttgagcttaaatttaaaaaaagatatggtatgcacacaaaaaatacatgctcacgtaaatattgaagaagagtattgtactgaaattaaagaggtataaaatttgattcagaaactgaatgccatattctgttttcagattgtataaatctttgccttttataaaaaatgaacactagttggtctttgtagagtcatttctagtaaaacaaggtataagcaataatgataatgtggtatctatccatttattgattcaatatgaaaactatctgatatggtttggatctacgtccccacccaagtctcctgtcaaattgtaatcctcagtgttggagatggggcctggtgagaggtgactggatcatggggcagtttcttatgaatggttcagcaccatctccttggtgctgtactcatgagagtgagttctcaggagaactggttgtgtaaagtgtgtggcacctccctcctcccctttctgtcttgctcctgctcccaccacaggagatgccttgctcccccttgccttctgccgtgatagtaactttccagaggtctccctagaaaccaaacagatgtcagcattatgcttgctgtacagcctatggaaccataagccagttaaacctattttctttttaaattatccagtatcaggtatttctttatagcaatgcaagaaccgactaatagaccatttcatacagtactcaccacaaatattaaaaagatatacattattacaatttgcagatgaggaaactgatgttcaggtaggtaagccaatgtctcaaagtaagtatgtaccaaaaaagaaatctgaatccaggtctatcaaccacaaatgctcaagttacttcctctagagcaaatttacattttcatttactaatataacactacaaatataccatacatttttttgtgtaaataaatatatttataaacaagcatatctaactataagaataataaatcctaactctctcaacttctgtatgaaaaggttccctcctggagcttcccaggtggtattttttgctattagcaaacagaaaattggttcatcaaagctagatttgactctaaagtggtctctgcttccgcaaatctccctactactagccaaccaaagcataatgctgatgacattttaaaaaatgacaaagagtgaaaaggtgcagaatataagatgtcatcagcatgaagaaagagtataaaaattactgtcttaattactgtgtattttgcaaagagcagctgaaacagacaactacaagttgaggaaaaacacagtcaagtagtcagtaaaataatactaagaaatatatcctgcatactagtcaatgtattcactttgatacttttaatagtcacacattgatatttttacttaccctctcacctaattcttgtaacactcaatttactaaaaattaaaaagtgggtttagaattacaaatgaatttttatatcaccataagatttggtgttagcatataaggtctaaaatatttgtacctgaaatgtaattacataatatttaatggcatacttttaaaaaataattttaaatgaaatatgttggtataccatgtgattaacttaattttccatgcttttactttaattcagaaaatcttgcttttaaatttagttacaatcagtgtcatcatggctatttagttacttgttttgttgacttctctttactctagctttctatttacttttggtatcagttatcccagcaggaagccctttataacccagctgtgggccacaaatacggctccaagggagcctgaaagcagttaaactactgctatagatcagtcttttccaagggagaacgtgataaatcaatcttgaagcaactcaaatagttctctctgtgtaatcaacttttgctctacattcgcaagtaatatattgttagtccacttatttttaaaaaagaaaattatatatcctccccattttatttgactgtatatctttaaaagtatataaataagaactataattttagtataatagtaaataaatttattttcttttaataagagagatcaatgtgcataatatcaagtataatcaagatattaaacgtttttttaaatctttttctttgtgaacaagtaaattgaaatgaaaagctgagtagatttaactttttcttgagttaaatgtggttgaactttttctcaaaggcccctgtttataaatgcattattaatctgtcatgaaagttgcttaaatgttttagtttccacattaccaaactgactagcatcaacataattaagtaaatttcctatcaaaccacacaatagatgttttatattctttgaaataaaaatattttgatgaatttaatttgctcaacaagtagccttgaatcttacatcttctaaaggaatgtaaagctgttggaggatacggctccatggctctctcagccatagctatgaattatggtacaattgcctgtctttctaaattcacaaagcttgcaacatggccaagcaatgcttttgtagctagaccttggcttttcttgtcatgctgtttttactgtgagtcaacagagcatggctcaagataatttataatcatcaatgaaatatccttgacattttcagaatactgtgaaaagaaacaaaatcaagtaggccatataaagcccctacaccagagaatcccatgatctaaatttctacaacgttctcttcatgcttatcctgtgggcagtttgatgaaaatggcttataatgtgattttattgatatgtggatcaaaattattcatgtctttttccaccatatccatgtattccaccatttcccattgccaccacaaataaagacttgtgagacagaagaaacttcgaggattaaaatccaggttattaaatttatgaatcagaacgtcagagaaaaccttgtaaaaatagagacaattctgggaagcctcaggatcaacatctatgatactaaaataacagaaacaccaatactctttgtcaggtcattccattccctcctagccaaagaagcaggcttacgttatcttgaatatatgatctagtcattttcagcataggactttgaaaaaagaatttagcaatagggccacacagatagtttaaatttattacaactttcattctgtaatctaccctctcctgagtgtaactaatgctctttgtttcaaaacccaaaatgctcagaacataaatacctcagattttcaaataaaagtatgaaaagataaaatgtattagatttcaccaattgttgagttctaaggtaacaaactccaacatttatagaaacactaagattgcagtaatgatttcaggacatttctagagcttaaaagtcatgctgaataaacatatatgtttacatatatatattcagcatagctgaatatatatacacatacaaatgtttacatatgaaaacatgttttcagcatgctgaatatatgtaaacatatctattttgataaactggatatttatcagaatgaataaattggatattcatttgagaaattatattcttgctttgtacaaacatatgtaaactatatatataatgtttataatatatgtttccatatatttgcataaagcaagaatacaatttatcaaaatggatatttttattctgtactgccctccttacttaatagttcatatgtattcactttgcaaagctttaaaattatgttccaatagggaattagcacttttgctaacacaatcagtctcaatgaaatgtattggcaatgtgtatgtgaaatgtgtttgataatgacaggttgctatataccttgcagattccactacaaagcaaacaggggaaatggaaaccaagttaaaaaaaaaaagaaagtaaatttgattgccaataaaagttgagttatgtttgtttagctcacatgggaatatcagtttgtaaacaatgtgacattactcattgtcctttatttaagcctgagtctactcaaaagcctcagtgaagtcttaggtgaataatttcaattaagtatcaaaataacttgtgctactggaaacaatattagtcctattttattgatgaggaaactgtggcttagaggttaaataattggctgaaagttacacaatggaaaaatgactaaatttctgtcatcttggctggaggtcctacttattagaatatgttacttctacacatgatagttttgatacttacttcatggctcaaaaaataagatagactttatgttaaacagcaaatatcctatttaatagagtcagatgcacagtaaattctatgttgtataatcaatatatctcatgtgcaaatggtaactttagggtatctgtttaaatatcagagtattttctgctctctgtattgctgtactggtttacatcatattttcttttcttcatattttctaataacttaagaccagaatttagaatagctagcaggtatctaggggataatcagatgctgcatatattttcaggaacacttatgttgacattgcctattttggctttgaagtacaagctaattgtactacctgcagctttctactttttcctaataacttctagctaaaagtatgaaacaaaataaatcccagtaagaaagcaaaaatggtaatcatcaaattgcaagacaaaccatgacttaatcctttttaccctaagtcttatcaactgcttgaatgctaaaaaaactgactggaatgtttgaaaggaagcacactttgtaagatatttgagactattcatcaagtttccaagctacctcagcatcttctccttttaatcttccctatattccatcaaatcactagcttattcagagattcaggaatccgtccatatccatatttttcaaaaggtgaaagaagaaaaactaaccaaacacatgagatcctaaaataaaaggaataatacccattattcttcagtctcagataaattacagatctgttcttcaaaatggtgatgagagatctccccaaaaagtgaaagaaaataaaagataaaggggttcagaatctgatgttatgaaccgatataagttgacaaggaagttgccagaaaacagagaaaaaaatcaggtgaaaataagaatggagaagaaagacatgtacacagccaaagcacagatgcatatgaaaaggacattattagtgacaggctttaggaaatcatgcaaaatgaaatgttaaaaaaaagactgtaataaagagaaaataccagttatagaaaacagaaaatgtagctcaattaacgtgatgttcctgatgaagagagaacatacacacactctcaaaaatatgcagaaacattatatctctgaaataaaattaaaactttaatataaagacaccaaacaatcaaaaataagatgtacaagatgtattattcctacttcaatctcaagaatgaagaatgtatcattcggaaaccagtgggaaaaaaatcagttcaatataggaggagtctatgaactggaaacagactgatttcagacttcctactagcctctatgaatgacaaaagacagtgaagcaatgtcccaaaattttgaggaaaataatacataattagccagggcaaccttcaagtccaaaatgaaaaggccagatattcttaatcatacaacaactcagattagagcattctaccacctccttggtcaacatacttaacaaaatccaatcaaattatgaaattaaaaagaaaaaaattaaaaaagaaataaagtaatgaaggggctatcataaaagtattgctgataaaatttaatccatcaaaatataaaatcagtattaaatactgtcagaatttttattattatagaacataagacaaaccttaatgtaaaagtaataatttaataagatttgggagatatgtggaaggtgagaagaaatgctccattacctaggctggagtgctgtagcacaatcactgctcacgcctcccaagtagctgggactacaggtgtgtgccaccatgcccagataattttttaattgtagaccttgtagagacaaggtctccttacgtggcccaggctaatcttgaaatcctgggctcaagtgatcctcatgccttggcctcccaagtgctgggattatgggcagaagccaccacacctggcattttctactattttataaaattgtttcttaattccaagaaaaaaatctcatcattctcttctatttaactgactaaaaatcttatttgcctatgtgtatgctgggtcactattgtagggaaaaaatatcttttcatcccattttaggttccatagctgagactcctataataagagtttaacaatagaaaagctatacatttacttaatatatgttttatgtgacacgagagccttcataaggaaatgaagacccaaagaaacagggcaccttgtgtattttttatgctaggtttgatgggcaagtagatagttgtggaaaagtctgattggattaaaaaagcttcatctgatggagataagctgggggaaactcagcaagacctgtttgttgagatttttctttgtatccctgtatcttcagagatgaggatgttcctttccttcctttctctgagggttttatggcttcaggaaagaaagacatgagggaaggtcaaagagacctccctgcccccatggttttctttgattccttcagcttaaaatattttggggtagcatgtactgaacctcattattagaattctataaaacaattttgtggataccaaagaatagtggagtggattccgattcataatttgattaataatctcaagattatgctgcctgcaggatatgaatgttttctggggaaaaatgttgttagtggagatgaagagaaatgaatgcttgcttggtaaattttggagttggaattgacaaaatttgcagattaactacatgtggagttatggcagagaaaggaattaagattactcctgaatttgagctatattaactggaggagaaagtgatcctttgagatgcaaaacttaacagaagatcaggatgctgatggagaaaagtaatagaaataatagttcacttgcgaatgttagtcttgacatgccagtgagacaggtaaatgaaaacagcaagcatgtcatcggataaatgagcctaaagctcagaaaagaggtttgggtgttattacatgtaaatccaacaatatggatcaagtgtccttggaggaatatgggcattaaagatgagagggcaaagactgtgccctaaatttagacaacattaaagacacagaggtactgtaaaggaaaaggtaccaataaagactgaaaaggaatgggtagtgaaaagtaggaaatcagggaaagtgaggtttcctgataactaaagaagtgtttgaagaaaggaaatacagtaagtggtgcactaaaatgatgaaaagacatgaagtgtgaagataaatagaacatgctcattcgatttgatgacatagaggtagttgttaactacaaagaagagcttcaccatagatgaaatttaaagtcaaattggagtgggctggccagtgagtaaaggtgaaaatgtgaaaaatgcagaggtccacataacttttggaggtttgcagtataaaacagcaaagaaatgtggcagagctagaaggggtaatagacttttttttttctttaatgttggaagatactggagctagtatgtatgtggatgaaaagataaagtgaaaaaactttttgattaacgaaagagaagatagcataagaaagaaatccacggctaggctggtttggaaggttgtaagttgatgagactatccacagaaggcatgagctttaaaggaggaggtcattttgcacagcaggggagagctggtcattcctttcaattcctatagcatttctttaatatgtaaacaaatccagtacagacatccagctacaaacttcttaagaacttgaagaaaaatgtagatgaatattctttagtatttcttcttttttaagagactttaagtttaaatgacagatctctcaaaagcatcttctttctacttagagacatcttttctgactaagcttctggttgcaatatccactctctcaaccccaatccagacccttttcagtactctggacaaatattatctctccattgaaaccagtctactaagccctcagtccccggggtcagctttcctgggtagctcccaatgtcaaaatgtattccactagtgactgcaccccatgcctatattaatcatctgtgccttgtactttgcttccttattttaaagcttcaattttcactgtagtgtcagccctttaggaagaaaactctcaggccaggccttcgagtcctggaacatttcctctttcccacagtaatattaacatagccattaatatatctataactccaccaaattgaaattattccagcatctgatgttattcttcatacaaaaattatctctgggaatacagtgatttccctagggttctgttctgaaggattgacaataaatggaaatatatattagtctccacattttccaacttctttgaagaaatacatctgaagggagatagtacctctatattaaaattatcatttttaaagactttccaaaattttaggcatatttgtataaattatctcatttaatttaaaaacaactttttggagacatgaaagtatatagcaataggtcccctctaggctaaacctgaatgataacaatatatgtttggagatggcaagttatcaggaatgtcttttcatgcattcagttcctggaggtcaattgattatcatttcctaaagaaggagaaatacatggacaagaatgcatacagacattgagaagatgagggtaaagtaagaaataaagacacacaaagaaaggcacttctgcctttagagagagaatgattaaataaatgatgaatgagccgttttcttcagaactttgtgacacaggtagtatgagaaagagcttcaggtctcttattaaaaaccttttgggttggaaataggggcactcaccccatttttgcatagagcacattgaatccagctcaaagacttcacactttgggatgttgcaatggcaaacatagtacaacagtaataggagctggcagatgctcactagactaggcaaatatccatcaagagactgtgccaacttgcttgtgaacacctgagacaaaccctggggtttctagaaatatcatccttggaagagagatagtactcatagaagcagagaaagacaattatcaagcatcttgcagtaataattatgctgctggagatcacagagccaagagtttttagattaaaaaaattaatattcaaataggctattattttgctaaaagtgcacagcaagttgttggcagacctaaaatctgaagtagatttgcacaactccaagactgaggcgccatgactataccaaagctgtgtacagatatattcagacatgtaaaagtgcagttcaaattttcattatctccacagtaatattgtcaataatgcttacaagcaaaaacagatatcctaatactacaagtaattattttttaattaaaaaattgtatataggccactctggcatatattggactagactatggttttcttagtaatgcattagccacggttttatccccaagaagtttatattttagcagttaaaagtgaagaaaggaaaactacacagtgagctatacttgaattaaacatatattgggcattggggagcatataaaacagaaataacattgttagacaaaaaatctaacattggttgatcaaaaatatgaagaaattggagaaagaagaaatttctaggcagagattatcaaaaggtctgaaagtgaagaaaagaatactgttctagggaaatgtccagtcatttactctgctttgagcttagaatttcaggacaggagtaatagctgctggagagattatgcaatacaaaatttaggaaaggctagatggggccaggtcataaagggcttagtataccctaaatatatgctattaataaatggagagtcactgaagatttttgaacaaggatatgaaatggatggaaatacgtatatggagtaaatcttcttagattatgcattaaatgaaaattgcagtaatttgtaatgcttatgtatttttttcttaatttttttattttgcagttcagaaatacagtacactcccattttaatgcaaataagcagtatacaacaattttaataaaatgtagctcaagttacggagaggctaatgaaattggagttcaaaaaccctcttttgacagctgcaattcggtaccagctggtggcagtaatctactccagactaaacatcaatgaggatgattcagctctgcatggctgaaatttttaggacattggcagcaatcccaggaatctcccaataatttagcactattttcatcatctcaatcccaggatattgaagcagcggattggtcctgaaaatatagagaaccaccttctacctccccatttcctaagccaagggtgtttgtcctcttttaacttttccctcctttcctgagaggagagggaaggaagagaaagaaggaaatttacccagcctcatttatatctacatgtactttatcacaggacatatcatcatgatgtctgactgcaggggcttccactgtactatcacgtactattgtcattttggctttaatagaaatggaaagtgaggtcagtaaaatcattagaaaatattaaaaattgttaactgtgaaaccagtgtttttgactaggtaattaatgattaaatattttgcttcttttcaatataaaaaacaaaagagataggttatcacccagcataactaacaatttaaagcccatggttaatattttttatgctggtgttgtaatactcttaccatggcatttatacgtatgcatgaacaacaacagtaaggcacacaaatacgcctgactcctttacattacattggttttccagaattttggagtaaatgagctttgcattatggcttttaatctatctttatgatgaagataaagtctcaagactcttaaaaagccgtaacaaaaaattgtttccctacatagcagaaatgttgcaaaaacattaaaatatgcaagctcttgatttcaagagtgtttcaaccaaaggtggaaactaagaaagactaaataaagccagagcctaaaatcattttggtgatctattaaaattcacttatttattcattaagacaatgctacgctctcactttttatccctaaaagtcagttctttcaatatccaagacctcataccaagtgactgtctgtcttcgattctaagtaaaacaaatacagtgtgttttcccattccacatattcaaaaatgtttctgctacaatcaataaaaacgatgcaatttcatgaaatgaataaggatagatgaaatgattaaatacataatgccggtgcctattagtttaactcgcataaacacaaaatttaaaatatcaacatttcaaaatatgatttggcaaagtaattttaatattataaaattaaagctataactggagaactaaattagcctgacggacactcaataacgtacaacttcactagaaacattttcaccttctaatttactttgtgaagctgaagctaaaagggactcttcaaatgttttatttaccggccaatttctagacgtctgtactctgcctgcacagtaacaagctggtgctaataagccatacataaagatcctacttattaaaatacaaattagacaccccttatgtttatacatgtgtaagtacaattaatattgcaagcttccttggaaacaaaattgctttagttaaccaaccattgcaatgcaatcaaatgagatttgaaatgcaattggaaaagatctgtttggtagaaatagcaattatttcatgcagaacaattagctttccaagctcttttttgcttctcccacctgcccttaatagaataatttgtccatcataagtgacatgaaatgtcacctttaacacccataaattgtatggagacctagcaggcagctggtagacatagcttatttacaaatattagtttgaacttgtaaatgcatgaccacataaatcttaatccatttagggtgtacgccctttgttccctcaattgtgtattcagttgggaattgaatggagctgagagagagtgtgaattgcataagtcctttgttgttgccagcatattagtgctttgccttttgttcttgttgttcatgagatttctctacattacacagtagggaaggttaatcaacattttgcctaagtaatattaatgaaacttgcctacttacacttgagggaagaatcagaatattacattgctctttgaaatgttaatgtaccttttaggaaattatgtctgccttctaaatcatcttagtgttaaattattaaaggatggcattaaagaaatattgcacagatgcacattgttaaataccttaaaagataaaagaattataaagtttaaaagaaggaccttttgaaagatgataaaatttatcttcaaattaaccatttttaaatgtttggttaaaatattgagaaaatttacaattgttttgtgtgctttcacaaaacaagagatttaatgttaatgatttataagtttcaaccacgaatttgaactgtattctgctctggtcttgaaggatttatttaaccttgctgtatctgtgcactaaagcaccacctagtttattaggaacaaaaaaaaagctgagaggaatgtattatttttgtactttttacttatttgagtcttaagattagatagtcttcattgaggttctattctccaagcacaaaaacgaccactatctaaaccttctatcactctatggcatttcaaagggaagggctatcataaagactatgtatggctgccaaggttagatatgggaaatagcaattctcaatgtgcaaactgtgacagacctgtgtcctgtcaacatcattcacggtccttcaggaaggatgctcaggaaatgagttgacaggactctaagtggtctaacttgttttccctttaacagtctcttttgatgtcaatcagtatgtcaacaggccctaaataaattgtgaggtaaccaagggggaaattaggaacagaatttcttcaagaattctcccacatggtgaccaccatttgctaagaattcctaatacttactgggcaaataattcattttctatttcaccatagaagatttagtaatggcttttgtattattgtgggactgatttgtcctcttgcacaatgtttttttagcagtactgctacttggatagaggcaccaaaaaagtagaaaataagggttacatttcaagataatttttttcactttttgacatctctaagaatacagcatacaattgctgatgcatcataatttaagtggcttttttggtgggggcttgggggagatgaggtctctctctgttgcccaggctggagtagtacagtgtcatgatcttggctcactgcaccctccacctcccaggttcaagtgattctcctgcctcagcctaccaagtagctgggattacaggcatgcaccaccacgcacagctaatttttgtatttttagtggagatagggtttctccatgttgacaaggctggttttgaacttctggcctaaagtaatccacccaccttggcctcccaaagtgctgggattacaggtgtaagccaccatgcccggccaagtggctttttcttagaaataactaaaataaatagaatgactaagtgccttacaattgatgatttacattcaataaaatatggtaatagcaaacttgaatttagagtttttgtattgtgtttgtgttgtggttacccattacctcaatatagaaaacaaaataattgccaaatgttagtgttaatgagcccaatattaaagagttcacaatgtctaggaaatgaaaccttatgtctagaaattaataaataatagttaaatgaaacaacaatgatataggcattactacaaccctacttgccaagttatttttttccacattattgctctttagaaaagtgaaaacaacatacaactaataaatgactacttaaaatactaccaaatgaatttaaggcaaagaaaaagggtgctttgaacagggaatgtataatctatatatttcagaggctgagtttgtgtgtctgttttgagttctccgaattactgaagattcaaactaaaacagcaccaagggtattatatctatgctaggcagaatacatgatctagccatacatctattatgactttacactgcttttaccatgcacgctttatgttgtgggacataagggaagagtaatttatatttaatgttgttaatcaaacatatatttagctagatttgttttgctgctttttccctatttgcaaaaacaaaaaaaatcgtttttatctaaaagcaactaagtatattgtaagcctcttcattcactagatgagcttacagtttgctcgatgctctaggagcttatgtttttagcttaatcattgattttttccttaatatatcatggatagcaaattgatctttattaacctgtgtatgataaaggttgtagacaaagccaatacctacataatattaataccaatcaagttaagtgatatgatcagttcagtagagaatcaaacaaactggcagttgtcaaatagagtctctcattagtagactgtttaaaatatataaataagtgataaacagtaaaaataaataatatcacaagtatcaagaatggaagactattatatacatgaattaaatatcatttagtgcattttcctttgatattcaacataatcatagaaacacaaagaagtgctaattcttaaacctcagtttagtgtctactgaagcacaactacataccttcaaatttgagacttttgctttgcaaagagtacaattaagctgtcgctcacattctaaacctattttaaatgtgggaaggtagagggcagttgtttacatccccaaaatgagttgtctggaagttttctgtgatcagaaattataaagattttctttcactacaactgtaatcactcaagtatgtaacagaagtactttctgattattaaggaatttttttttttttactgtgccccttggctataagaggatagataaatgatagatatgcagaccttaccacaaggagaatttctgctatttctataaactagtaactcttagttcataaaacaagtttattaagaaaaaaaaaacatgcaaccgctaatgtcagctgacatttctcaaagtaggccagagtagaagagagattacttctagctaaagtgaagcaaattaaattttaagaagttgaatatattcattctcactttcatcatattgcccaccatcaaggtgattataatatgtatactgcttcttacaaactcaaagtagttaaaagcaactttttccaacttgtatattcataatatcgacaaaaattattcagatattaaaatttaatgctatttttaatgtattttataaataatgtacctttaattatgggagaacatttcaagggttttaaagggttttttggtttttgtttttttttggtaatatggaacataaagtacattttggctaacttaattggccctgattacccaaaagcaatttatttaaaaagcaacaagtatgattatttttaatcccacaacatcataagattccatcattaaaatatattttaatatgcatgtaattatccatacacaatatgtcaagctatttaaatcaagtagttaaaaggggttcttactgcaaaatcttctctccactggtgagctgcttgaactttctccgcttccaatgccaggcgctgaaaaacaaacaataaatcttagaattcaaatgaacacgtaatatggaattgttatataaaatgcttgcgctttctaatcaattttgaggacataaaaagcagaagatgatccttatttatgattcataaattctaaatcatttagtaatctaacctactaaagttgatgtttgtatatttactcttcagcaatataaataatatactattcttgaataccattaagtttgttacctctgccatcatcagctatagtgtcctctatgagtgctttctttcaatgactaatacttcagtttttagaaaaacacttaagtatactaattttcatagaatcttatttttagtaaatacctttggagcatacatttctcttaaaaaatgacattgagagattaatatgcactaaacaatatactaggcaccttcttaaatgcatattgagtttttaccaaaagccacaaaagctgaaataacttcccctttgatgaagtacatctttagtagttctttcagcgataatctttgatagaggatttgtgcatcttaaaattgctttatttcaccttcaatcgtgtatgctaaagtagttaagaattataagccaatttattttcctatagcactttcgaaatgctattccattaagttcagtgggagatgacattgctagtgtcagcctgccaatcactttttataaacttttttttcccctattccaatagcttttagacttttctctttgtatttttcaacttcactatgatgttctccatgtgataggctttcataagacagtgacatttaatggttaggaacacagagttggggacccgactgcctagatttgaatatcagcccttgcaaactactagctgtgcaaccttgggaaaagttaagactcttctcccattctctcatgtgagtaatgtgaaagcctgcctcatggcttattggaaggactaaatgagttacaaagtgcttagaacagtgcctggcacaaactaaacaatatatatgtcaactatcaacttcaaagagtaatggttctgttttctccctggatcccctagagaaaatagtgcagtgttgagtttatttgtggtttgccttatgcagctagaagatagtgataaaactgagcaaacagaaaagtaaatataataaatatactaaactcacttattaaggtatagaaattatcaggttaggtttaaaaaattacaaatctcagagtcatttattgattcatgctgtttgtgatctatgaactattccttagcgtaagttcttcctgtggaggtccagtctacactggataaacatccttctagaccagtttttatattaatgtattggcttctatccctgtgattataatctattcatttttctaagctgttgcataggttttatcagtgactctataatattgcctagtgggagatctcaatttaagagtcccaaagctaaatttaagtgaaaatctatcatagtgtgccaaaaggacaatggttttgtttttcactactaggtagaaatggagtatataagaagctaggaaatgttagaaattgtaccacatagagtaaccaaaaggcggctccctctccctacaaaaacaaaaaactaagcagcaaagccaaaagacaagcatatacatttcaggaacactgcatcataatacttttagaaactcaacttcacatgaaaaatgaagcaaaacatgaataaaatggcaaaaggaatggaaatggaagcaactcttctatagaaacacttcagtatgggaagataaggaaagagaagatagaatgagaaaataagcatgaaggctttttctttttttctttgttttgatatagggtctcactctgtctcccagcctggagtacagtggtgcaatcatagctccctgcagccttgacctcctgggctcaagtgatcctcccacttcagcctcctaagtagctgggactacaggtttgcatcaagaaacccggcttttttttttttttttttttttttggtaaagatggggtctcaaactcctagcctcaaattatcctcctatctcagcctcccaaagtgctggtattacacacatgagccatcctgcccggccaaagacatgcccttgacaaaatttgcaatgtaaatcttcccccatttaaaaaaaaaaaaaagcagtataataatagtaactaaacttttacatgtatgggcaaaaaaaaaattctggaacttaaacaaaattctgaataaaatactaaacctttttagattaagaaacattagaactctaagatgtctttgtgtcttagagaagaatattaagttttttcttcagaatacacaggaagatgctgtttcagcaaacaaaacacactagtgagcattcacccacagggctatgcagtttccaaggtaccagctgttaactctaccagatctttcctccttgggagtgcatgagaaagtgcaattcaactgatctgacccagaatcacgtggcttatgacatgaacataatccatgtttagtaagttatagtgacagtaatcatcacagttaactatttccagagaaacagaataacagtggcaacaaactataacacaattccctaggaggaagatagtccaaatcggctttatttatatgtattttgaacactaattttataaagtaaatgccctgtattgcaagactctgaaaatgtttttagaaaaataaaggcatgaagttatgtataccaaagaagttatgtattttaaaaggctggtctgaagcttgaaagttgctaaatttcatatccccaggttggaattttagaaatatataatcatgaaaactctactcctgttaatttctttgttcatgaagaaattaataaatatttttacctagcaaatttcatgacaaagcatataatactaaactttagagacttagtctatctcgggactagagtcaacagtcactgggtggtgctacaaaccagccggtcattacttatagaaaaccgacatgtcttctagacactttaagcctttaattcacttctgttttggtcaaatgacattttatttttaaagctaatgagctaccattaaatggcaccggtgaattgtgttaaggctgtcaaaggccaggcacatggctcatgcctgtaatcccaatactttgggaaggggaggtggggaaaatctcttgaggccaggagttcaagaccagcctgggcagcatagtgagatcctgtctctaaaaaaataacacaattagccaggcatggtggcacatgcctatcatcccagctactcagggggctgaggcaggagggtcacttgaatccaggagttcaaagttacagtgatctatgatggtaccactgcactgcagcctgagctatagtgcaagaccctgtctcaaaaaaaaaaaaaaaaaaaaaaaaaagacacaaaatacccaataaaatgtgagtatctgctcaacagaacatccctgtttccatagttggctatataagtatatcctgtaacaataacttacttcagaaaaaaaaaaataaaaaacagaacacttttctgatttatggcacagcataatatagtatcagaccttaaaaccagactgagcaccacacagaaataaaaaacctggattacaatgaatacctatgagaaaaatttgaagcttaattctgctaatattacgatattcagcaaggtttattaaatggctttattgtaactgagataccacatgtatatatgaaaatcctttggatatcaaataagtatttataaaaagtaatagatgtgttaagaatgtatacatccctacctacttattggtttgaacatttaaaatagaaaatcactataaaggttttaaggacttacaactataacaaaatagacttgaccccagactttctgactccaaagcttatgctccttccacaagaccattctttagattcctataaaactcatcagagtatatatgaagacagagtaatatcaaaaccaaaacactagaattcaattttaggttaataaaaaaatccccagcaaggttttagaaattactaaaaaatgaaaaacaaagccagcagcaacaacaaaaatcatattttagttgggaaccatctttacaggtcttgtcctcaaatcctgggagattattgctaatcagtaaaaacgcttttgctatgcagtggtctgcagggagaaggatagagaatgaagaggttttatcagatcacagaaagatcagctcccttgaaagtctattcattctcaacctttactttttgtcatatcttcatcttttccattagcgttgaattctgtcaggtgatataaacttctataaaagcagtattatacagtatataaagatataattctactatcctaatcaatatccacatatatttttccaaaaaaaagactattttccaaacatgtaagtaacttgcttcctagattgcaaatttattgcaagttaaagataaaatttgctttctgaaattatgagaaattttcttttgatagctttaaaaaaaaatcatcagggatcatataacagttcagttacactcccataatgttggtactcttgtttatatacaaagatttgacttacagacaccatttaaacaaatatcactaaatttcaaaacaatttcttcagctaatgtaagtcaagattttcctttttaataaaaggtaatagagatctacaacagctaatccaaataaaatatgcatgtgttatgtgattaatcttcaaacagttaacacccaataaagattagcaaattcttgtattatacctatgttgacaattcaattatcactctaggagtttcacctactatcttcatcaaacggttcttagcatatcaaaaggatcaggataatcatttgaattttctaacaatacctactgaaaatagcagacttaggtgaataaacagacttcaatgttcgaaagaaaagcctacagatacaatcaattactttggatctatggtacaatgaacatgcactggtaaatcagacagatctggtttccaattctggtgctgcttttcactaacaacaaaattttggtaataaagctaacaattttgcatctaggattttcttaaccttacattttctacttggcattctacatatctagcataatacaaactcagtaaagttttgcttccgtttgaacctgacaaacatgaacccgtagaataggctatgtcagaactataatcaccaatgacctcttcaacacgtacatatgagcgaaataaatgaaaaaaaatcttagtagaccttaagttttcactgtattttaccctgcaggaaagctctggtctataaaaccatagggtaaccaaaagcatatgcaattcagggaatacaacagctcagttcagtaaaataagttcaattttattttatttttaccacaaatagaataagaaagcagagaagatcattgtgttctgcctgtgacaccttattttttctgaagggcagagaagggtataggcaaggtgtgacatttcttcagcatttcttatgctgataggaagtcttgaagacctcaacagacataacagcataatacttccatgaatattgagtataatattccatctcaaaggtaaaatgttctttttccaataaccttaactagataatgggaaacaatgcagctgaaattcatataaacatgtatgttcagcagaattctaccaaaggcttctaacaatttgttatatcctagtgaacaaggattttactaggaaaatcttcatgtgcagagaaattgctctgtatgtttaaatcacatgtgctgtacttacagattgttaaaaatgtttctataaagaaatattattagtactctgaaaaggttctgttagctaaagaagccaggctggaaactgggatttgaggattaaaagttataaaatgtaaacagactaaccaggatgagttaactttggtacatttcaacatttgataattgtagcaactagataaataccctgactagggggaaaagttatttctaggacaagaagcctagtgtgtttgcttctattcaataaatatttactaaggctcgttatatgcaagttcacagaataaaaaatataagacatagttttatcaactatgcttctaaagggaccttatattcatataccatatacatcatatacactcacacataatatcatgtggtgttttacagatgctttctcaatagttaaactatacatgctttattcattttactttatttcagtggcctctgccacatggagaatacatttttaaagtactgcttctatcatgatgcaaatatctcaaaggacaggaaggatcctaaaaatagtgtcattagccaatgacaagatttagctacaggtctctatttttttttttttttttttggcgggggttggggggcgggctggagggtattggggaagctgaaaatactgaaaagcacagaaatagtctcgagcctaccaccccagaattcaccttgatctttatatttgctttataactttatgtaagaaaaaaaagtattacaaatcaccttgaagttcaccttattcacctcttctgaccaatttccctacacagagcaatcaccataataaattgatctataaccttaggcattggttggaagtgtatttttaaaaaatatgtaaatatcatctgatattggtattgttgattctccttgctaataggctacatgcaaagagaaattccacaagtttcatgaggaatgatttatctaagaagaaacccatcaccctttcaaggtttggattgaacaaacaaattacaatcaatggtgtatgagaaattatttgctgaaggttttggaaagttaagataatatctggaggaggacaaaacccctcagggaaactaagctggagccatttctaagatttttttcagcatcaaaatgttatacatcaattgcatatttactaacagaatgtagaataggtattatttcttaatacaaacctacctattccttcactccatcaagagaccatcaatctttcttcacaggcactcatgatgcaatttgaaagattctaaatcataacttaagcaaggcaacttaaccaaagacatgttgatcccctctcattattgtgctataggttagcaagcccacccttataaagatgactaaacactgtttatatgttttacttatgcttgctaaaaaatttttgcagccacattacagataaatcttataatgtacaaggtataatgtaaggatacagattaactctttttgatagctatcattttcttacaactgatttcatgccagattatgggaaataaaaatctcataatacaaatacaatttctctttctagcctaagctttaagggagtgtaatatatgcaaaacatataaataaaacttgctgaaataaagccagtcatttatttttcgatctgtggccaagtgaaaaataaaactttcgcctcatagcttctggagtgtgtcctatagatttcaacctgatctgccatattcatgaaatacttcaaaattaaccacaaagcttcaaatctaatcttcagagatgtaattatttccaaataaattggaagacccttgaaatacagaaggcagggtaagggagatatcatctggtgagaacaaaactccttttagcagtatgaaaataaataatacacaacaattatcataccttcttttgggtctacagcgcaaaataaaaggttgtccaaatgaatataatttgcagctctacgttttgccacctgcaatgaattacgtgttgaacttgttgaacacacctggaccccatgaaaacccctccaatcccaccatcatccaaagattctgattctatagctggtgtcattcctgaaaatctacgtttaatatattacaccttttccatagataaaccttgaaaacactcttctagagggtaatattttggagctattagacatatggattgagttactttttaagaagcactgttctaaatagcaatataattatcctgagacaacaaaacagtccatgcccttcactagttctataacctcatgctatcatggcccatcatgctatactcaattcgccctccctctaaatcactaaatgtgcgttcatccagtgcaggaagcagttctttcacatctgcgcacctccagtatcttatacaacgtgcagaacagtgtaggcattcagtaagtgtgtatggaaatgtggaaacaatcatttccaagcattttcaaggttgtatcaacatctataactaggttcaccaagtcatcgtcattcagtattataatactttgacattctgtgactttctggccacaaaagctgtcctcctacacgacaagcatacatcaccacctaattcttaaaaattgctagattaactcaacactacctgtcacttaaaaagtagtagaatatggctagggaagtggcaaggatacaccctaatccatgtaattccactctggggtcttagaattttagattctaaaattctaagaccttattcagttaccttattctctacatgttgactgctgcagattcaaaaacccaggaaggaatcactgtggagaagggagagaaaatggactgtggagaggaaaaaaacaaacagaaaagaggaccattcctaatactatagtcctgctgataatctagtctaaaatcccacaaaattaagtcacaacatcaaactatttacattaggagatcatccactcagagaatgcaaatatctcttcagcttgagaactgcattctggtatgtcacactaattccaaaggccttcaatcactttgcataacaaccaaattgcctacaaataaacaccaacctaagttgccctaaaatggttgttttatgtcccatgtgaccgctcctttacatatctagcaattattttttactaccatgaataactaaggaagcataatatagtaaaaacagctctgccacttatgaccagcagcatattaataacttttaccacaatttctcaactataaaatgagaattttagtagtgcatatatcattttgtattataaggggtaagtatgatatgtgcttagtattcaataaacagaagctattatatattaaaaactaagggggagaagttagactcgtcataaagtcaataaactgaattcttaaaattatcaccaaaaaatattacatacacctgagagaaaaaaaaagccatcttaaattatttccataataaagttattggaaagggcataccttcgctgagactagaaacttcagaattgttttgaccatattagtcctctgaattagtcccaatttcaatcaccatattgagagaaatttctcctcgggtccctcatgtttctgcatgtcacatgaacagaggcaaagagagactagtttttcaagaatgcatagcaaacagccttggaatatagagatagtgtctccctccagagcgagggcagatttgtttcttgccccaaaaaataaaagtgatcctctgaggcaagtgcggtgtcctggcagacccctttagatgactggggtttcccaaactcagggttcatcagctgtaacacataccattgcatacaccataggcccttgggtcattcagcagcaacctcactgggtttgagagtccagagatactgatgcgaacacaaagctcacgctacctactgtgccatgaggcataaggtccactgtgtctgaatcagggtatctcctgcatctgtgaaattgtggtcggctagcttattaggttgcaattagggcaaaatctcagaccctttacatttcttgacacccatgttgtactttttgttgttacggtttctaatttggtcttgaaaactctattgagagtggccagaaagcaagaaagccactctctaggagagccctgatgaggcgctgggttgtgaggaggaattagtcctatgggacgggtaagatacaatgtggaggtgaaactaaaatgcataaaacagaagaaatgcattacttacagatcccagagaggttgcgggggtcaacaggaggccagtgggaagtcttgaggtgacagggagctcagctagcaggtggcaggtggggggaagagggacagagagaaatagagacagagacaggcagagacagtgaggaggatctctgggactatgcctttcttaaggtgctcaggctttctcgcaggtgttgcagattggctagtttgaagaaaacatgccagaagggggaacttatttatgtaactctggtgttggccattaggtttatcatggtcagcagctgtggggcatgtcggattttttttttttttttttttttttttttttttttttgcgtcagtgagatgagaaacaagaaggtcatatcaaaaacgactacgaggggaagagaagttttaaccaggccgaaagtaatggggtattactgggtttgaaacaacttatgtgaggcctagaaatggatgtcaaggcagtaaccatgttaaacaaatttatgacacaccatgtctggctgagccagcttgtcaaagtgttcactgatccatctctctggcttcagactctcactatcatttaactagtgtcatctttattttgtcttcagcaattctttggtgactctgcattttggaccttaagagtcacgatgtctttagaacagtacttctcaaagtgtgcccagacccgctggggcagcatcacctgcatcttgttagacatgcaaattctcaaatctctccctaggtctactgaatgagaaactactggagtgggccctgtgaatctatgggttaacaaacatccaggttattctaatgtgcattgaagtttgagaagcactgctctaaaagaaaacttcacagcatcgttcaaggaaaagttttagattatcttaaaaaagcaagctctcatatctgagggaaataaaacaacaactacaacttacgtgttctaaagctcttttgaaaaaataaaccttgtaaaggaaacagaagtcactggaatgatacccattcagaaatttaattgtaacttattcttttagtgattattgtaatttgatgaactttgtctctgagccaattaactttaatgtgaaaacagtaaaataaaaaggaaaaatgatatttgctttttagacaaaatatgtaaagtgacagcataatatattattacaatcaaatgtatattggaaatgttattaaatcctcaataaaatgtcctaaaatttattaatttgcattaacaaaatttcattttgtaattgtctaaaattatcttttctaatttttttctttgaaatgtactgtgtatagtctttataattctcctttcccttccttttttcctttctttcttggatggaggatgctcaaacttgcttgtccttgtgagcccattactcacaatttgcaggaatttgtgtaggcttcaggatttcattttattttagtattctggttgccaaatgcattaaagtttataaaaggtagaaggaagaaaactgctatactcataagaaaatgatcaaatctctgtaggaattaggtaaaagaattaaactacacaaccactttaaaaaggaaaaaatatggaaaggccccatctcactatcagattgttgcatataaggttctgtctttacaaaagtctacaaatatatcaaagttcatgtgggtctgattattctaccaaaataacaaaaacaaaatgtaactggacatgatctaaattgacataatgaacaaaaaactgtaaaatgtagtataatagggtaagaagtacctttgaaaattatttttggtacttttttctgcgttttttttttaattttaagaaggaataaaaggtaaatctaaaaatcaactcttcaaataatttaattggagataagaatacaaaaatttaatatacatctgacaaaagaacatactttacaaatcttttcattcacatatacatgaataagcttgcatatgcatatatgaaatgagatgaataaaaattgattgcccaggcacggtgggtcccacctataatcccagcactttgggaggatgaggagggcggatcacgaagtcgggagttcgagacctgtctggccaacatagtgaaaccccgtctctactaaaaatacagaaaattagccgggtatggtggtgtgctcctgtaatcccagctactcagaaggctgaggcaggagaatcacgtgaacctgggaggcggaagatgcagtaagcggagattgcaccattgcactccagcccgggcaatagtgtgagactccatcttaaaaaaaaaaaaaaaaagtgaggcgcaggaagggtagataaaatcaacaaaacttattttgacctccatagtgaaaactaacttaaaaggtttattttatcagtaaggaccatcacttttctcatatatttttcaacattttacaatccctagagtgtttatcattatattgaccttgtcataatccaagagttttaaaacagcctgaatgattaactttccaaatcacctggcagagagatatccattatcttacattgcccccaaactggtcttaaataggtatttaagatgggcagatactacacataaatttaaagaactagaaaatgcagtactgtcccaataatacatggtaactaaaaatatcatcaagttttcacttcagttattctgaatataattctcaatttggtttttatttttagttaaaattttgtacaattaagaatataagaaaccataaaacacatactgactttgaaaatatgggtagaggagagtttttaaaatttctctgaacttctggttcttcttctataaaatggagagaaatacccatttcacagaattttttaggaatttttataaaaaattgagaaaaacattgcaaaaagaagagatttttgcaaaacagagtagcgacatcttattcaacattagctattatgaatgaagaaggaggaaaaggaggacagggttcttttattttatggaaggtctaatcaaataggtatgtatgactgtggtcaacgtacgttacgctcccaagattgtgtcagattctatctggtgaaccacttccagtccttttaattttgcaataatgatttgtcatctccagctctgctcctcccaccacccacactctgactcttcttatatcaaaggggattcatttccagttatctcaacctattctttgactggtggtaaactatttatcattcctgacttgttatattaatttccttttacctttaaataatttacctttgagtttaattaacttgcacaggctgccaattcagtgagtaggatggttttaaaaaaaaaaaaatgaaaagtgtgatcttagacggtaggcaaattttctgttttgctaacgttgctgtggaaacatcggtttcctcttttttttttttttttttgttaatacatggagggggatggatgtatcacattctgtggcaaagagtgtactatatgcccctctcactttgtaatctttcctcctaggagttggaaaattactatgatgtgtaaatcaatcaatcaaatttgtaaaatataaatttacttggtttcttaaatggcagaaacatcatccactaataatctgaaaaaaatatgccacctctgttttcccctttttctagagaacatgatttttttaatgctgtaaaatattcagtagctctttagtttttattttaatttgagtaatactattattatttctcttcttcttaagtgagttttaatgatttcggtaaaagctccagtaactgacattatcaaagattctttcaataattctcatactattatcctgtaattttccactcacgttttttagatataaagcttctaagcagtgacaaattttaagctctcgagtctcaagtacaaagttcaagaagccttcttcttttcctttttaagaaaaattaaaattacattcattatacagtatacatcatgttattaagaataatgatggttaaaatgtgtatgttttacagtttatgaaatttcttttacatatggtatctcagttgaacatcataatgagaaataaagaagggctgatatattttcactacttactctttaccaagcactttacagaaattatctatatttcctacaaacttagtacatactcccattagttccattttacaaaggagtaaacagatgttatcgagcttgagctcccttaagtcaccagctaaatggtggaccagctggaatttaaatagaggctacctattccagagtccttgtctctaccctacctgatgaaagaagttatacaacttgctctcaacatcacgtaagtaggagacaaactatgaataggagtaatttcttctcattctacatacagtagagcatacctatggatatgtgtcaaataaccaattaagcatttgaaaaaagtctccctcagcctttatttaatttgtattcattttctaaattagtagcatccttttacatctggtattttttttgtcactaccccactgcattccaccacttcgctgcagcattcacagattggaacattaggccaaatggaggttagggctgtgtggcagaaagctatataaacattacccaccccgataactcaaaaggagcaatgttactatcaataagaaaaataaatatcaacaatggaacaaagggtcagacaaaaaagagagggggggagggggaggaggagggggaggggagggggagggggaggagggggaggaggaggagggggaggaaggggagggggaggagggggagggggaggagaagaaaagaccaaaagtgcagtgtaagggtaggaattcctcttcagaaactcaactaactgttagttcttctggagaatttcgtgatatctattattaaaaaggcaagcgaagggcaaggacagtgcttactttgaacatatagactgtattcactatgggaaagtttggaagagcagatgagatgttcttttaagagatttattaatatttatccagggtatctccatgcattcaagaaactaatttatactaaagaaagggaaaatacaggcaaacacatttgatttaaagaaatgggccacaccaggcatggtggctcacacctgtagtcccagcactttgggaggcctaggcaggcggatcacctgaggtcaggagttcaagaccagcctgaccaacatggtaaaaccccatctctactaataatacaaaaattagctgggcgtggtggtatacacctgtaatctcagctactgggaggctgaggcaggagaattgcttgaacccgggaggtggaggctgcagtgggacaagttcgcgccattgcactccaccctaggtgacaagagcgaaactctgtcaaaaaaacaaaaaaagagagagaaggaaggaaggaagggagggagggagggagggagggagggaaagagagagagagaaggaaggaaggaaggaaggaagaaaggaaggaaggaaggaaggaaggaaggaaggaaagaaaggtgggccagatttgaggaaggtgggcaaggttaattctgagtgaaacctcttaaatacgccccctgattgtctttatcccagacctcaaggactcttgaaagaaaacactagaagttatttcaccaaaatctttgtaaaggactaaaatcacaaggaaatgacacttcgatgtatgttacagagcaaagttaaggttgcagggtatttacttcctgccattggcattatgggggcatagaccatccatagaaggctcagaaacaccccagacctgacagaggtacgagggcgttaccatgtatacagatagtctcaaagaaatatttttaggtaaacagcttttaaaagtttattatacactattttatcacctagctaggtaacatagatggaacacgttaggacaaaagaaatagaaggtaagatttctggaaaagcaatctagtagcaattataatagcaaacatgtatagatctataatatatgatagtatgatatgtccaagaaaaaggcactgtggatttagacacagatttgaattctgaatgtggctttccactcattacatataatctctaagccataccttcttctaaaaaataacgataacaatgtaaaatattgaagctttaatgtcacaagaaacataaacataaaccatctgatgaaccataagactcattagtattcagtgactctagatctctaaacttcttttttccttccataatgcttgatccatttttaaggctgcaaatgataataaatgattttttaagatccatgtatctaaacctcacaaatatctggctttttaacaaatatcagtcatataaaatctggcatttgaattggcaaatactaaaagaaacaaacaaacgctattttcaactgaatatttatgaaatctgtgtctctaccttcagtcaatcccaaaggttgaaggtaagtaccacaataatccacataataaatacatttattactcatttgcagtttaaaactgtacagaaaaattttaaattggaatcctttcaagcaacacagaatcacaagcctaaaaacaatctaacctatagagtaggcatggaaaaaatgtaagctgatttaaattcaccaaaaagttaacaacagaaataaggacaatgtacaatagtatttattactccagcaacatctgtagataagatttgttagcattttcaattacaagatcacagaaggtcaaaaaataatcacatacatggataaacattgccaaaaaaaaagatattaatagtcaagatttctgaggaaacagctgatagccatcaatgaattagaattgatttaataaattaaatcagtcaacttggtttaatcaattaaatcagtcaatgcagatttattcatcacctactttctatatgtagagtttgactttaggagctgtgtagattgctttgataattgagagctaaatttgggctactgtaacagaaataccatagactgggtaacttaaacaacaagcatttatttctccagttctggagactgggaagtccaagatcaaggcattggcagaggcagtgtctggtgagggtctgctttctggttcataggcatacatatgtatgatagtaagatatatccaagaaagagatgttgtggacttagagacagacatgaattctaattgtagctcttccacttattatatctaatctctataccatattttctccttctataaaatagaagcctcagatgacagaattggtgagggagctctctggggtctctttataagagcactaatcacatttgtgaaggctctgccctcataaactaatcaccttccaaattccccactttctagtatcattgccttggggattaggtttcatcataggaattttgggggacataaacattcagcctctagcatgatttaatcagagaaaaatatcacaaagagaaatataaaatagaccaaagtatactaaagatttgtaaagaaggtaggaagcaaaaaaggaatttagcagtcagggagactgtaatatctggtaggtgagataatttaagcaaaataataaagtagtcatatttaaggcatattttacttttttggctgattgaatgttgactaaattgatgtagcaagaatctgtctaaataaatcggtaatataatattaaaaagtatcatcatgggaacttggtacaatgtctatctactaaataaccagtgaagaaagttaagttttatgcttatacactgctgatgggaatgtaaattatatcagccactatgcaaagcagtttggagttttcacaaaaaacttagaacaaagaactaccattacacccagtaatctgatttttgggtatatacccaaaggaatagaaatcatcctaccatagacacatgcatgcatctgttcttcacagcactattcataatagcaaaaacatggaatcaacttagatgtccatcaacaggagactgaataaagaaaatgtggtacatgtatatcttggaatactacgcagctacaaaaaagaatgagatcatgtcctttgcagtgacttggatggagctggaggccattatcctaagtgaattaacacaagaacagaaaaccaaataccacatgttctcacttacaagtgagagctaaacactgaatacacatggacatgaagaagaaaacagtagacactgggacctacttgagtgtagagggcgggaggagggtgaagatagaaaaagtacctactgggtgctatgcttattacttgggtggcaaaattatctgtacaccaaactcccatgatatgcaatttatctgtataacaaacctgcacatgtacccttgaacctaaaacaaaagttaaaaataattaggccttaaagaagcaaccaatgtcaacactatgatgaaaatggtatttgggctgtagtattccattcttcttcaaagcataagcacagtataaatgagattacttagtgggcaagcagtaatagagactcatgtgtgggaatctagaaagactcagcaggctgcagttgtgcctaaatttttccatttagctgatagtgctctaagtttctctatctaagattcactcatttggcccaaatatgcattacctattccaaaactgctcttaaatacaaatatctatggaaataatcacgatgagaaattttcttggcactaaatttaccatgaattaatttattatatctttcatagattgaagataaacaagatactagaaaatgaaaaattttggcaaaggttaaaaacaaaggagaatagaagaattattttaaaataagagataccaactgaatatggcaagtctgagtaaagactcagaggagtgaatactgtggaataatggaagagtataaaagagcttgacacagaaaagaatacataagggagaagaatacggacaaaaaaatttgtgtaagaaaaatttcaactttcattcattgtcactgacttttttaccaggctagtgctggaaatagattaaaaatgcaaagtagctgcattaagattactcatgattttgctttaggaaaaaaattaaactaattgtaaaagttattaataaaaggtttacattagataaatgaaatgataggagccacaaacgttattatgcttatatttcaaagataagtgatttagaattagtttttcatttcaaataattaggtaaccctactttgccttgaaacaattctgttatgaagtttgcaacagaactgtgtagtattcaatgatgagaaactgtcattttgggcctctttagtgaagggttgttacgagtcagagaagcaaagttttataattgaaagtaaacaatcttagtcactaaaatgatattgttattcacctccacagaaagaatcatctcaacagcaagactgcattactcttgttctatgcatgaggaatttagtttatcaattagtttttctttatcctgaatgtgagccaatgtttaattgcttcatatccataattgtattaactatgaataaattgttttaagaaaaaaatctgctccgtggcacaaaggagattaattactaaaagacaatagcaattctttgctatcaatcaaagatgcagaatagcatggctacctaatgaggattcagcttcattaactttcctcaaatctcatttgtaatatgaaacatcaccatatattcaattcccagaaagataaatttaatcaacccagtagtgtgtggatttgtttacaccacccttacccatcatccaactgcaattccaagtccttttcaaactgtaatactttcataccaaattttttttgatagagctttgggccattttcaataaaataatgaaatcctcccaatatccttaaatccatcaccatttcctcttggtattatgaaaaaaagaaattcatagaatcatatattgttagagactggaagggatcttaggagtcattggatctatccctatcattttacagaatgacaaactagattacttaaagaaaatttctctttgagccttgaaaagtcaacaggagccatcaaaaaacatttttcttaaaagggagagaatgccattgaatgacactacaaaattacaaaatatgttccattgtatatgtataggtaaacaattaacttttaataggtatactgttaatgggggcaataataaacactatgctgataaagaagataaaggtcttatgtacaactcaagaacgtctataatctgtaaagattttagcttttctctcatcccaaactcacaatccccttattacataattatttatacaggatttataaagagaaatcaaagagttaagggatcacaaaattagtaatttgccttaatcattattagaaaacacgtgcttactatacatttattgattgtacttttttaaacttaagttacatctttgcatctattcaatataataattctagcatgcttacttattcaaatataatttatttccagtctgggaaataatttttcaaaagcgattagtttaaaagatttttgtagtattagctttctgataaaagctttgagaatttcccagagcaatctgaatttatcgagctgcttttcagcaaaaaggtgtttaattaggttgtctcacacttctctaaacctgaaaacctaatcaccaccttataactcaaagaacacaaaggcaagttgctttgacaattaccccgtgtaaaatctttggtttttccttctactcattcctaacttctatcaggaagaactttgactttacaaatgttttatatatttttaaatcaaaggaaaagttaaagaaaaaaatcaaagtcataacatgaataaataatttccttcctctcttgttagaggcatacgtgtgtatgtgttcatataatcaactgcaagtataaacagacgtttgaaagcagcaaatcaaaaaccatgaataaagtaaatcaaaaaaagagaaaaagtgaattattttattaatgaatatatttcaaagaaataggctgtaacatacaagcttaatgagatacgcttttctctcaatgaggtttcatattcatcttagaaatacaaagaatgattattatcatctattgtgagtgtaagcactctatcatgcaaagaaatctcaccacatactgtggaaaacttcttaaagttgtattttcacaaattcatgcatctaaaaaaatgtttgactcttctctatccctctttaccttactctgtactatcagatacataactttaggcatgaaaatacagttcctgccctcaagaactttcaaatttaatgtaaagaaacagaaaatgaaaaaaaaaacctaaatagaatgactttgtgtccaaaagtcatttcatattcagtaagattccaaacaagaaaacaaggtggatatgacataaaatcacttagtgctgagtgccaagcattgtattaggtaatttcacaataactctattaataggtattactatcaccatactaaatgcttagaaactcattcagaacaggccccaagttatctagttaacaaaaaacaggggaaatatatatatatatatatatatgtctatatgtctgtgtgtgtgtgtatgtgtgtttgtgtttgtgtgtgtgtgtgtgtgtgtgtgtgtgtgtgtgtgtgtgtgtgtgtgtgaatatagagacaggtaaaaagaatcaagggtcaatccttgagaaatatctgtgtataaagtagaaagatcaacagaatcagtgaagaaaacagaaattaagaattcaagatgtgtaagtattaaatgaactctctttgactgagccaactgcctggcagataatcctatgtcttctatgcaatactctctgttgattctatgtagattttcaaatgctattaacctgagcagctgttcctttttttttttttcctgaaacatctaacttttcttctgtaactctaactaaacacacacacacacacacaaacactatacatttgatctccgtactttgagattgctccagaatatattattatcttgcatagtaccatctaccttgacttgtacagaaaatattagatggttaatgatattttagtcataatttctttaaaacaaaaagttattttatgaaggtcgtcttgaaagcatcagttaaactggaactagatcccatttgttctaattcccagtcccctttgtctgatgcttcttctgctaaaatacattggtaagtgatgtgctgttctcaaggggtcgtacaaggatttagccgaagctttatagttagctttggaatgagaattgcactttacccgggcttcaacccctcataattcaagtaaataaggccaaacaggtacgataaataattaaatactattaatgttagacacagtttgaaatttttctgaagatactttgaacaatgcacatttacagattacctacttcttaaaattactaatggcaacatcacaataaaaaattaatagcttctatcatgtgtgtccaaaatagtcccgggcaaactgacaaatatctgggatattttagcagtttttggaattaacaataattgctatcattgtagtttgccaaatcttttgagatgcgtgggtttgtggaaatatatttaagtctaaaaagattaagcgtgaaccaaaatgaaatgtctcattttttaagtagatttaaaaataattaaatgaaacatttattacacttgagcacaccataatctatggaaatgcatactatattgaagtgagtacaaaaaagttaaggcattgcattttatggttagatttttccgaatcacttttacaatgtttcgcaggtttgctgaaatttatcttccccccaacaagcgaaattcagtatttgaagagtaggcattattgaaaacaaatttgtttaacatagtagccagttacatacttgatatgttttgtgtttgtcttgattagctgctttacaacctgaaaattcattttgtggtgctgaataaaatcaaagaacgtatttacttacaaataatggctttcaaaacattccctttatctattatgcatattttatcaactttatgtcatatttttaaaagcatcatatctgtataattgctttcatggtgcactggaatcccactataataattttggcatcaaaattataaggctacattgttgttctggtaacgaatctccttaaaggaagtagtttgtgttgaattaaatttctaaagctaaatgactttattagagtaagatttcaaagtagctgctaaaagctgtgtgtatttctacatgagttggcatgagccagtgacagagtgtgaatcattctcccatcagctgctccgtagggctgggttatcaattatcataagcaacctccagttggtagtcaagctatggctcaagagctccggtgactgtctcaaccccacccttgaagataacaaacctcattttgctttgtgccaaaaatgacaaactcctgcatgttcatgcagggatagcaaaatatgtccttatttcttatgctggaatggcaaaaaacaaaacaaaaaagtttcttctcttaatgatttgtgtgtatgctggagtatgcatatgtaaataccaagcaagagttgaagtagttacatagtggatctcacatccacttttctttatatcttcactttttttaatgaataatagctattaaactaaagtccaagctgaaacattctaagttttaatgagaagagagggcaaacaatactctatcatgttttcatttgacatttatatatattacgatatattttaatgaaaaattaattttgaaaacatcttcagatttggggaaagggcagcagtaacaacaatgtctggcaaaggtcagatcagggagaagagataacagtaaaattatctgtgaggaagaactggaaaacctacgataagaaataactctcaagtgcattctagaatgaagtaagagtctgtgaaaatacttgataatgaaaggtaagcagtattgtactttcacatctatccagcacaagaatggggggcgggggagatagagacagagactgagattccaagtagtcatatgaagataatcgtaataggcacagacagcactttaagttgcactcttttatcttttacagaaaatgtttcatgtgcaattctgtttctctttctagtgacatatacttaaagtatcttttcagatttatattttatctcaactcaatgattccattaccaattaatttttgtttacaaaattatttaacctatactctgttaatgacactgcaattagtaccagggatacagatttaaaagagagtccctagattatagaacagtctcataagggaaatagatgagaccatcactatctgggttgatgcgtgatgggatggaagtgagtggtgtgccgtagaacacataaggtaacacttcatgtaaaatggggtgggatatggtattagggaaggttccattgaaaaggtgattccaaataaagattcaggaatcacctttggtgatgaaggaaggaggtccaaagtatattgatacagcacagattggagattggagggatagtggtgaaagatgagggtagttaaataggaaacaaatattctgtttaaagatcgtgcttactattagaactggatttttgtttttaggtctgtagaatattgtagggacaaataaattgcctttcttctttgccaggtgaaatctcctgtctctaacccaacatgttatctctcccagagtctataatttcctaatcaatttcatgtatttaaaaaaaaaaaaaccctctggcctaacaaaatctctaccaaattgaaacctttcaaccctttcacagcttggcctggctcaccctgagaagttcacagaataatctgcaccacagagtcatagctctgtgactaccatcccacacttttgcaactcttaatgactggatcagaggagggaggatagataatggcagaaagggtcttaactcagctgcagagagttacactttgcagtgggtgggtgtagagaaattctagtgctgactgtctcctggaaagcttttgcagttctgcagaaattcccactttggggttatctaaatgtagtcactgagcaattgtgattccttccccagctactcagtgagcctgtccataaaatctggattctactaatttacaaccacctcttttggttggagacatcttgatccccctacccacagccaaccaactatcctctttgctttttattacatagcttcaaagtagaagattagctaaggttagaactagattttggaaccattttgcaagtccatatacatggtctaataactctctttaaagtaaggatgtttggcattcataaccactagctttggggcctagccaaaatttccagacaggaagagtgccatgttaacaaccagtttactacactatgaggtttggattttgtcataaagacaatgctagaagaattctatgggggatgcttgaaaaggcagactagctggacacacctgaggtggggattcctgttggatagctactgcattgctacagtagggagaaaacgacaggatcacagatctaactagtgccattaggaatggtgctgtggaaaaagattcaagaaatactaaggaaggagaattgagatgatttaggcttggagcttgttgttttagttggtctgtttgtagatttgtttgccttagaggaagcacaagagaaaacagggacagttgatggaggggagcaaagtcattagagagtaaggaaaaagactgaaataacaagagaagattgttagacttgaacaaaatagactccgatttatatttgtcagaaataagagagatagataaagacgattcaggatgagaatagtctgggcaaagaaactgaggtagttctcatctggtacattttttttttttatatatgtgaatagaggatggttgccttaaaatgaaagaggatatggtagagtgggagaaaagtaatacaaatttgaaataatacacttctttggggaattgagcaagggaattatctaagaataaatagattttacactcttcaattttctgaggaaaagtatccttttctcatgtaatttttttaaagtcaaagtactgaataataagaatcagtgaaaaattgtggctagtttaagcatgttgctatcaaataaatgccttaattgttttgacacagagaagaaaatgtgtctccaaggttacatcgttggatatgaaaatttatagaaaaattaatctttactaaagattacttaattaggaacattgttattgtgacagaatatattatataagagtattcagaaacaaaacctaaggtttaaggaaaatttatgagatgaataggaacaggaaattttacatttcaccctatcagcggttctctgaataatacatctgatgttttaagcactccagaatacatttccaaaataaactgatttttctaattcaagattattagaaatgtttaaaatcatgtatgtgctacaactttgtaactataaatcataacataaatgtaaggcattataccacaaaaactagaattgacaggcatataattttctagtatatggggctgagaaatgaattacaaatggtctttttgttgtatggtagaaatcacttttaatgcagtgtgatgtgtcacaagcactaaagaaataacaaggctttgataatcctggtcattctccataaattctgttgttacgtggcatgtgcctcagggacgacacagacaagttaccagttttcagaagaattaaacattcagctacaattacttttaacataatatgcatgaaaataacatttccaagaagaaaattaagcatatattttctccttctaatgtcttttttaaactatacaaacacacacacacacactaccatgtgttttaattatatcttatcttgctatcccatcagttatatttatgggaaatgtgcatatatatgacattatgcacacacacacacatatgtctacctggaataaaggcaaaatatatgcaacacattttccacattgaaaaatacttgtattaaatgtcaggatctttcctgaattccaggtacagagagaggaatcccagtccctgacttgaatgagctcatggtcccaggagaatgccattcatttctatacccccagtataaaacaaaaacaacaataaatagatgttatttgctgtaaaccaggcactgtgctcagcactctacagacataatatttgatcagcacaacaatcctatcagtaggtgctattaaggcccatattttacaaatgaggaaacttagttaaaaacctagagaagcagtaggatgggaggaataagttactggagcacaaagtactatgctcctattttggcttggctagaattaatctgtgctgagtctgggcaaattctttcccctctctctgagtctcattatttaccacctgcaaaatggactcatggagccttgtgagctacagggctcgaaggcagtgatttctttgctgcatgttagaaagactaagagagtttccaaatattaacatcgtgataccatgctgggatcccacatcacttaattcagaatgtctgagggtagaagtcaggcaccagtttttacgcagcacttttaatggacctaggttgctatctaacttggtttaagaataggaaaacaagtgggccccttctattttacattcaaacacaaagagatatctggaacttttttttttttttttaagtggatacccttgctttctggaattcccatcaaagaaagcaaagggcttatggataggaaacctaataaaaccttaatcctctactctattaatactatgctgctccagttaaagcgagagtttgtgaccttcctttttattaaaaactaatgtgacacagtttttgcaggtttgaattacccataagtatatacaccccatcgttaagacattttggctttgtgaagagtttcacttaatgctccatattggggttataattgtgtattctcattttctcacatttacaaggaagaatttggatttcccctgcctctgtctttatggaatagccaagatgctgacacctttcctcccagacacttatgattctagtttatagctgtaataatcacaggcattgtgtctcttgtaatatccacttgttcaaagagtaaagttttatttacatacttttattttcacatatttactttgctttcactggcctgtatttacctattaatttatttgcattactgagttaattacatattgacgattctatgtgtgttcagtttgtgagcataatcttaatatttgttgtgttacaaaggctcacaataagagcagaaaaagatatattttagaaatattaatgaaaagaaaatgccttagtggattttattacaacgaatgttaactattatagtaattcaatttgtttcatcataaatgaacacagatttgggggctccaaaacacgtaaaaaatgttttgcagtaattcatcttaaaagcttttattctttaataaactatgctggctttgtgggagaactttatatgagttatttcagtatacagaaacaaagattctaattgcttctgaacacttcatctttaaccctatttacattagcagagagaaattagaaattgattaacttttttcagccaaaaaatatcttcaaattgagttttcttctttggcagtttcttatgaagttatacatattctcacttataatctagcaattctactcatagatatataacctcctcattccagcaaagtaaaagcatatgtccataaaaagagacatacaggagaagtttcactgctatttataataccaaaaaaatgagaaacatgaaggtacatcattacgagaatggataaacaaattgtagtatattcatattatggactactactcatcaataaaaaagaagaaattcttgccacacacaaaacacacaaatgaatctcaaaagtatgatgcattgtgaaagaagacagatacaaaaggaatacatactgcatggttccattttatgaagtacaagaataggaaaaacacacctataggacagaaattggaatagcattttcctgggttggagataaactataatttttcccttgatacacaaaaatctctaaatatgtgtgcaaacacacatatacgtatgtataacaaagcctgcagcaaaatatggtatagaaattattgatatctgtttaatactcttagcgactcaagtagaatatattgtttagcaaaaaagcaaggttatccaacagaatttttagtgtaaataaatatatcacatatataaatatataacattcacatacatatttataaaatgtatactcatgcatcataatattaattgaaatatacctgtgaataaaataatgagatctttttattttgggttttaaagcattctctattgtcttttcagtaatacgcatatatttttacttaaaaaggatatttctatcttaaaaaagaataaatatagcaattgaatttagccttattaattactttcttctctctaatgaagaaggaacatgaattctgcaaattagttgtatgtttttgaatttataccatggtactctttttttgtgttttctgttcatttatttcttgaaattttttataatcctttactttgatccttcaatattttactctttttgtcaagttgctattttgtgaacacaccctatttacaagctcttccatgattctggacagaactcaggcctaaaaaagattctaaacaccaaatatgcaaaaagcacattccaggagaaatgatatgtgtgaaaccatagagtgatttagaaatgtgaagctgtttaacatatctaactgaagccaattacacaagaaaggcaatgagatatgcagcttttgagacaagcaatcttatgactggagaacgataaggcatgcgtgtgcatatatgttatgcatgggtaacagaactgtgcactttataaagggttcctaataaaacagagttttaaaataatctcaaagtgtatatgtttattgattattcaagtatatctactgttaggtgactctattcatttctagtacctcttgttcatttgctcaacaaataatagatgtgataccactagataccaggtagggtattggaagaggtgtttgtgacagcagtagctcgacagatcttatttgcactaaggaaaagacatagcaagcaagcctgtgtgctaagcacaaccaaggagaagttgagggtgttagaaaaggaaggttaatgatttaaggaaagagaagtgctcactagtgacactgaaatctcagaatttcagtaaggatgtatcacatataatctgcttttggttctcatgcatctagtcacatttttttaatcactttagaatgtgtacctagtatcacttacaaaaatacttcaaacaatacattaggtgtctggataatttggccagcatcatgggctcacaaagaccacttagcaaatacactggattatcaaaaacgacactaagtgttggacaatgttggtgactgcacaatgttgattattcaggtcccctttacatgcccaggtgcactcttcccccaggtgcagtgttagctgcaaacagtttacagctgccccttctctaaagaatgaccctcagctgaacagaggctcctcagaggttttgctacccttcgctagtccccacctcttctccctggggcctacagccaatgatggattctagcaggaatacaaaaggctaacccctaaccatcactgatgtgagactgattttgtagtgcagttcatgctaaccattcctcatgggatcaggctgaaaggagtgttctggctgaaagcttgttcttgcttagctctttctctggcttcccacattcccttacctgttcttcctgagtaccctctgaacaaacaagaaattcaatttcaggctctgcttctaggaggcctggactaagacaatgatactgtcctgtaaggaaaacggatgggccacggtcaagaacaggctgaggcagacatctgatccagcaagacacagcaagtttggagtgcgggcacacaattccactcattatataaccaagccaggtgaggtgcattaggtgatcacccatgtgagttcgtacttggcttggagccactattgtatgtacaaggtataactaccctgctgacgctgtacatacggcttgcacccaggcgcgtacccatgacttgctggcgcccagagaaagagtaaagccatgtcgaaattccctacgattcctcaagtgttctttcagctgcccaccactcgttcacccactcccctcggtcctcagcttgggctggaacctgacacttggtatagccagcaggatactgaggagagtgagcctttggtccccactgattctgagtcagccatgcagctgaaacattggttgtggtggccggtggcagcttactgctcggatgggatccagtggaaacctgggcggcagtagatgggtcccccgtgaggatggagaaggcgctgaaacagctgaagtacagagcaccaagaaggaataagcctttgctggcagagttggatgtgcatttttgaccgcggtacaagaagtacacactcagcccctgagggatgcagcggaggtaagggcactccaggtgctggtgggcacctggaggcctggctacagaacttggaaaaggtattagaggttgctgtgaatgcaggcctgggtccgttgtctcagtcggagaccccattaggtctgatacagaggaggctgttggcagaaccaaggggtccgcgctgtaaagacggggaaaatgcgccacctcagaggtcctcccagaggagaaaagggaccctaatgagtgacacgctgacagatgtggatagatttgattttggccaggttgacagagagaaaataaataagcagcccaatgaagtactcttaactttgtggagacagttgtccccagagcagcacttccagaaaatgcccaagcgggagaaggacattgctgtgcaacccggtcccccctaggtgcttcaactcaaagactacgtgctgcagccatgcagggagtataaagcctttgctgtttgatgagggacctggctgaagtgcccggcttgcagggatacctgacaaccagaggccacgtgtggagctgacaatcgacttgtaccccaccaacatacagagagtgctggtgctggtagacaccagcacggatacattctggaagtaaatattttacacagcttggtagctgtgccatctatcgtggacttgatggaccgcttgacagtactgggacagtaccactgtgtagtggacttggccaatgccttctcttcccgagagccaggaatagcttgccttcacgggagggcgacaatgaactttcacagtgttgctgcagggctatagcatagccccaccatatgtcatggtcttgttaatgatactatgctaacctctgattgtcttgcagatttagaagtggcaaagctccccttgcctagaattatgatggtgcggctgagaccaccttccaggcagccaaacgggctattcagcaggcacaagccctacgggtagttgatccagggcacctatttgagctgcacgtgcatgtgaccacagatggttttggctggagtctatagcagcgcatggagtgcttgagaacaccagtaggcttttggtctcagctatggaaaggagctgagctccattattcattgacagagaagcagttagtaactgcatatgctgcccttcaggctcatgacagcatggccggatgggctacagtcatcgtgcagacaacttacctaatagcagatggatgcattcatggaaaatgaccccccaaactgggacgcacagacatccactttagcaaagtggggcacctacttggagcagccaagtatgctgagtacaagtcccgtagcagcagagttgcaagagatcttgggacctgtagtcctaatgcaagataaggccatggggcctgaggcacccctagacctcaagccttcaccgtttaaggaagggcatcctccattccctatggggcatagtacacagatgggtttagccaaggtgctactgctgcctggactgctgttgcactccaacctagtattgacaccatatggtttgataccaggtgtggacaaagtagtcaatgggctgaacctagagcaatgtgaatggtgatcaccaaggaggtgacaactatgataacctgcaccgacagctggggagcttatcgagtcttagccttgtggttaactacctagaagttacaaaagtaactagttggtcacaggcccatatgcggccaggccatgtggcaagacctaggggaggaaggatgaccttctccaaccaggtatgcggatgaacggtaacctgttgctgcctgccccaacacccttaaaggtagggaaataaaaacctggcttaatgtatgaagcaacattagggtaaagtcaccatggggtggttgcctgccataacctggagttgttgttccctgtattactgctgtgaactctgggtccaggattccaccctgtgggcacatctcctcactagaaaaactccctcagcctagggagtggaatgtaaggcctatgtgttaaacctgtgtttctgggacctatgtgcccagagcctatgcataaggcttatgtgttggacctgtgtgtccagggcctgtgtgcccagagcctatgtataaggcctctgtgtcagacctgtgtgtccaaggcctatgtctgccttggcctagggggtggagtgtaaggaaaatggatatgctgtggtcaagaataggccaaggcagacatccagtccagcatgactcagcgagtttggagcactggtgcacaactccactcattatgtaaccatgccacgtgaggtgcattaggtgatcacccaagtgagctcatgcttggatcggagtcactgttgtctgtcaaaggcataactaccctgctgacactgtacatgcagcttatgcccaggtcggcttgcacccaagttcatgcccaggctcacttgcatccagagaaagagtaaagccatgtcaaaactccctatgattccctgagtgttctttcagctacctgccacttgtccacccactccccttggtccttagcttgggctggaatctgatatttggtgtgacatgccccaaaatttatataatgatttaaagaatatagatttatatatgtaacacataattattaaaatcatatatttgcaatgtgtttctttatatattcatatgaaatgaatattttgaaggcttggggggaatcttttgctcattaagtctgctcctattagagtagtaatgggggcagtacctactgaatcttactcccttccagctaagtattattcccaactgataactctttccctgtcttttaagtttcaacaagtaggacaacatatgttgtctttctattgttgacagaggacacagataaaataaagaaattacctttttaaaaaaaaattagaatacacacacacacatatttgctatattttcccgtcaaaaatggttacaatccaaatagtctaagttattagaatatcctagaagaatgcagatactgtagccccaattatttctacagtataagtcattttgaagagtagattttgctatttacgttttccaagattacacaaatataaattcaactcatgtaatgcataattgctgaccatttgaagtattaaaaaggtaaccacagagcagtgatacactctgaaataattcccattaaaaagactgaaccaagttaaactgatttgctccaattatttttattacatacaccttttctaatccttttcattttgatagatatataacttaaaaatttttttgttaaaaatgttttgttaactagttaattaaaagttaaagaaaaaaacacaagaatgtgcttttatctggaggtttcccattaatctctaaaggacaatttgtttctgaagtatatgattcttctattaatcatgactttaaaatatgtacttaacaaaatatgacttgaatgtaaatgttttgagtttcttttttcaatttcttgaattaaatcctgaactattatttctgaaatcaaatttacaagctcagtgtgaatcaattaactgcacttagatcatacttcttagttgttggtagataaatatatatatatatttgtcgttgttgtttaaaggctatatttttgcacagaatgactgtttaaaaatttaccagtttttaaaattatctttcatgaatgagaaaggtaaaagagctaagtatataataaccatgaaatcaaacatttattatacactaattgtaataactcttaacaagtaacaaccatgcatattttacttcctacttcatcaaatggtagcaatactaccactgctaaaacattcagtaaaccaaattagatacttaggaaacaaaataattagctgcactcagataaaatattaaaaatatgccataaaagatgcaaatttaattgcaagaacagtttctattccatttcttccagcaatgcctgaggcttattatcttttttctaggtctcaaaatggcaggaggtaaccaatgcttttggtagtaaaatataatagcaggatcccaaatttaaaataggataaaaactatttttccaatagtggcattactaacttggaagaataacaactaacaggatatacagtgagagatatagatatgtttatatgtgtatgtgttacaactaaaaaacaaaacaataatgaaacttatgtattattttaaccatcctatatataatattctttagagaataaacatctttttttaaccatataacattagactcatttataaagacaaacaaaaacaaggaatacatttattgaatggaatttaaacatagttataaaattgcaaaaactccctttcctggtaggccaggtgattgtaaatgttcgcaacaggagcattacaagatttttaggcagaacaagtcctcttctatgggagtatccctggccccacccactaaatgccaccaggtttcactgtgacaatcaaaacaccctcacatattttcaaaaacttggggtggggagctggtaggtgtcagagggtattatatcagcccctggctgagcacatgatcgctcccaggtctcagaatggagcaggctgaattcagtaaacatggtcctaccatagtagctctgtgctcttagaaaaattccctctctatgcctcagttcatgcttctgtaatatgtctttttcttagcaattgtttgcaaacctcccagaatcattgtatgggacaaatgagacattcacaataaaacagctttgtaaagtatcaaatgccatccaaaaattataacattttgtttcatttaacaattatcctatgctgtacttttcatgtttgattagagaagatttgaggttaaaaaaaaaaaagtatgcattactgtttaatttggacacaagtatactaatttggaggctgcagttttttcagttatcaggacagaggcaattttaatctttgaccctgtgctacggccttaatgaggccacatagtcacctgctggtagctccagaggtgaagaaaaagaagctggtacttagtaggaatttaataacctctttaggttttgttccaaaaaattcagtcttgtttaagtggaagcaacaacaatatgcccattttaatttaattctatagatttaggaaattacagattttcccattccatagatttgttttcaatatttctaaacacatatatattgaaaaacatgcacagtatattgctatagagggtatacaaaaccctcccatttcttcattactgaagttgaaagatcattgcttgctctcctaagaggcttataaagctgtctaacttttaatggcaaatagcaacatatcacattctgacttgctgtgaacttgtgccatataccttaagggtgagaaaaggtggctgtcactttatacaaagaatggtgcttctataatatagtgacagaattcacagtgcaatgcatgatattgcaagaattactgaaaatgactcaaatttagatttgatccttaaaattgttttttaccttttaaatgtttaataaatatgcattatataagtgtatgtataaatatatgtatgtaaataatatacattaacgatagtacttaggttctattttctacaggaactcttatttcatagcattaacgacttgatatcattaatagtttgtcagaaagctatagaatttacattaaaaaatattcaggctgattgttcaatttaccaaatatgtttgttgctatttctgcatcacagaggctatattcaaatagcctgaaatcaaatataaaattataattagattaacaactacacaggtaacttcccaatgtgtttttaaacaaaaataaatcacttaagatgagtgacattattcatattctaaatctactattcatataattccccttaaatttgcttctgtaactcttgttaaaaagtactgaaaatggttttagaaatatctttactttatcagatttataagcattcattatcattatcaaattttatcagtttatatttatccaagaaaagccccagtacacaacgttttagtatggaggaataagttcaagagttgcattgtacaacatggtgactatagttaacaatgtactgtatttttgaaaactgctaagagagtacattttgtgttctcaccataaatgaatgatatgtgaggtaatacatatcttaactagcttgatttagccattctacaatgtttacatatttctaaataataggtacataacagatatatacaatttttatttgtcaattgaagttaattgattttaaaaagaaaagctcagcttatatataaaaatgatttccagtgattgccttacaaatataatttcccatattttacatcaatgaagcaattccagattcatacacattccaattcacacacatctacactcacagcgtctcatgcaaacatacacacagagagctttttaaaataaaacctgcagagtacatttcaaccaaatatgtctgggggaaattaaactgggaaatggagaccattcatggagtctcagtgcagtagcaaactcttcacttctacttattcattctgtgaaagccgtcatacatctatgtccactgatccacttgcatttggcataggggttggtagattatttattgaagggatttatgtcagactgggattaagatgtcctaagaattcccaagtgtgcaattcatcacaacacaatttagagagtgaaaagagagccacaatagaccttggtagcaaagtggaagtgagtgataggtgaaccgaagcccccagcttgatctaaagaaagcagacaacatataccaacggtgtcaatcaaaccgcctcataagcagccccatgaatataaaatagggaacaaacagattggtttttctttccttgttcccaacagttataagaagatagattccaacactaatgagcttgtttttgtatatatgccagggaagttctatctctaattttttcttataaccaaagaaacaaaaacacgcatttttctgaaataatggaggttgtgaaatattttatttttgccaaattgttcccctacatagccggtgccacatttttgcgctgtgtgaatcaaataaatcttgcctctttgtttctaaaaattaacaaactgaagtatatttttggtactttcagacccacatttataacacaacctaaaaccatccccaatctaagtgtgaaacttaaatcatcatgttaaacttagatttaaaaaattaaaaagaactgctaacaataaagcaaatgtcactatgtaccagaattctttgtggaggtcagtagtcaagttagtcaaattttctcaacttaaatataaaagctatatttttcacagaggctattattgataaaattatggtccccaacattagtgcctggcaaatggcttgcactatagaagtatttgttgaataaatgaattgagggtaattaataataagttcattgttttatttattaagattagttcaaaacagttctccttaaaattatgctgaatttgtaatagtttgaaactaattctaatcttatttgaagtatgcctcatttactctatttattggtctgatatgttatgaatgtattggaaaatgtcactttcgaaggaataaacatctctggaaaaacggtaacaatattgactcttcaggtctcttggattggatttcagctaggaggtgggagttcagactgtctcccatgccagagaactataaccagtaattgttaaccttgatctgtgacttcagcagtaaggggtcatatgagctgggacttagagataaagttttagattattggatgggtgtgtgcaggctcttcagaggttactggaaattgcactgtgtctgggtaaaagggagacaaccagactccttcatttggaacatggatttttgcagaagtgtctgttagttcagcataagtatcaagggatttcaaaacattcatgccttctgagctagtaatttctctctgttcctaggaacaactccagttaggtaaggggaaacgtctaatgcacaaacatgttcaacaaagaattacctcaccattctcctgttgtttcccttttttctattaaatttgaaaacaagaaacttatgaaataatatagaaatgctcaactcatgtttgtttaatgaatgggttaactgcttaatatgttaggactagaacagtaataatatatgcagtagaaaaaaatacctgaggttttttatgtgctaggcactgtgttaagagctttaaaaggattttcccatatgatgtaatcttcacagacgtgctataagtagacctatttatataaaacattattgtttatatgttttcattttctatctgcacagtatctcttctttgataatagcacctcaatttttatggtgaggctccttctagaacactctcaatcaatttcccttgggacagggggattctttttaataaaagttctttttttctttttcaaatattattttaggtccaggggcacatgtgcaggtttgttacatgggtaaattacatgttgcgggggtttggtgtacaaatgattttgtctaccaggtagtgagcacactacccaattggtagctttttgaccctcacccttcccccaccctccacccttaagtaagcccctatgtctattatccccgctttgtgtccatgtgtacacaatgttcagctcccacttataaatgagaacatgcagcatttggttttctgttcctacattaattcacttaggataatggctgccagctgcatctgtgttgctgccaaggacatgatgttgttcttttttatggctgtgaagtatttcatggtgtagatttaccacattttctctttctaatctactgttgatgggcacctaggttgattccatgtctttgcaattgtgaatagcaccacaataaacatacaagtgcatgtgttttttggccagaatgatttattttcctttggttgtatacccagtaatgagactgcttggtcaaatggtagttttgttttaatttccttgagaaatctccaaactactttccacaatggctgaactaatttacattcccactggcagtacataaacgttccctttctctgcaacctcaccaaacacctgtttttgttttgttttgttttgttttgttttgtttaatttttaatagcatccattctgactggtatgagagggtacctcatcgtggttttgtttgcatttctgattattagtgatgttgagcattgttatatgcttgttgaccacgtgtatatcttcttttgggaagtgtctgttcatgccctttgcccattttttaataggcttatttgctttttgctttctaagtcccttatagattctgaatattagaccagggcaggagaatttagccagaaggcatataaccaggactaatcaacactctatcatcttgatccaaatgatggatataagaataatcaaggggcccaataaaggttgccagatctagcaattaaaaatatgggatacctaattcaatttgaatttcagacataaaatgaatcattttttaggttaagtgtattccatgcaatgtttaggtcacactttgtttacaaaatgattcattgtttatctgaaattcaaatataattgatgcattgaattttatctagcaatcctacaaggggcaatgttaagactcaatccaagacttatactcaatcattgacaagaagtatttcattttttccttgcagtagataaatttgtagaacataagcctatagttactatgtgctatcttttattcaacatggggaaattcagcctgggaataaaactttcacagagaatagcagagtcaaggttcatgtgagcagatatggatgcattttatgtcatttgagcagatatggatgcagtcatggctgaagccatttgccctttagactttgtctgaactggcacaattcagtttatgttacaatacattttttattgaaacataacttttatttatgtcacatgggactgaaatatgctggtataatatgccattattatcctcataaatgatgaaacaagtattgccttgatagatttaaggtttcagagcaagtatgtggtggatttgggaagacaagaagtctaggtacaatatcctagttctttttttttttttctgagatggagtctcactctgtcacccaggctggagtgcaatggtgcgatctcagctcactgcaatctctgcctcccaggttcacacaattctcctgtgtcagcctcctgggtagctgggattactggtgcccacaccacgccctgctaattttttgtatttttagtagagacggggtttcaccatgttgaccaggctggtctccaattcctgatctcaggtgatccacccaccttggcctcccaaaatgctgggattacaggcatgagccactgcacctggcccaatatcctggttcttaagtaatattctagagtgtttttcaaaaagacaactatataatatgataaactgcaagtaagtctttaaaaaatatttacacacacacaaacaaaaagagagacaacctcttgaggagctagtcttgttgaggctggcagagtacaggatcccttgggtatattcttaaggctgatatatctaaggtcagacaaggtcataacacttccaagtaaaacagaagaaactcagctctccttcctcacctgtttgtacttctataaggctgtactttttcttgctacaaaacacccactagatttgaaatgcaagctcactaaaagccaaaaactaaaacaaaacctgctttcaattaaataatagaataatgcacacctaaaatacaaatttgattatgccactctcctgcttacaggcaaagtacactttctctatgttgaatgtaagaattttaattttctgaccattgtttactcttctgtcctcatcttttgtcaatctctgctggcacctggctgacttgtcacgctgaaattctggcagctgtgtacagactcaggcttttttttagcctcaaaatatcctacactgttctgtgtacctggaattccctgcttaccccttttccacctgtcttcatctactcaggctactataacaaaataccacaaactgggtagcttttaagcaacagaaatgtatttctcacagttctggaggctgggaagtccaagatcaatgcaccaggagattcagtgtctggagagggcatgctttctggttcatagatggtgacttcctgctgtgtccccacatggttgaagggactagccagctttctggggtttcttttataagattactaatcccagtagccaggactctaccctcatgacctaatctactcccaaaggccccactctttaataccatcaccttggggattaggatttcaacatgtgaatttttcaggggtgtaagaattcagtccattgcaacactggaaaaattcctactcacatttgaaaagtaaacttacctacctcttccgagaaagcctttcttaatctattacaacccttcctcagttggtgagatagtgctcttctatgtatgatacaattcaatagttaagatgcctatttcatgctgtattgtaccctctcattaaccagtcatttggtgcaagtttccttcggggaaggagcaagcccatgcgcaaggtggctttttttttttttctttttggcttgagaccatcaactgttaaaaatcccagcagctgggaaagtaaggacctcaatcctcaaagaaggttctgagtgagcaacatagcacacaatatccaacttggaagttatggaagtctggaataaaactatatcatcagaaatcagaaaaaatactctataacttaaaataatgggcatagttaacacatccatttaaaataaaaagcattgtaaatgactgcagccaatccatacatacaatggattctgtttacaatgtatcaaaattattacttgtagcaagttaaatatcaagaaaatcaattaactcttcatttcctgataagtcttgtgaccaaaaataatttacaaacctccaaaaagttaaactattatgaagtaatctaaataatataattcatcatttcagctttatcaacagtctcttccttttggtgagacattaacaaaaagaaatatcatttaagtcagcatctcaaagaacaattaattcaaataaagtttaatgaaagcatttagccatatgttgaaaccaacccaatagtcccatagagagtttttggctaaacagagaaattgaccctcctggtcttaaagcttgaaatttacatttgtcttacatgagtttcttcctcaggaaaggaacttcaggcctctccaaaaaaatgatgaaagaaatgaaactcaccagataccacacccagacaagacagaccgctcattcatcataatttcttccttggccctccattattcctgttttcttacatattggttcatttcttccctgctatacaaaaccctagtcttattagtcagggagataggtttgaagctgaactcccatccccttggctgcagcatcagattaaagccttcttccttggcaatacttgttgtctcagtcattggctttctgtgcagtaaacagcagaacgcagaccaaaccgcagggtgtttcagtaacagtatcagaaacataatagcaagcaagaaatcttgtaatttcactccaaataaaccattccatgaaaataaatatgatttcttagaaacttgaaatatgatttagcaataaatattacctaatatataatataattaagctctaatgtaggtcatgtatgagttcttttataactattttttaaatttttcctgttacactttatttatcatgttctaatatattaagcatttaaaataattttaattaatacttctttaaaattcaatgccatagtcttttaattgtttcatatttcttattgaccgtgatttcttcttttatgccaaaatctccttgacaggaattattttcttaaatcactaaaattcagaatttgctttacccaaaagaatgtttttcaaattagttctaccagtatttttgcatcttgtttttatactgagatgcatttattctgatatgccatagaaaactctatgcaagaaaaatatttcccagaatccaattcaatttgacatgaaaaaaagacacaaaataaatcttaattgtgcctcagaaaataatcttaactagtcaaaaatcattttgcctctaactgagatctttctgctcagtttactctgtcactttatcacagatttcttggccatattgtctaattacaaaaccatggctcttgtttctttatacagagacttgtaaatagtcaactcaatggaaaaaaatgcatcttataagcctgtggtagaaataatttttcacaagtggtatgtcagttcagcatcaatttgagaagttcccaagcctaaaacaatccaatggagagctcataagaaactagaaattagagcccaccaaaacaaagattagcaaactattttcttgtatagaacaaaggcatgactttgcaaagcactgttgcattaaaattctgttctggaaattgtttttattcacctgacattcactcctctttctgttttcaaatattcattatactgtttaactttctcaccacacaaagcaaatctttctggacagagtaatgacaatagaatatgaagcagtttatcaaaatcaatttggtttgctacatattcatgagatattttattataactactccaaactttccttttttcaaaaatcaaactgctgatttattcttttttctgaagcattctgaagcttaaagcatcaccataatgagatagtttgctcctaagaagggttccattttgtcaagcatttcagctatccaaagaccaagacgcctagcaaaatcaagtagctaaagcacaatgaatccaagaggaaagaccaaaaggacagaacgtcctagatagcaaagaaacatccataaatttttttttaaaaaaagtaaatatatctgtcaaaaaaatagctatacattctaaacttgatcttcaaattgctgttaagcctaaatccaaaaaaaaaaaaaaaaagaaagctggttaatcctccaataattatattttctacagatacagtgttgaagatgtttttaattacattatatgtcattctttttatgtcaaaccagtggagaattaatgtatagttgccaaatttataaggtgctgtttcctttattttcataatgtctttgaccaactccattaacgacagaagctcaggatctttttattagtatcatctttctgactgaccaagcttgtgagtaaatttttaatttgtttctctcaagcacctttttcctggacccttaaaacaatatactttgaattaattgcaagtcatacacacaaggtgacagtatcctgaagctgtaagatttaaaagaggacaatcaactaataaagataaacagaaaataagatgttttacttcgtgttacattgatgtctgttgcatcctgcctttttaaaaaaaaaatatatatatacacacatatacacacacacacatacatatatatatatatatatatatatatatatatcaggaaaacgactatgtctttaggatataaagaaatttcacggctatgtccaaataaattcaatccatttccaaagtcaactaaaaagtttttttttaatgaaagagaaatagaaaatgtcaagtagaactataatttcagcagttatacagcagtcattatactgttgccaaaaactgaagatctatcaacattcatggcacagtttcacacacacacacacacacacacacacacaatctttatcatcataattggtataggtctaacttaatttaaaataaaaacaaaaataaatttaaggttattaaaattcagaatagtttcaggggtaaaatataccactaatactccattttgaaaactacttttcagctagtttttcatcattctgtcaccatcatcatcagtgacctacctacatgtactgaaattttttttttttaatgtgggaggcactatgtagggcttcaccaagactacattatttatttatttatttatttatttatatttttatttttttgagagggagtctcgccctgtcgctcaggctggagtgcagtggtgcgatctctgctcactgcaagctccgcctcccgggttcatgccattctcctgcctcagcctcctgagtagctgggactacaggcacccaccaccacgcccggctaatcttttgtatttttagtagagacgtggtttcaccgtgttggacaggatggtctcgatctcctgacctcgtgatccacccgcctcagcctcccaaagtgctgggattacaggtgtaagccaccgtgtccggccgactacattatttattatttaactctcaggaaaacgctttcaggcagacactatttttattctcacttaagatgtaggaaaacaggtacataaggaggctcgctctcttattcaagttcagacaactggtaagcagtgagcctagaatcaatgaagacagtttccctccagaccaagaagcagtaagcctgaaaacacagcttctcttaggaaacagcaaagtgatttgcagactttattccagattgttttctatttgataatatgtcctggtaaaaataatgacaccttactataaaataggagtgtagaacttgtctacaccacatatttgtagatttttttaaagttataaattgattaattaccaggaaggaagtacagaaccaagatgagtgatctaacttctaatattgactaaaaatttcttttctctgtagcagctgaggaatagccacaacataagttgtgtgttgtgatactatactaaaactcaagaaatagaagtttcttaaagcttgtaaagtttagtgcaatgtggaatcttaaactctatcaataaactttattcctttattacattaaaacacactgatctatctactcatgcattaattaaaatatcaaatagttatgtattttcattaatttttaaatatttctatattatcaaaataaaaatattagcctatatttaagagaaatgagcatatgtggctaagttttgcctaaatggtcttcatgggatcctccatttaaaaggcagcttcttttctatattctgtgatgcaagtattaattgtgaattataaaaatttatcaaaaagatgttattaaaattaattcacttgtacagtggtatagcctaaggaatttacaatggtctgaggtagctacctaataaacacttgtctaaaatgcattaaaagtctttgggattgcaatgccttgagacctatacaatctgaattcatgcagaaaaaagtggcacaggtcaaatctctgctacttagtaggaaataatttgatagtttgtattattgacaatcacacaacaatatagcatactgcataaaattattttacatattttctaaacttggaaataagcataattggttctacataattttttttcaatttctgtatcacttaaatgaagacatcatgatccattccacatctacatttctgtttccaatattaacaaaaaatcattaacttaagaatttttgctgtttatgtgtgacatttaatatataagaattaaaaggctatccattatctattgtatttatttataaacaaagaattgtagtctaattctaggtgacattaagttgtgttttaaccattttagaaagattttcaaaggaatgtcattttctttgaagagcaaagacctagtctcagctttctgaaaagtttaataaactagaaaactgtcataatagttaaaataactttaaatttatacatgcttaaacaaaaattacaagcttgactcaaatttcaattacatttaattatgaaatatctaagcacatttctcatctatgccttatgatttagttttatcttattctgatgagaacaacatttaaatatcagtagttacaggtacctaccaaagaacagcatattcatgaaaaatatttgagagttagaaaaacacctacaggttttcaacggattttatacttagaatctttataaaattattatttcccttttgcatgatacaaagattattgtagattcactgtttttttccattaaaaatagaaagtatagcttttgacaacagcagaagtcacaggcattaataaaaaactgcataaaattagaaatagtgatacttggtttccacttcaaaacagagggcacgcagcaaatctttaaacatgtcaatatctgttaacatctacgaaaatgttcaggcattgttgtcaatcaatacaaaaaataatctgaaaataagatacttttgagaacttaattatgtaggtctgatggaaatcaatagattgacggtaattattttttttaaatccacaagatgcaggagttatattcaaatatcaatgtaaatctactttaagaaattcgctgcttgggtttaggtggatctttactgtgtttggttgaagtcaaagcacatctttatgttatagatgacaattttgttccaccagcatttctcaaatgttttggtctcatgactcttttacattctcaaaaattactgaggacccaaaaagcttttgtgtatgtgacttatagctagtattatttactgtattagaaattaaactgagaaattttgaatttactatttataaatcatttaataaaaataaccccctcatatgagtaataatatattttaaggaaaaataactggagttttaaaataagatgagtggcagagagctatagtttgaaaacaaataaatattttaatagccattgcagatagtgctggaaaatcttttgtgatgctacaataaaactcgagaaacagaaaagtttctttctttcttttttctttttttttttttttgagatggaatctcactctgtcaccgatgctgcagtgtagtggcaagatcttggctcactgcaacctccaccacacaggttaaagcgattctcatgcctcagcctccagagtagctgggactataggcgcgtgccaccatgcccggctatttgtatttttagtagagacagggtttcacgatgttggccagactggtctcaaactcctgacctcgcatgatctgcccaccttgggttcccaaagtgctgagattacaggtgtgaggcactgtgcccagcccagaaaagtttgttaaagtttttaaggttttgtgcaatgtggaatcttaaatccgatcaataaacttttcattctttgttacattaaagcacagtggtctatcttacacatggagtgtatattctacacacatgcatgatttgtactctgccgatccactgaaagggttttgggtactcctcaatgtccttggaccacacttttgcgaactgtgttacagtgttttaatagagaaaaatttttaaacactcttgcattatacacatatcaaaaaaatatgatgactcaggactgaatattacacataagactcactccaaacacattttctacagtagattctctaattccgattgagctatgacctggctttagatttccaacctcagccgggggcggtggctcaggcctgtaattctggcacttaaagagaccgagatgggtggatcacttgaggtcaggaatttgagaccagcctggccaacatggtgaaatcccatctctattaaaaatacaaaaaaatagccggcgtgatggcagttgcctataatcccagctactcagaggctgaggcaggagaatcgcttgaaccagggagatggaggttgcagtgagccaagatcccactactgcactccagcctgggcaacagagtgagactccatctcaaagaagaaaaaaaatcagttcactgttaccaaaaaaaaaaaaaacactacgaattcagatagcatattaaaatgatttcaagataagtaataaaatattttctataatatttctttttgggtaagtaatgatgattttgacatgaagaaaaaaactcagtctgaaaactgagcagcttttgtgactagtctatccgcttaaataaaaatgaaaaaaaaaaagagcttccttttaatctatataataccaaaggtttttaccagtttgtaagaaacactagccctaattaaaagtaggtcacattcttttaggtgacagcagaatattgttaaaagaaaaaaataagcaaaatggggtttctgcaggaggcaaagagaatacatctgttgctcacagaatccaaataaacagcccaaacatgctgttcaaagtgaagacagtagaaagtggaagccccaagaagagttactactgtatggcagggatttagatgatgttcagccagaaatgagacttctgagaaggaatttctaggataaaatgcccagaagctgatctgatccacagtcagttgagaccggggcagccagaaagaactatacaagactatagccatattacatacttacctgtaactgcagtcatatggttttccatactctatgctattagaatacaaggagactcaggacaaacaaaactagcttgtcctgtttctagcttgagccacaggaaagtcttcttaagaccaagagtattgggagcaaatgaatgaaggttgttctactccatggatcaaatgaacttcctaattgtaacagaagagctatcacgaatgctttctcctcttcgaagacttccctgccatcctcaagacacataactgcctactgcttttgactttctaatacaacacttttttttcctttaacatgggctattataatttattataaagctgagctcttgagggcaggaatcttttcttttcttattcattttttttatcccaagcatgtaatatagtacctaccacatactaggtactaaataattataataattgtttcttgaatgaatgaatatccaaataaaatcaaaattagttttttttccagaatattatatctttagctttattttttctttctttctttttttttttttgtttgtttgtttgtttgtttgagatgtagtttcactctattgcccaggctggagtgcagtggcatgatcttggctcaccgcaactctgcctcctgggttcaagggattctcctccctcagtaactgggattacaggcacatgtcaccacacccagctaatttttttgtatttttagtagagacagggtttcaacatgttggccaggctggtctcgaactcctgacctcaagtgattcacccaccttagcctcccaaagtgctgggattataggcctgagccaccgcgctcagccagtactttgcttctaatgttttatcttaaaatgctaaattactttaatcttgttctaaaagaagttttgtacttccaaagcattggattccaaaacataaaacctccaaaacgtgctatacaattttccattcttctcaatctgccagtcttaaaatttgtttccccaaggtatccactagggttgaaattaaacatactatatattattttaaaagtcataagtttacttatcctagcaaagcgattgacatacaggtaattttcttttctcttttacttttggctgtagaaagcaggaaagacagagagcatcagggcatccttgcactttagatgcaatgacattcggtaaatcatacctcaaaatggtaataatacatcctgtttcaggctgttgtatggattacagtaaattcatgtcaggcatctgggtcatgttcagaatactatcaggccttttgtgttgttttttacatttcctggctagtccaggacagcatcatgtctcacttaaaccgctgcaatagcttctaattggccttcctgatttcacacttgtcaccccagtctccacaaaggagccataatgatgcttctgaaaatgtaaatcagatatgccacgctcctgcttaaccccatccaatggcttcccttggtcctgcctgttagggctgacatgaagactccaccccactccaatttcatctcctgacgtgacattcctactactacatcaccagcctccttgtggtgccttaaacatgccaggcacgatccagcttgggcccttcctacatctaaagatcccttgcctggaacgtgcttcccttcactttcattactttaggcctctgctcacatacttctttatcctctcagcctcattccagtcactatgttttattcactactatttgcccaagatcgacagcagtgcctgatacactgtgagccttcaaaaatatttgctgaataaataaataaatatattattgataataattccttaaaatcctagttagcatgcaggagaactgtaaaatcatgggaaaacatttttctttatcagaaacttaaaaataagaatagctaatatttggccgggcgcagtggctcacgcctgtaatgccagcactttgggaggccgaggcgggcggatcacaaggtcaaggaaacaagaccatcctggccaacatggtgaaacttcgtctctactaaaaatacaaaaactagctgggcgtggtggcacacgcctgtaatcccagctactcaggaggctgaggcagaattgcttgaacccaggaggcgggggttgcagtgagccaagatcgcaccactgcactccagcctggcaacacagcgagactccgactcgaaaaaaaaagaaaaaagaaataagacagaacttatttctcagtcagcccagacttgatagctcataatggtctgaggagatgtagctccctgtcttaacagaaactgtgtgaactgctcctgttcatcaatcatgtagtggctgtttactcgtccccaggccacatgtctctccacatagcatctgggtcttcccctcagcaaagccaaaatgtgcgatgacagatgaaatttctgcttttatttggatgtgaaattcaaacctaagttggaatgccccactgttggaaaacaaacttaaatcattcatgaggcataaattttatgtctagtttatccaattgaccaaaaaaaaatacatcaactatttaatgatcatgacgtaaaggtaacacttggaattatataaactatcattctctttctctctcaactttttctaagggttttcccatttacacattattttttgtccaagtgatcttactactttgttgagaaaaagggtcaaatgtagaaaataaactaaaatgacagaaatattaggaaaattaagaaacaataagaattatgaacagaagtgtttaacaaagaaaacattgtacagactttgccaattatgaaattaaatcactctggatgcagcaaggaaataaagagagaaattgatagagtagaaattaagaactaggttgattgccctgacaaaggtagctgaataactttaattctctgtacttcaaaagacttattataaaattaatctcaccacgtagattatccttccaactcaagttcattgaattgcggtgttaaatctgaaattctacctactacctaccagaataggattcaagaattccaacaatctctagaaaaaatatgcaaaattttgtgcagacatttaatattcattttactcagaaaagttgcacatcttatatgaatttttcaaggcaatttatgacccaatacaaatttagaaaaagcctattcaatagaattggcatgaatcattgatatttatatattttacacatataagtttatatggaagacaagttttgtaaaacataagaccaagacttttctttttgggacgaagccatcctactacctagaggaatgtctatccaacctctattagatggcagtcttaaagttgctggtttcagtcattttttgaaggaagagaggtattgcttctgatccctattctcttttaaaataacagaatttctaaaatggatgtcaataacccatttaattgaatatcaatgcatattaatcatgtttttcaatgcaaatgaaaaactttattaggactaaggcctgtagagaaactaaaaactaaaaggataatagtcatctattcattactcaaaataaaaccaattccaaaatgtaaagtccatgttaggaaacctaacataattgtattttaattattttttttgaaatgtatcaaataggaaatcatttaaaacaaatgtcctaggtagttgtcaagtttgcttattaagttgtcagcccttcttggacttcttttgcaaagcacaggtgaataaccatcttatttatggcaaagtaactgtcataaaccaaagactcattgactttcattgattcacaaaagtactaacagcttaaaatgtacccccaacatcaccacggccacctctgctgctctatagccaccatttattgagggctgactcaactctgctgggcatttcacatctgttttcttatttgtcctcacagcaacccttcaagaaaaatattgaactggagctgcattttagatgaggtaagcaattatgacatagacttccttcctgggatgaacacttttcctattacccatcccttctagagaaaggggaggactgatttaactttgtagacaggtgtgcaggctctgagatattttgccattctgctaacatactgactcttcagagggatcgattaaaaagcaattgagccacagaaccattggtgtcggcctcctgagtacagaagaggagggagctcattcaatcgtgcattatattagaaattagaactgatccatagatgaaaaagcaattaatatcctataggaagaagaaataaatactatgagatcagaagagattgatcctataatattagacctagaaagtatcttagcgactgtttttcttgcatccttcaattaaaggctatattttatatttctgtactttattatctactagatattttcaacatttccttctaaaagaagaatcaggtgaatcaggcactgtgcccagtttaacttgtactataaaagctggggtagaaggccttccctttgccttatataaaatacagaaaaatattagaattcctatttgcacaaggacaaacaatgattttatattaccttggcacttattacttatccaaagtcatgttagtaatttaaaatatgttttaaaatcttggatacagattagtacaactgaaaggtgttattatagagatcaatatagagcctagaatatataaagttgaaaaataaaacaataaaatggtatccattccccactatgtgagtgagttcaaatttatccattctcaatgagttcaggaatttcagtctgaaagaacaagtcttcaaggttgggaagacttgaaaacaaatctgctgaaactattactatggtctcaaatgattcacagagagcagaaaagaggctttaagagccgagatacacaagtgcaactgatctgaaagaaatagaaaataaattgtataatgacaaagttgacaacttggtaatgattttgggcaaggctctacactttgggccctgagaagataaaacagagtcatgtatcagattagtgattagtttaggaagctattaaaatttcttccaactctgaaaatatggacttatcagtaatagtgactagtttggattctctggataaacatgtccctagaatgtagaagggaaattccttggactaacatagcttaataattgcttgatagcagtacagccgagtagttaagagagttactctagacttgattaaactgacttctgctctgctacttattccaggttcataaaccattgtttgaaaccttaaagccagagattttgcaatttggatgttttttaactttagaaaaaactacagtgaatagtctatatattttattaacattcccagtatccaatactcaaacacattatttctacagtgactattcatactaagtataataaataaaggctttatatatcctcacctcaatttaggtcagattgtttgcctctaaaatagctcaagtctgtggagggtagaattctaaaatgaaccccaagtgtacatgtacccccggctgtacatgtcctttataacaatcccctaccctagagtgtgcgtggggccagtgaatatgatggacatcattcatgttacattatatggcaacggcaaagggatttttgcagatgtaattaaggttcctaatcagttgatattgagttaataaaaaaggagattatctcaggtggacctgtgctaatcttatgaatgctttaaatgaggatctagtagtcagagactataaggaaaataggctttctcctattgactttacagaagcaagccaccatgagttttacagctgccaaaaagtaaattttgccaacaacccataaacttggaagaggatcccaaacctcaaataaggtgataataggctgcctggtgagaccttgagccgaagatcctgtcaggtcatacccaattcctgacctatggaaactgtgaggtaataaatggccattgctttaagctgacaagcttgtggtacttggttatacatcatggaaatgcatggtaattcaatccaaggttagatcaccttttgttaacaattagttacaaaaacattttagttcttagagatttctgaattttgaaattgtgaataaggaattgtatgcctgtgattgtatgacttcatgaagtatttaattgctatgagctttagttttctaatctttgaaagagaggcagtaacaacacctacctcacagggtggtggtgagaacttaataaaatagtgtatataagatacttgatataaaacatgaaaccaccatcccactgcaaacgttttattattattattattttctaccctttgctctaaaccagtgatctcaacactatagctacatgttaaaatcaccaggacagctttaagaaatagcagtgcctgtgccccactccatatcaatcatactgggatctctggttgcaagaccagtaccaatgcagttttaaaagctcctaagatgactctaatgttctctaagaccctaagatgactctaatgttagcttgagaatgactattccatatatgtcacagaaaatcttggctttttaaaaaatttggtagcatttaatgggttttctgaataacaccatcaagaaagggaatattcaatttttaaacaagctttgccctccactttacataatgaattctttccattatatatccccattagattagtctagtagatatgggtttactaggtagcttcttacagtgtaactccttttggagaactgacaaatcacaggcctggctcccaaaacaaaagacatcaaaccttgtatcccaaatgcaccaaacgcaaggccctttcagagcacctcactttccttgttccctgcataatgctccacttgatttctactctaatgagactgaagatagaatgcacactggtcaaactataaatagcagtagaactctgacccacaatctatgaagcaaccaacctagaaagacaatttacacagaatagtcagagctcgatcacagactgccaactcccaattttattatttcttatttttttggtctctgcttccaactcagaaccaaccagaaaatctaatatgctcctcaaactaatcacatacctagttcacctcctaggtgaactagttcatgttctcatgccaacaatcccaatcagagcacacgtagagccttctttctctgcctttcccacacttctggtttactttttttatttttattttattttattttattttaatattgacagggtctcactttgttacccaggctgctttcaaattctgggctcaagtattcctcccttcttgccctcccaaagtgctgggattacaggcatgagccaccatgaccagcctcctgctttactttgagtctctaccaaatgcatgtgatgatggctgctatggaaagctttgaataaactgctctaatttgtatggttttatttataattgccacaaaaatgtaggtgaaggaggaacatgttcttataagcacagctccaattcctgttacacatttttatctattcatgtaatttaactgtgaatgtttaaactttgtgttggagtataatatccagaaaagtgcacattaagtataaaacttggtgaattttcacgaactgaaacacctgtgtaattagcaccaggtgaaggaacaggttgtgactagagtccctcctttgtgctcccttccaggcaccacagcctccccaaaacaggtgaccactatgctgacttctaacatcacagagtagattggcctgctttatatttaattgaaatggaatcagagaatagtatccacatttggtgtctagtttctttcattcaatgttatgtttcagttttgtccttacttttgtatgttttccttgcaatgtgacactccagtgtaatgaatgcttcacaatttatattgggttgtttctagtttggagctatgaaaaattgtgatgcagtgaacattctagtacatgtcttttgccaatctgcacatttctgctggaaatgtatctaagactgcatatgtttcactttgataaatataaaaattattctttaatttaaaaaaacgcgcaagaatcatgtattggtcctcaactaaaactgaagaaggaatttggtagccaaatgggtgcaacctgaatcctgtattttctttcatggtaatgctattttaaaatattgcattaaaaatgtttatcctacaaaaaaccaacattgcagatattatgccattttcatttcttctagaaatacacagactatcttatgtaaaaggtaatttacatctactggaaatatacatatctctgagaataccagtataagaaaagcatccttggctttctttttgtgtaatataaaaagagaaagaagcttggattttaggaaggcttgaactaagcatgacaaacttctcccttatataagctgcttgaggcaggcgccaagtcagattcatctttatagtctcacatctgtacctctgatacatgaagggtttggctcaatgtttgtggaataaatgaatcctcaaaaagccatgtcagcaaatgttcctcttgaaatgttcttttaatgagctggtatgacacttgataaaattcattaaatcagacttcctcgcccttccttttgttgtttgtgcttcagagctcagcactgggaacctgccctcaagtcctccccttccagggaaggctggaaagggcttgaaccaaaagagaaaagaaagcaaatgtttacatttacctgctctgggaacacagactgctcacctcagcattcaaataagtgccctccaaccccaaggtgggatggagagagatcctgttgtattatgaatgttgctactataaggcataagaagaagcaataggaaacacagttgggccactgaatctggcagcttccagaggcctcagaacattcacatttgcagctgcattaactgtgcttgtttagtagctgacattcaccattcacattttcaaagagctatttagatcgaatttcaaaggtatgttttgaggggaccaaacacatagcaccatggtaagctacctcaattttgtagatttttcataaattgccattaaaaaaaatcacattgtatagtaagtagaaatcagcctcagaggaaaaatgtactagatcagatttttttaaaaactgcccttacatttattatgcactttccctcttcacctcacccatcccatatggaaagaacaaaatcataaaaacattaaagaaatagtatcaccccaaattccaccactgtagcccgataaatgtttacattttttcctaattcttgtaaagtctttgttcaaatgcacaattagaaaaataatggtaatcatgatattacaattgatctgaagtcatgttatgtcatagacattttacattttactcttccccaaggaacactgaccatattataaccaagtcttcataatattagtttttaaattatgtaataccctacccacaataaactgtcattctattttattactctgtgacattttgaccacagaaagatttttactattccatctttgtggctttttagtatttttcctacttttaaaattattttctgagaataaatactcagcaataggaatacgagccaaagagtatgtgtatatttattgtttttaaaacaaatttactttccaaaataatttttgccagttttacaaatttaaatagtcagaatactaaaatgtgaagaaatagcaccccaaattaggaaaccattctaatttggcttatacccatcacattgctaaccaccatctataaagatttgtctggataatgctttcgttaaatgatgcatattttaaagtaacaaatgttcgcctttttgtactgctggcaagtcagaaaaatcatccattttcaacagtagattgaggtaagatttccatagagaaaaagagtaaaaagctaaacttagttgaaaatagatcatatgccatagtttgtactatgggctttctcagtatcatctaatttaatgctgcgaagtaaataataattgcccctgtttttacaaattgagattctaatattaagacttggttggccgggtgcagtggctcacgcctgtaatccaagcactttgggaggccgaggtgggcagatcacgaggtcaggagatggagaccatcctggctaacactgtgaaaccccgtctctactaaaaatacaaaaattagccgggcatggtggcagatgcctacagtcccatctactcgggaggctgaggcaggagaattgcttgaatccgggaggcagaggttgcagtgagctgagaccgcgccattgcactccagcctgggcaacagagcgagatgtctccaaaaaaaaaaaaaaaaaaaaaaaaaaaaaaagacttgcttgaggtcacatagatttaaggtaaaacacagatcaggttgtttctactaaaacattctaaatacataaaaaattaataaacgaattacacagatactccaggattgccttcaagcagacgtgtccaaacgttgaaaatcagctagcaaatttcttataacggggaagtaattaactgattatttgggagatactgtactttttctgactttgggttaattataaagaagaatcacttcataaaacttatttcaggtgaaagaattaattataaagtgttatatagtgatggctacataaaactatatttcaaacattattttattcttgacatattactattttcacaacatgaacatttctacaatgttccaccagtgttcacaaatattattttcctcttttttgtcagtttattgctgaaaaacagtatacatacagaaaagtgtataaattttaacaaggtaaacatattcatatgatgcattcacatcaaaaaacagaaattaccattatcccagaaatcatgcttttaacaccagagattagttttgccttcacagatttttttttcatctagcaaagctctgataaattctgtgacctttattgaagtattcatttaatttctgctacctcttccatttcttccctgaagacagaagtttatcccatgagatcaagtgaagtacaccagatgaaaatagtaatatcaaattggcactagtagggacaacctttgaatacctatcagttggcgcatactatacaggacctttttttttccccactcttacaaccacatcaaaactaaaaagattatgtttccctaaaacaactcgcagagagtagttatatttgcataacaggatttattcctgcttagttcactaccatctgttttcatattttaagtcaaaagatttatatattaaacaatcttatatagcttttcacatgctattttagaaggcaattggcccaaatcctgattattttttctaagtatataaagttgtttccataggtaggatacaaaccctcaaactcaacatctttttgatataaataatttaaagccttatcacaactgtgaaaagagccactacttatcccatttgtgataaattattaattgaagtatgcattcaaatgtacacttcctgatagcaacttctttaatccttatgtagaacataaaacactaaacaaaggagaaaaatcttcaataatttacttttctctgaaatttacatttctctgaaatggttcaagatgcttcccctaatggaggataaaatgaattatgtgtggaactagataattattgtaatgaaaatgttaggatttaactatcaaaagcacatacataatatatgctgtgtcacatcttcctatattaataggttttaaatattagattatttataattaagattcaacaacctaaaaaatatattttttactaccttacccatacatctaaactaaaatgtcacagagggtagggtaaggaaagtaattatgcagatgttattcaaatcagcctgaacagttacctatttacataaaaaattggatgtttgactttatgttgattaaataagcaactgatgtctttattgcctctgtaacaattttatgatttttaagccacagccttagaattttcaagaatatcactttagaaaaaaaatagctattcttccatcttgacaactttatatcatttaaccacaagggggccgtagctatcttctttgaattgtttaagcatgccaggaagcagataacattgaaaataaaatcaatccattctcaaaaattaagtaaacataagaaaacaattaggaacatacaaacctgatttttgaaagtaaaatgaatatgaaacacatgggttttccccatacatgttacacatttgaagcaagatacttttccctacttctgtctccaaaacaggcgtatctctgtaccttctgaactcacaacagacttctaccttaaacagaattagtattaagtatgatcgtttgtgagaattattaataaagccactattgttcaagtgctgcgatttatcacttgggaaataataaatgcacctccagtctgtgctaacctgatgacctgaggtgaaatttgagaatgagtaaaattaccaaaatatgctcccctggctaagtgagcacactaaaaaaggaaaataacatctaacaatgatatgcttaaattatgttctttttttttaaaattaaaattacaaaacagttggaatggtaaactatacaaagcaataaacgttttgttcaaatattctctctggtacattcggcaaaataaactcctctctgcagataaaaatataacatttgtcttctgaaagaaatattccacacaagtgctagtataaagtagaactaaaccagctgttccacctgtggccctgtgttaatactttagtgccttcaaagatgttatccagaatcctcaccaaaggcaaatgaactttccctgatgggaggggcaggctgcttctaaagcactggccacattatgaattcacactatatccaatgatccttttaaatttccagtcgctcatgccatcctcacattatcactttaaattttgttataccaaggaagcaaaatgttgataacagtaataataaatgctggaataacagaagtattcatccttttaacaatattgatgcaagttcttagactcttctaattttaaaatttcatgccatatctttcatattcattctcatgtttttataatatctggatttccttcattttttaaagatttttcctcaaatgccaagcaccattgtctaactactctggtggttggaggatatttcggctttgagataacattatgacaagccaactggacaatacagaagaggacaagaatggcctggatgtagtcctaaaatgttacagtgtatgaaccccagtaatgtctctgtactaaggaaatggatatttccatgactcattcccctcattcatctaatggaaatgtactcatcacctgctctatatgcggatgactatgtgcccatgaactgtggaagaggtatacataaattaagcctattaaccctccccatattcttatgtgaaaagccaaggagtgaacagaaatgagtaggctaacatttggcaaaattctcagttacacagcacttccttgtcgagggaaaccaatatttgaaaagaaaaagcaaccacggagaagagaaaaatcctctctagaaactcgtaacaagttaccaataaatagcgaattatagaatgtgaaacccaacttcctaggccaaatgttattttctgcacaaattttaaaagcctttggatccattctgttttagggtggcataggctcagtccattccaatggaaaccagagggtgattccagggcccaacctatattaaaaacagtggtagtcaatagtataatatggcatctgtattccaaactgataggtactctagacatgcataactaatgcacaacaacatctctcctacacgtttttcaaaagaccttcaacaagttgcacttgacattcacaaaagagcacattccctgtgatagtgctatttctctctttagttttaaattaaatgtgacattcataatttaatctcttcactagtcaaatgtatatcagaaaaattgacttagagtaagcattttcttcactgattaatattagaatggagaattcaaccaaagctattaaaagcttttgtccctttcttattagtagtgtttcttacattgagctttttataaaagcctataacttgatataacaaaagtagaagaaaaaacagtatttttaagctctatttcaccatgttcttaatatttcctcacttacggcagattttcatgccataaaactaatttaccacctactgtaggtgatattaactctaaattttaaaattgtatgaagactgaaataaaataataaataatccaattactaggaacttactaaagagactctccttcctcaaccatggttaaatccatttacatttctaactcagtattttaatccaattataaataaaaatatcctttaatggatccacttaaatcataaaccagcacttgtaaaattaaaaattaccacagtaattctataacctggtacttatttaaagtgtcttttttaaatagctgggtatttacccaacccttatataaattatgtaaaaagtaaagaccagaaaaaaatatgttctaaattctaaaaaaaattttacaagtctcccactcttaatacatttcaaaatactaaactaatgataatcattttccccctgacattttcaatttgaataaagacaggaaataaaaagacagtctaataactaaaacttctaaagctagatcagcaaatttttactgaacataaggcatcagagtgatgtgttattggcaaaacatacagacacacacacagatatatacttatatcatgttttctagattgttttttttcctacctccaatcttctgtgattttgttctattgggctatacatcaggtatgactaggttgtctcaaaccttattcgtttaagtacttcttattttataatcaaattatgggcaatttataatctcacattaacattttgatctaattggattattttctgaaagcaaagtacagattgcaagctaaaacacacattaagtataagcatttgcaaagataggacagagagtcttgaaagagcttaatttcaatatgctataacctataagtaacttacaaagtgtattcaaatatatattcagtacttcactatgtgttggtcactatgttagttgctttgttatatattaaaaagaatcagatacaaaggcatcaaaccataaaacacattagcacaagttatatgtgtgcaattagtagcttacctaaaatctaaagatgtcaattaaaaactaaatataaagaataaagtacagttaaatgacataaacattactactcattactgttactcatggttgcttatagttacacaatatttttttccacacactatctcatatatattacaatccaatttcatcccctcaacatcttacatgttaaataaaatagatactatcttctattgtgaatgaggaaatgaaaagatagaggtcctgaaactttgtcacacagaaaatcacacaataaattcatataagaggggaataagatttaagttgtctgtcttctagtagtgtcccaccactacctcacatgtaacatacccacactttctcatgctatcactagcgaggggatttatgctaaccttttgaatgtgttcttatttttgacgcctcaatttgtgaaccaatcatctacaacataggggagaggcaaaattatatcacacaagtagacattcgcaaacacataatgaagttactaataagtcacattaaaaatggtcctattaaaaagtgaacaaaggacatgaacagacactttccaaaagaagacatatatacggccaacaatcatatgaaaaaaagtccaaaatcactaatcattagggaaatgcaaaccaaaactacaatgagataccatcagaatggctattattacaagtcaaacaataacagatgctggcaacgttgcagaaaaaaaagaaacgcttatgcactgttggtggaagtgtaaattggttcagccacattcagtagtaactgatctatttgcaagaagaatctatgaggttttttgagaagaggaatcttggatcttgacttagacacttttgtatcgtcagtgttatctgtatgtctgttacacagaagtcactcttaaatgtttattgaaatgaaaactgtcatcacataatgccacacctagagttggctctgatggatctgtccttgcaaatagactagatattgcttgggaataaacggggcaattggattccttcattttattattctcaaaactaatcacaatatctgacccaagatagatatgcaacaatctttattgaatgaaaataaaatcattgagtagatgaatggtatattgggatatgggcattttgaggtaagtaatatattcaactgatgaaaagaaaatagcaaccaatagaaactagtaatgactgtgcttatctttacaatgaattttagttacattcatttctccctttttctctaatatctttaagaaaaacagaatattattttagaaatactactatgccaagaaaataagaatatgaatcagtacgctcattggtaaatggctagatcttattgcccccaaatggcaaaaacttattcaaataaagctatatatggaaccaatacgataaatttggtggtgtactgttctaaaaaaaaaaaaatcaagcctctatgaaggcaccataaggaaatcagaattttagctccacacaatcatgatttgacaatactttttaaatactcagcagaccccacgtccctgaaaaaatcccaccgctatagtaatgcttccacatttccttaaagtttctcattagtagtgataacaatagtaggtaaaaataattgtgctatttaaatgtatttattgcagtaaatttattgttctctttaagaagcactttgcgcttcaaagcttttcactagaaagagacaaggaataatattatcaatatccatcataaaaatatcaaagcccctatcattaaaggtagtggaagagttgtccacagaaataatactgaagcctaaattgtcatgtagcctaaatgtctctttttttcattagattaggagtcaactgcattttcctgactagtgaattactttgtaaaaggctggaaggccccattggaggtcattaccctatctgcagggtctactggaatttgactctgtgcttctgatgtgtatacatacacattaccaccccaacaatgggactcgttttcaggttttctacacatttatgagatctcagcttataagagtgctctttccatggtctatggtaaaaagattaggacattaagtataaagaagcaataaataatgtagatgctatttgcttagctaagaattgacatattagaaatgaatatagcactaagattattgtgcaaaagaacagttatgaactacaattttagactcactttagggcatctatggaataagaaaaggatccttgactttggagtcatacacacccacgtttaaaccccatccctggcactcaggcataccagttgcatcactgggaccaattaatgtctatgagccttggtttcctcctcagtaaaaataacactactgaactcataagtttattttggttattaagtaaaataatatctctcaaacaaaggaaaaggatctcaatctatgttatatcccttcatcttctccattctgccatcatagataagctccagcaggaattgaatttcaaccctgatctaataatctcattttatattttggatctaaatctattatgtgagtttaaaaaactattagcctcctttcataaggacatgaatcatacattgagttttaaaatctcaaagtttagaggcaaatacaagtgtattactgacttggcagtataaatacatcaaagaattctcacaaaccgtatcttttatattgctttatgtaccaataattcatcaactaatttattttactaaattcttaaaacacaccacttatgttttacttaaaaggtaactttaggccaggcacggtggctcatgcctgtaatcccaatctcagcactttgggaggacgaggcgggcggatcacaaggtcaagagatcgagaccatcctggccaacatggtgaaaccctgtctctactaaaaatacaaaaattagctgggtgtggtagtgcacgcctgtagctccagctactcgtgaggctgaggcaggagaatcacttgaacccgagaggtggaggttgcagtgagccgagatcgtgccactgcactccagcctgggcgacagagcaagactccatctcaaaaaaaaaaaagcaactttaaggtcttactttaaaggtgtcataaagtatagttatggaaatattttacgattttaactgaatggagagtatacaaacctagggatctcactcagtccttaaatcatctttgaagtggcatcgaattctcagtgttaaaattctaccagttgtatgtaggactgatataactcatgtgtattaaaaataatttttaagatttcctcagtagttatgaccctgattacgaatcagacacctttgtaagatttactaatagtttacattaacagattatcacttattaaaaataaagccatgtcttcctatttcagtatttgacctgaatactttttacttttctatattttattctctacaccacaaggtaactgcagagagaatagtgctaatctggactatattttgcattaattcagggacttttgaagccacactgaattgctttttcagacctgcttaaggtcagacagctgaggaaaagccaataccccacaatgaaatctcaaacatcctgggaatactcacttcaaatctgtgggatcaatttggggattcatgacaaaaggagtcccaagagatctacttataccatcaccatctcacatttcagatcctaatctcctaattattctagagtgcttgatggagaaagaagcagaggggggaggaagagaaagacagtatgtatatgtttaaggatgcatggaagggagggaggggggaattaggtcagaagggttaattctgggcccagtcacatatatgtaattaatttctatgtttagtgcaaatacgactgtatcaacagtattaatttaatataatggcaaggtaagagcaggaatatatgctactatttttaattcctaggcggtaaatttgtgtcatttttcacagtatggtcctattgaaaaccttaacacagagaacatattactttctggactataagagccgactgatgatgacacctcttgaagtctatttagccatttaaatattaagcttttaaaatcattctccaataaacttcctaaattgtttcactcgcataagaaggataaaatatatcctcaaaagaatgctatgaggcttgctaagagggggaaaaaagtgaaaatgcctaatggcatacatgacttaggttagggattagttgacattatgtaaatctgaatatcattaaagtaacagtaaatgaattttatcgccaagagtaagaaccgtataagggagcgtataagaacagtataagggagtgtacaatacatcatactaaaataatttttaatacaatatattttaatcaattctctagcctatctgagacatattcagaagaaagtaatctaagatgtaaaactgaaaaagaaattaacacaaagctaactatatggagcagccacagcagttctcacaatgtgagaataaacctgttaaagtctcatattcaacttcactacagctattttacctttcagtcaaacaaagaatttcatttgagaatcttaagtaatctatactcatttctaccagtaagattttctggctgcacattttcaaatacagtcaactttttcttgctcatatgctaaccggcattcagtcttttatagcagtaatcactgaaagaacacacttctgtcaaatgcaagagatcttattcagaaaatcgaataacacagaagaaatattcattatatgatatagaaaattttccttctccaaatagagtcactgcattgatttttttcttgatttgtttgttgtctattacacacgtctacacattccaaatcaattttatgagtcagactcaatactgaatttattgcagaaaaattaaatactttgtaagagcaagaaaaaatgtattttgtttacattttattaaaataaagggtatgccttagaatcatatttagtgtaatggttaggaaataatcattgtaccatgaaagtttatcttgttttaaaaccataaatcaggctgtccagaaactttttaaagtattcaaaaactgtactttcaactctggacagtttatgttatcaaaacattttagcatatgttaaacagatatttgcattccaaatatctgtttaaattctgtataaaaaacattttaaactgaactgttctgatattttgttttataatgaaaccaagcctttaaagatggtgtataaagctaaactcttctttaacttttacctctgttttgtttcaagttctctccatcctgctactgcatgctccactatcccacccttcagaggcaccattaagaaacaatttttattttcatacaaatttctaaacaagaaaagaatcctggctgattttagctacagatcctttaaaattcaattctgcagtagggtttatgccttataaatattttttaaagatggttgacatatgattgactcttatatttttctacaatagagacacaaaattctcaattatacccgagtaactatccaaatatttacttgctattgtgagtagttaatattaatcaatttgttataaaagtaaccaacaatgactaaatacttgttatttgacaagcaaacgtgtttttgttttggtttttacacatattatctcttttattccccacaacaaacccatgaacaaggtgttgtcacgatcccccttcagaggtgaacaggctgaagtacagggaagccatgtggcttacctatactcccaccatgctacatgggtgcagacaaaagaaaacacatgtagttttcttactacatgtagcgaatcccaaattcttcttctttattctatataacctaaaatagtgaaattacagaactatttacatttagctctaattttgaatttttaaaaatggttagtggttcttttacttaaaggtcaaaatttccattttccaaggtgaccagaaatctcatactgccttcataaagaaaacagggaccaaagacttaaagattttctgggctgagctcactctttctttaacagattaatttagatgtagaaactctttcaaacttcaccttgatttgtatctttaagtgagaggggagttttcattcattagttaatgtgcacattaatgagataatttgtgggttttattatttcttcaaagacattaaacttctcaagggaaaacatttcatggaaacaacatgcattcttgttattaaaattttcattttaatctcgataaataatacttcatatgtagcttcatttattaggattttaatcagcttttaagttcaaatcctttatgacactaaaggatgagttatctaaacctacccagaaatcattttatttatcaagggcgtttctataatcccataagacaaaacgaaggaagtgagcatgaagaagcaagaaatctaaaatattaatcatattgcattttaaaatgttctttgcagcctcttttttaggtgtaaattggatgtttaggcttagttttggttttctacagtagaccaaacagtgctaacctgtgttaaactgaatcaactaataacttctaagaggtatgctggaaaacaagtggaagtgaaataatatcatgacctgacgtcttaacatcagttaaaataaaaggaaaataaaattaagcaaggggaaaaaaagcaagcaaaaaaacaaaaaaagcacagaatggttatgattacaaaaataatcaccacacaaaaacaggtcacatgaaggaaaattattctcaataagaataagcctcattacttaggaatccttgatacagtgtcctctaaaattttctccatggacagtagtgcttaattttttttaagtatcatcacatccttcatgtgatgtcactaaggccatttaaaaatctgtttccacaatctttccctaacagtcccaactttccaactttaacatacttatataaacacaactactagtattattttaaaatgcataattttaaccatattccactgctgcagacaattgcaatgtgctttccatcaaaatcacatgaattatacataggaaaaaatctttgatcattactgcctctcacacttgggaaaagtggaataaaatagatgtagcaacagctcagagccgattttctaacaaagcataaagcttcctccaccatatatggagcagcactgacaccaaacaagaaatacaatgtcttgcttgcacagcaattctgtggcaaacactatgccagccatggaatattaaggtttcataatgtcagtgtctactgtcttcctcacatcactgtcatcacaggtgaggcaaaagtctctgaatccccttgggcttacagcttactctgccctgcactgatgcataatttgctttggtcttgaatacatccctggataattctttattcttgcagaagtctcccctacacaattgaaattcgcctttaatggtttccaagaggacagaactcctcggtttggtgtttccaaagatgcaaaaaaactctaaaaatggagtaactaaacacagcatatgataaaattggtgagattatctgttttatgaatacaaaaatacaaccccaaattttcctagaagactttcgtaaatattcagtaatctaaaatgttgtaaattgattgtccagacacacacaaaatgtctctctctctctctctctctcacacacacacacacacacacacacagaatttagaaaactggttagttttgtaaaattcactttaaagggaagattgccaattctccattttgatctaggagaaactggtaacattaaagatacatgtatgttatggtttcttataaaagtcatggtatcttcaccttctggcgtaacataaactattgatttatatttaaacattctttcaatgatagtttgtagtttattataagcatttaacttaaattttttctatatgacttcatagttatcagtgacctcacctcattaaaggtctgacattctattgtctatgtatagagatcatttgtattctgtcataataatcccttcatagacctaaacctctgtgtccaagtatcctaataaattgctaggttttttaaaagacaccaaagaatattcatttattttataaatgcctcatgtttattgtagaaaaaaaactagaaaatactgataagcaaaataagcaaatactctatagcccgctcagttaatatcttaagtactgtctttgcatatatagatatgtatatatctatatatatatctttatatatttatgcatatgtagagatactaatatatacatttaatttatacatatcacattaaaaatatacttgtgcacctgttcttgctcatatgatagcagaaagtgaatgtagttcatctcaataaatatctggcaccataaacagatcatatttcattaaccaatctactattatttgagaactgaacatctaagaaacatcatagaacatttttggaagtgcatgagaagcatttaattttaataaatactttatgagcataaatgggacaaagcctcttctttaagccctgtctgatctgtgagtgtatgagtgtaggtgtatgtgtttgtttgcagagtagggagaatgttgaagggtagggggctaagagaagaaactttcttctttgatcagctcacaaatggttgagatacctatagaagttcacccaatagctagttgttctgtaaaagtgttttacacttaaaagcaggaatattcagatcattctgaactttatgaaaataaaaaactatatttggctgatgatatagacataggcatgggtgtgagtgagatggaatttaggggtccttttggttaaattctgtcagtattgtatatcaacatattattcattcttacctctctccccaccatcaccccacaaatacacacttaaagaagacaccccatatctagggtcttcttccacttctccaggtccattgcttatccaccagtctccagctttgagaagaagggaggtcaaaatgtgctggacagagtccaagtagaagtcttcagactgtcagccatattagctagctttctacttttctaggtcttttggggattttaaaatagaaattttgattatgaagtggggaaatacaattacagtaagtaatgtatttgacagtaaaagctttaccaatattctttctattgtatttaacacagatgtatggctctggaaatgaaaatagaaagacccaggctaggcacagtggctcacacctgtaatcccagcactttgggaggctgaggcgggcagatcacttgaggccagaagcttaaaaccagcctgggcaacatggcaaaaccctgtctctacaagaaatacaaaaattagccaggggtggtgatgtgcatctgtagccccagctacttgagaggctgaggcaggatgatggcttaaacccagcaggtgggggctgcagtgagctgacatcatacccctggactccagcaaaagagccagaccctgtctcaaaaaagaaaaaaaaaaaggaaagaaaatcaaaaggcccaatccttctcacaagacccactgaggtctgtccaaagtaaatccaagcatgcattgctgaatcagctagtgctttatcatgaaaacacaggcttgttttgatttgatgacatcaggttgacaaagtcattttttaaatattttaactacaaggaaagagcctccataataatttttatccagtttttaaattttccttaaaacaaattaaactggtaatgttttaacattatcaattcactattcagtaaacccaaaatttggaaagaaaaaaatactgtaccacaaacaaatgtgaattctatgaaatactgaaatctgggcaggggacgggcgaagtcccttagccttcctaacaaaaactttaatatctgattagaacaagccaagttatccctattttagggaaatgaaaccaggaaataacacaaatgccaggactaagcaataggcattaaacagccagttatactgccacctatctaccacctttaaaacactgggcatgccaagcacagaacatctgcagatattacagaggctccagtggtaactctactggagattttaagttgccataggtcacaactatgtgtataaataataacaataataaccataataaaatgataataataaagtacttcatgcataaggttaatgatgcccattcagcaatcaggcattcactttgactgttttttctaaattgttggaagatttccatagatccattcatgtctctgtgacggttcttttccctaggccctctttttggaagactgatcattggagatgaaggcccttctgctgacctgagaagagaggacagctctttaacccacacagaaactacacccaggggtgaccccatttgaactgtgctgttgattttcccaagcacattgtttcatagtcatttaaaagaggattttaataatcatgaaaatatgaaagagaatattaaaatccaagagttttcttattcataggctaatactttgaagaacaaagtgatttattttcagacaactgaaagtaaccttgcaaacccaagtaatatttttcttgcacctattgccaattgaagaataatttttccatactttgagcacaacacagaatgcagctgcatctcaaattataaaacagagcattgatgcagtagatcaaaatcctgctatagtaccattggggaagaatagatggttctttggacacagtgatcaacaaacacctatcctaaacatgctctaatgagagaaaggccaaaaaaaaaaaaatgccctcttgcagctgggcgcggtggctcacgcctctaatcccagcactttgggaggccgaggcgggcggatcatgaggtcagaagatcgagaccatcctggctaatacggtgaaaccctgtctctactaaaaatacaaaaaattagctgggcgtggtggcaggcatctgtagtcccagctactcaggaggctgaggcaggagaatggcgtaacctggaaagcggagtttgcagtgagctgagatcgcgccactgcactccagcctgggtgacagagtgagactccatctcaaaaaaaaaaaaaaatgccctcttaaaattcaacatagatgttttcccaaggtgtcatgggagcacaaaggaggagcaccatactcagtagatgtaaccggggtaaaagacactaggaaatacttcaaagagacagttactctagagttgagtcttaaggaataaatgttggctaggcattcaaggaatataattagtcaaaggattctgggtacatggacttgtagaaaaaaagacttaggataaaataaaaagcacacaataatccgggaatggaattctttgcaggatcatttggcttggttaaaaagcaaatgtagggaacaaacaaaatgaggctgaaaaggtgttccagaaccagattatgaaagatcattttgactggctaaagaaagacatttccttggttcttaacttcttcatatgttagcattatctttaacacatcatgttcagcattgctaacctcatagttacaaaatggttggaaataaacctgaaatcatccttttcatccgtccagtgggagaataagggtcatattctcacaaccatcaaacaataatactgaacccacctattaaaatacccttgatgtgatctctataatcatgcacgcatgttgtgctgattggcttagacagattttatctcagtcctgaaccaatcagaacctatccctgaagctgggcctaggatcaatcctacataatcctatctacattttatgacagttacagtatgagagttttgagaaggggggaaataggaaaatgattggtgagtaggtgtcttagtccattttctgctgctatattagaaaaccatggactgggtaatttataaagaacagaagtttatttggcacacagttttggagactgtcaagtcccagagcatggtgctagcaccagcgagggtcttcccatggtgaaggcagaagcaagcaagtaaacagagagaggcaccagtggcaggatttgtaataacccactcccatgataactaacccattcctgagacattgacattaatccattcatgaggtctccaccctcattgcccaatcacctcttattaggctccacctcccaacagtgctacattgggaattaagtttcaaacataagaacttttggggaatacattcaaaccacagtagtaagtaatgggcaaaactgtctctactgctcttctgcaattctcctgcattttaaggaagctttataatactacgtggagagagaaaagcataatcctataaaaataaattctcattgtaggaaagcatttttgtttcttaaataacatataaaatcttatataatttcctgtggatatatcctgaaatatccttttaacttcatcacataagtaggtacatacaggcaattcttagggatctgcacctagtggctttaattatcttttctctgaggagattcactattctagtaggagtctaagcttctattgttattgcttaagcaataattttatgtgttagctctcaaattttaacaaataccaacttctaacatcataatatagtaactttattttaatttaatttcttacttagcattttgcttttagtacatagcattcttccaagaaattaaataatggcccttttgtctgttcttcttttcttgaaaagatttcacaagagttctggtttactggtaatttcaaatacctgtcacatgaaataattgctttctatcactagcatttttcccagactatcagcaatcaaaaatcacttacagtttgccacaagaatatctcaggacttgatttgtatcatttttaataaccttttcccatatattttcaaaaattagagagtctgttgtacatatttatctatttatttgaataaataaagccaaaaactataagaagcagtcatatgacacataacaagtcagatatctgtatctgtattcaaaaatcttctttaagcaagggaacataataatgaatgctgttctcatactctcctgtatctcccatctctcaacgccatgatgtaataagaagttactgaacagtattaaagccagaaatcacctgcttctgccacttgtataatttccacatttttaaaaagcctgtaaaatgatcaattcactaccacctaaaataggttgctgctgtgatatctgaaaacagagattttaaatcctgtactaagaacaatcacaaaaagagacacaaaactatgttttgggtactggaaattatctatatcttgatagtaatttgttatacattgctgtaggcttctgtcgaaactcactgaatttcaaacttaagatttgtgcatttcattgtacattcatggtacctcaaaggaaatatttacatacacacatatataaaataatttaagagtacaatgtattatcattgtgctgtgacaactagatccttgtaaagcaattactccactggttatctgcccaaggacaatatgggtgtgaaaggattaagctgtaatgcttttttccgttgcttttctaggtatgtaagtgatttgatgttattatgccctctgttcttttcattttcagagccatacattgaaaatctttttccagctttgtgtatgccatacattagattcattagaataactcccaattagaaaatatcaagtagtccattagtggttacatagcttggaaggagcaggagataggatgcaaatctggacctatctgatgacacatccttagcttcccatgggcaacctttaacattttttgtccataaacagttatgagtcgcagaactacaagggacatgcaagataaaaagcctagtgattatcactttatttctctatgatatatgtactttggaataccccaatctgtgtctttcaaaatacaagagatttcaattttttatgtcatttactatattttatttattagacaatataacaatgattgttttccaaaaacatcctaccctattcttcttgttttaaaatgagaatgcgagtatgctttgcaaggggcaaaatagaaactaaatttcagtaagcttcttccctttgcaacaataataataataaacatttatttgagtgctgatgataggccaagcattttgcaaactgcttgatgtaatccttacaactatgctctgaggtagttatgcttatagcactcatttttccaaagtaaagagaggtgaagttacttgcctttcagtaacagctaatgagtagtggagccaatatttgaaaactggcaggcctgtctggccttatcacaactataccatccatactctcttaattaaacatgcattggctcatttattaagcatatatttattgaatgcccgctgcactcatcagtagagacttagagttcctgacctcaaggagttacaaaaatagtaggtgttacactactagaaaatgtcactgccatttgataagaactatgctatttaagcaagaggaggaaacacttggccgggcgtggtggctcacgcctgtaatcccagcagtttgggaggccaaggcgggcagatcatgaggtcaagagatcgagaccatctgggccaacatggtgaaaccctgtctctactaaaaatacaaaaattagctgggcgtggtggtgcgtgcctgtagtcccagctactcaggaagctgaggcaggagaattgcttgaacccgggaggcagaggttgcagtgagccaagatcacgccactgcactccagcctgggtgacagagtgagaattcgtcagaaaaaaaaaaacaaacacttaacccagacacaaattgtggtagctggcagggtggattgagggagagataagagaggctaaaacatacgaaggttctgtggagaaagcccaattttaaagaatgagaagttaaccagctgaggaataaaattaagggtgtccaaaggtcagggcacaaagtgaacattcagggaaatggaagtgtgagtggattatagagaggaatggctggagaagaagggcttatactggatttgactttcaaaataatttggatttcataacaaagagaatgagaaaccattacagaatttgggatagaaaaagtgataagttttgaatctgaaaaagatgattggcagtagtatggaaaatgaatcaaatcacagggctgtgagaatctaaagcaagaagacagaaacacagaccagaaatgataagcgcatcatgtgaggcaggcatagggccatggccagacttctacattttactgaaaaggagatccatgaagagagaaaggaactttgtaattaaggtattgtcatactgcatgtatcacacaatgttcaagaactttcatcaagggcatgatgagaaaaactggctctggaagatggtttcaggttacaaggaaatctaaaagataccaataaatattttgatacacaaaagtaagataaactaaaagaatctgagaagtcttgagataccggcatacaaaataaatgaacattaatgttaatgatctttcatgttaaattcttatataactttttgtttaataaatgtcatggtcctatataatgtgtttttatgatattacatgatttttacactagaaataatgtatatatggtctttattctccagaaacttgcaaggtctcagagcagattacctgaagctactgaaccttgaatttagtatgttcccacatggctaagaaacatgaggtcaaaatattttttagatggcagattttttttggaaagaaataaactcttttgttttcttgacaacactgtttgatgaatagctttaccctcccctagattctgtgcttgaggagtgtttctattccaacttaaaaacaaagcattaaaagttgatgctaccaatagattactcatctaatctctgatttaccgaaaataaatagtaaacatatttttgcttcactacatactaaatagggtgccatcgaattatacatcattaaaagttttaaaagatcacatcttcccttaccccaatccatctccgcaatttggttaattctttttctgtcctttcaaaaataaatataaaacaaacaaaataacttaactttcagcataaatcctgtgttttcccgaatgtgcttagtaggaaaaaaaaagtatactaccatatgtttgtaattgtagggagaaggaaccataaaaggttacttgttttcatataccttttattggttcactttgctttaaacctttctttgttttgctctattattttttcttccagcttcactgatgtataactgataagtaaaaactgtacatattcaaggtgtatattatgatttaatatatatatattatgtaatgattatgacactttaattaatacatccatcatcacatatggttactattagcagcttttaagtgtcaccctattatttctgttcctaattcttaagcgtcgttttggtggaaactcctagtggtaggaggaagaaataaaagcatttacatccctttaggttgtgtggcctttctttgcctaaataagcatatcattttctgagttagcaatatggtatcagttatatgttttgaagcaataatcatcaaaagtatgacattttatgcaacactgttgatacatataatcttctgctatcattcatctttttgctctaacataggtagggaaagtctaaaggcacaggttgtgagagaaagtggcttcaaaagatctcatagggtacagttcattaccttgtttaattacccacattccagagccagtctttcacctttacaaacttagattctggtttcatcagtactcttggagtggacatctcccagatgtagatataaaatgtattcatttattgcctttagaaaaaaatccaaactcacagatctgcaaggttctagtcagtctgatctttccctagctattcggcttcatcttatgctggtgtcctttaggtactcaaatcctaacctgttctgaccatttggatttctctgcttgaaaaactgttttcccctcacttgctaaacaaaagttccaagcctttcatatctagctcaaatgtcacctcccgaccacccacactaaactgccccttccctcttccactagttctctgcatcttatcactatgttcatttcctccactgtgtttttcccaatgtgagtgcatcttgtctgtctcactactctagaatacaggctttttgaggacaagcaacatgtctgtctgttctttgacgtatgtatccccagagtacataataaagctagctccaaaggtgagcactttataaatatgtcatgtgagaaagaattaactcagttaataattggtataccaacacagttggcataacagaaactgtcaattatttacaagaaaattcattcccttaattttcatagatggcatactctatacattatctgcctgcaggcagaacttctttaaaagcccaatgataaaaagaaaattgtttttgagcctggaattagaacaagaggccttagattgacataagaattaatgggaacaatcagaatatactgatacatccaggaacctaaaagtcaaagactgataactaaatactttctttagaggtaatgcttgattgctcactggcaatcttctatgatgtcccttctttccttgtttgaattactgaccaactgccctacagcttactactttcatgccctaagtaagttaatacattcagtcaagttagtgaaatagtcattctgggttaattaggatcatgtttccaccttccagtgtgtgtatgtgcctgtgcctgtgcaagtacacacactgagtgacagaagccatgaactaaagtttgactatcaggccgggtgcagtggctcacacctgtaatcccagcattttgagaggccaaggcagacggatcacttgaagtcaggagttcgagactagcctggccaacatggtgaaaccccatctcttaaaaaagaaaaacaaatagccaggcgtggaggtgggtgcctatataatagccgggcatggcggtggggcgtggcgggaggctgaggtgggagaattgcttgaaccttggaggcggaggttgcagtgagctgagattgtactactgtactacagcctgggtgacagagtaagactccatctcaaaaaaatcaaataaaattaaataagtaaagtttgactatcagagtttgatcttctctccaagttcttgtggaatgattccattcaagctgccaggtactaagaatatataaatgtctaaatttattcttacattgtacaattcattgtgagtattatctaatacttttttctaaaaatcacattaagtttggccatagagaaatactggttatgaagagcatgtaatcattgcatgcctacatggtgtaggaaaatacaggcacacactgatattttacatgtatagtgtatacagcaaagagagaaaaaagaatggtaatacagaattatgagaattgtttttaaagtatatttgaatctttactaatgactttattgtcttatttagaaaatatgtgacttacaaattaaagcttaaggacgaagacccttaatggaaccattcattagaagatgctatcatattctgacaaaaggaaagcatgaataactaaaataatacgaatctctaaggcatttaaaatatgaagcaaaaaaattttaggtaagatacatttcacaaaagaatttttgacttattaatacttggtactttctgtgaatatactattgtcactggaaataatatatactatagtgagtttcaaaaatgtaactacttcacctaaactatgtgctgagatttcattagagatggtatcaatggtgaggatggcaggaacaaaactaacctgaattattacaatttggaagtggtttgttttgctcccagtactatccaggttttgctacactggcttcattttttgtatttgtgtcaagttttaacatttttcatcataaagaaaaataaagtttctgtgagtttcagtcaagaaaatagttcattttcctctccttttatgagactcagtgtggtagcttacataaggcatttcagctgagcaaaccagctctagtcagctcttctcctcaaagggactggcacagaatacaagacaggattttggccccaagcccacagcagtctatatttttaccactaatcatatacattacccctgtcttgacactgaaaacacacattctgtgccaatcatctattttcagggaaaaatgcatacgcatcttgggataatttccatttacaactggcaattcaatccactgaatcaaattgtactcgttttgattcaaagccaatgtggtaatgcctaaagtgtgaattacaggcactggttgcaacaatgagatcacaataaagaaatacaggagttaatgagagtaagaattctatactccaacactatgtaaaccataaaacattgtcaaaatggaataatcataaacatctctcctccttttgtggtgttataatatcctctctttcatgacattaagttggtgagatataacaattgttagcaatctggactggttctcacatttaaaaaaatactggtgtaagaaatttgaaaatctaggagctctgataaaagcttggctgtaaagtgaaagagagaagaaacatattagctaaaaaagactacaggttttaatcatatttattttgtttgtagatttatcttataaagatggaggagattagagaattaataaatgcataaactttgaggcaggagtcagtaacgtggaagagaatagaaataaaatagaagcagtgattgctggtggagggagaccccagtgttggaagagatgggaggcaaatgcttctgaaagcaggtaaagccatttgcttctacagaagaaaggacactttttctgggactggagggaaaagagctacaggtggatacagataaaatttgaagatacaggagttcaaagaggaaggaatgaatccagcactccactcttacgcctaaagtaaatcaaatactatccattctaaacagtatgtgctcacaatgccttttattccttcccatttcctttataaattacagttctctttttcacctactcctttctcctcagacagaaggcagcaaaaaaaaaaaaaagagctttagtgacctcagccaaataaatagttccttggccagtctgaaaacatgtaaggccgtctagttcaatggaaaaaaactgtacacattgttgtccttaaaaagagcttcaattcttgagtattcctggcaggtccatcatctgagccctccagccttacataaactttattgagtcagacggtatatagaactaaagctcccagttcataaccactagtactctgacaaaccaagaatttcctagcttaaaaccttgagcatcactctaaacagttgtgcatggcaagatgaaatacatcaccaagaaagctcttttcaaagtatttaaatattaatcatgcctctgtcttcaaaagacgatgttctccctttttggtcaataatcacttatctgaccaaccaaaagaatacataagccaatacttttgaaaatgtgttttctgcttattagaagaaggttaaaatttctttctttctttcttacttttcttttttttttttttttttttttgagacagtttcgctccgttgcacaggctggagtgaagtggcacaatggcccagtctcagctccctgcaacctccgcctcccaggttcaagtgatttctcttgcctcagcctccacagtagctggggttacaggtgcacgccaccatgcctgactaatttttgtatttttagtaaagacaaagtttcgccatgttggccaggctggtcttgaaatcctgacctcaagtgatccaccaaatggcctcccaaagtgctggaattacaggcgtgagccaccacacgtggacagaaagttgtaatttcttaaaaaataaagtcttacatctgattcctgaataaacaatgagatagatagatagatgataaaagacagatgagagataaatagacagacagacagacagacagatatataggcaggccttttatggattgtcagcttgtatccaagaaagaaccattatgtatggtctcaacccaaattgtttagcttgtaatagggttaaaatgtaaaatttagtttttaaattttattttaaattataaatattttagtgtccttctgtatataagtatacctcattcgtgtcacatttgttatttggaatactaatgagcagtctaaagctttcatgtgaatctctctgaaatatttctatggtaacacatttgagttattagggctataagcctgaatttgaatgtgatattaactatatactactttcaggcctaaatactacagagtgatgaaagaaagcagaaagacataattataaacatccaggaacacaaatattggaaggataaagctctgcaaaattaggcttggcttgggtcacatgctcatgctgacataggtggggagacaggaacaggggcccttcactgcataaactgcagtggttaagagctcagactagagccctattggttaggtttggtttgactactgactaacacttattagttattttataaccttgaacaagttacttaacctctgttttgtttttgaggatctttgtctctaaaattgatataattatagtaggtatgttgtagggttgatataagaattacgtgaattaaaacacttagggctggacacggtggctcatgcctataatcccaacactttgggaggctgaggcgagtaaaccacctgaggtcaggagttcgagaccagcctggccaacatggtgaagtccatctctactaaaaatacacaaattagctttgcatggtggtgggcgcctgtaatcccagcttcttgggaggctgaggcaggagaattgtttgaacccaggaggcagaggtttcactgagccaagatcatagcattgcactccaggctgggtaacaagagtgaaactccttctcaaataaataaataaataaaacaaaacaaaacacttagaacaatgcctggcacttagcgagtgtcatgtatagttattattaacaatatgatcatcaacaccgttattgataatctcactaggatcatatgtaatacaagtactttttccataagaggtgaaaagaaataccaagtaggcaaaaacaagttgtttactatagggaactaaagatttccttgaggagtaatgctataaccaggtcataatgagcatgtaattcaagcaagactcaattacacatggttaaccctaagcaaacttttgaaatatgactttaaagacatcagcctctctagtatcaaatgactatatggtaaaatttcagtaagagttttacatatggcgtcccatcctttatacaaatcatgtgagtagaagttatttccactagtctacagctgaagaaatggccttagaaaggttacataacttgcccaaggttgctcagtttaatagaaacagattttgtcttaagggcttcaacagcaaagcctgtttttaacaatgacatcaaaaatatctcaaggggaatattagttccaaaaggcattataatgaactagactcaacaaacttaaatggttttctaaatgtaggattttgccatatcttttatatatccaacggtttaatgactctatgaggagatatatatataaaataaaatatgtccaaaatacattggaccaccttttttttttttcttcttgagactgagtctcactctattgcccagggtggagtgcagtagcgcagtctcggcttactgcaagctccgcctcctgggttcaagtgattctcatgcctcagcctcccaagtagctaggattacaggtgcccaccagcacgcccggctaaattttgtatttttagtagagacagggttttaccatgttggccaggctggtcttgaactcccgacctcaagtgatctgcccgcctcggcctcccacagtgctgggattataggcatgggccgccgcacccggcctggaccactttttatagtgtctcccagaacctggatgctatagaagacactttggcaaaccctgcattgtgttatagcctttcctctcctaagtagcacgttcacatgactgtaagatcttatctccaaacttcccatcctactcttttttgctcagaggtgaatctaacatgtagccctttgccatggtatttccattttagtaagctttccttagtaaagtctgctttcaggtaccattcaatgagataagtattaacgagaaggcgtgttgtctttttaaggattcctaataccacatcataaaggcagtcacttcacctagatataagggtagtattctacttatgcatttctaatctaggataagcaatcgtatcgcaaagattataaccaacatatagggtgaaatggaaatctgaaatggataaaaaattttcattctaagtgaaaaaatttggaattttttttttcagtgttggtaaagcctggtatcctactgctactttactttcaattactttggcattccgtgttaaaatgggttcatctttctttcctgaatgacttctttggatgtaacactaagttcaaatgttaatgtgggagctgacaagcctgtcctttctcctgaagactacaaagcatgtgatgtttccatactgacaaataccaggaattagtgaatgttaactattgttgttgttgctattattttttattattattttatcatgtaaggctcactgacttatatgcaacctctggaagtttcatataaaaaataaaacacaaggctgggtgtggtggctcacgcctgtaatcccagcactttgggaggccgaggcgggcagatcacgaggtcaggagatcgagaccatcctggctaacacggtgaaaccccgtctctactaaaaatacaacaaattagccaggcgtggtggcaggcacctgtagtcccagctactcgggaggctgaggcaggagaatggcgtgaacccaggacgtggagcttgcggtgagccgagatggtgccactgcactccagcctgggcaacagagtgagactctgtctcaaaaatcaatccatccatccatccatcaatcaaacactaaaagaaaaacagatatgttatccttttacatatgtatagcaccatgctgagaaaagtgctttggtcactggctccagataaacagagaaagctttagcctacacttgaaaaattaaacatgaatggtgttatttctagagcattgccgccaactaaaaaaaaattcacttttgtatttttccttttaaaaaaatacatgagattgacccagtcaggactcagaaaatgataccccaaagtatgatgccttggcatgctgagtattttgaactaatggaaattgggaaggtctcagtaccatgtttttctgaccttcacccatcctcctgtctcctactcatatttctctcatgaaacaagccataaaaaccagaattcctcttccccaaggcagttattgaagctaaaatttttctctcccagagcaatcatgaaacctgtaagagtcacactctctccttcctcccttctccctttgaacaccttcattcaaaaggggtcctgctccatacccaggagtaaggaatgctacacaaacaggccaaggagaatctgagcaaatgggccttgctgagttcccaccttggtctctcaccattagatcatgcctttttgtccaatcgtatttcttcatggctgtcccattcttcattgaacctaagcataaaaatagacaagtttcctgggtctttgaggcttcatttatgaaggctcctatgtcacataacaccacttttttttttttttttttttgagacagagtctggctctgtcacccaggctggatggggtacagtggtgtaatctcagctcactgcaacctctgcctctcaggttcaagcagttctccagcctcagcctcccaagtagctgggattacaggtgcgcaccaccaagcctggctgatttttttgtatttttagtagagatggggtttcaccataatggcccggctggtctcgaactcctgacctcaagtgatctgcctgcctcagcatcccaaagagctgggattacaggaatgagccaccacacctggctaaaacctttattgaataaatttgttatgcttttctcttattaacctgtcttgttgtagaagtgtgggctataaccctggtgatgagtgaggaaagatatgacatacctctgcccctataaccctatccacagaactaactctgaaattataaatgaatgactttttaaaaaatgaaataaaagtgattattccaacagactagtaacatattccacttagagataacttaaaagagacattaaaatgaaaataaaggtatagatatacttttgttttgtttcgttttgttttggtaccatctgaattattatccatcattattggccatttttcatggtgaggaagaaaaaggcagcaaaagcaaaggtatgtttgattttcctctaaatgatatgaataaaatctacatgggtatggcaaacaaattagagagaagattaccccaatctctgcaaaatgaaacatgctacaatatgttttttcctccaagactgagataaggctataaataaacacataatatgggttttttttttcctctgaaaatttggaaaatattctagtttaacatgattatgtaggccgtcaccgtttttaaaaattgcattaagcccataaactcattctaaattggcagatctttaaaaaggatgtttatgtttacagattctaatgcttttgagaaaacagacacccatttccatttcctttgcttctcaacacatcatgctggtgacagatgtttctgaactgtttcaatgtccctgtctaaatagaaaatgcacacttaatgatacccatgtgtgtatatttctatttctagtcttatctttatatatctacaaaagattgttccccttggtaattatagtcctattcaatattaatgaattattggcagaaagtcactttttatgtatatatctacacacaaaagatctgtttttgtacattatgatgactatagatactcacttatgtttgcttgtaaatgtaaatggtcacaatgttttatatatttttcttttaaaagcttaaacttcatatgcttattttcaaggcatatagtgaaggtattgtttattgtgagagagtaaaagaaaagcagcttagtgtcagctctgctgtctctgactaatctgcaagccacccactttaatggctcttcataaataattcaaattttaattatgctgccagcctctgacctgaagagaaatgaagaaagaaaaggaaaagaatgggccagggaaagcatatcagttgaatcaaattgtgcctacagtaaatgactttgtgtctcacagctgcactttcctactcaagatgcacctgcttcctcatttgcgatttttaaaaataatattagtgtcatctaggatacaccatttatgattatttactttctctatatctatcatatttacaaatacacacttacagatgaaaatatatacctagattataatagagtcccctaatcagatatctccccattgtttcccatttcagactctgttctgtctcctaaaaagtcactggggttcatcataatatcaggcatgttcatatcactgcaatgacacatcaggtttctgttatattaaaaaagaacacataagtcttcgtccaaacccaggtcttgtaagttattgttggaggaactgctgccaaatgaatggctggctgaatagatttaggaaaatcgaactgcatctgtcacacagaaagctggccaaggtagatctgacaggcgatacatggctgaatgatctcttcccacctaaaaacatcttttaattgcatcaggtctctcaatccacagttgagcatctgctcattagaaccaaagcactatttctcagattgaaatgctgaatctcactgtataattttcttctaaatattaccttacaattttcctaaagcaagcaaacccagtcatatttgatgtaagatctctggggccaaatctaatctatgcatattaacaatttttcctttctttttttttttttttttttttggtgtcagtataatttttgtccttctatttatttaacaaagaacacatttggatttcattcaagaaatccccacatcccatttacaataggtccttttggtttatttggaggactcacagatatatttccagaagttgatttaatctgctctgagttcctttttatttctgaataactaccttttacagcaaacccctgtgaaagatttggaaaatctatcggactttatacagaagtattatttagctgtctcgaagatgaattcatcttaaaattatatcattcttcaaccacttgccattatttgcagcccattttctgtttgcctataccctaaaattttgacttttcaatcattgccctctttattttcctccccccttatccagggtttaatttggagaactgagaggcaataaagaatctcttagaatctatatttttggtaacttattttattggtctaatctcaataaagaacctatatttttggcaacttattgctccaactccgtctgtatgatgataaaacagttagatggaaacacattctagctcattaaactgtctatttgatctacaagatggcaaatttatttgtgtatatgcatctttataatgtaccatttcttataaaattatatcaagacagtcttacaggagccattcagttaccttgaaaaaagccacaaaagcatttttattcaataaaccaatttggaagatgaaagagaaactgtctggcttttagacaataattaggtgtgtcttctttgtctatgtgaaatctaggttttgatttaagattgacaagtgcagggtgctatttgttatcaagtggacaggctactttgtaggtcactgctgttctaatctatttatgtttcaaccaattaagataagaatatgcttctctaagtactagtgagttagtttagcagaaaatttcatgaaaatggttgtaaatttacatgtagaaatatagcagtatggaaatcaactcataagaagtattttatgaaaccctaaatgcagtaggtcagtgcttcctaacagaagtctactggcaagaaaggttttcaactctttttttttgagatggatttttgctcttgtcactcaggctggagtgcaatggtgtgatctcggctcactgcaacctccgcctcccggtttcaagctattctcctgcctcagcctcccgagtaggcaggattacaggtacctatcaccacgcctggctagtttttgtatttttagcagagatgaggtttcacaattttggccaggctggtcttgaactcctgacctcaggtgatccgcccacctctgcctctcaaagtgctgggattacaggggtgagccactgcacccagcctcaactaattcttaacaaaaatgtgtttgaccttttcctatgtccagctaaattgtaagaagaactgtactaccttaaagaaagccgaatctaaaaagtatttgatttgcttgtcatatccatttcaatcacaggacaaactacttctgaaaaatttttatccatcaaaaaatctattggactctatgcaaaagtctcaaagattaatctatcttaaaattatatcattcttcaagcacttgcctagaagttttcaatgaatgtgtacagaatatagccttcttaaaactggcaaatcaatttagattcaaatagattcaagacaaatatcacaatcctaaaatgactctttataaaaatagcatttatttttcagtgaaaaatacatttgtgaaaaaggctatactatggttttgatttaaaggataagcactttttatatgtgcatttgtgtgagtgtgcgtgtataaaatccctttacttacattttgcccatttttcttcagattgctaatcttttgcttattgatctgtaggtctgactttctgatataaatacaaccttacagttcataagtgtcacaattagttatgccccagaaccaaatgaaaagaaattcaaatcaggaaaacagctcagaataatttgtttgctaacgattcatctgaagactttcaattatagtacctaattgtataatatggtattactgtataccattattgagtactcatctatttctcccattagcctggaagttctaatagggttctaaatagaatccttctttttataactgtcacctcatacttttcctcatttacaacagcaaacatgattatcttactgaattgaagaaacgaaagcttttgaaagcccttaaacctacaaactcggctgggtgtggtggttcactcctgtaatcccagcactttgggaggccgaggtgggcggatcacgaggtcaggagatcaagaccatcctggctaacacggtgaaaccccgtctctactaaaaatacaaaaagaaattagccgggcgtggtggcgggtgcctgtagtctcagctactcgggagcctgaggcaggagaatggtgtgaacccaggaggcacagcttgcagtgagccaagatcgcaccattgcactccagcctgagtgacagagtgagactccatctcaaaaacaaaacaaaacaaaaaaacctacagactctacaagctgcctatttagggaacaaaaataaataaagaattaacaattattttgctacttttggtaaattaagttacttaaatattttacataggcagaagaaaaatctacgtttggcataaagttgtttttatccttttacacaaaagtatttgcgaaatattaagtggagtttagaaagattaaaattgttcaaagaacacagtgcaataattgcatcaaagttaaaatttgtcttttttaaaggaagtttcacggtaaatgtctaagataatgtttcaatattaaatactcagcaaatacttaactgagcataatatatcacagatatgatataacctttaaaggttctttcacaaaaataaataaaacagccagcaaaggtattacggagagaacctgaaacatactgtttaacgtttatttaattacaaaaatttactgggggcaaccaagtcactcactctccctctaattacacgcagtccttttttttcttctcttcgcttcttcttattcaaccaaaaccagaaatatcaaaacagaagagttaattattggggatgtgtggaccatggttgggaaaaatgttgagaaattatttgggctatgtggagcaagctgtcttgcataaaaagctatattgggctctagagaaagtgagaatggaaagaatttgagagatacctgagaccaaaaaaaaaaaaaagacacaattaagaatgttgaatagaatacaatgacaagaagcctttccaagacagtaaatccaaaaagcctgctaaatagcataagacaggaaaaagataaggaagcaaagggtggctgggaagctttaatccagagctcccgatgtacaagagaggctggcaacaggaaattgaaaagacagtggttctggccagaacaggagcagatgatgaaatggcatagaaaaattgataggaaatgcaaacagttttaaaaagaaagttgatgcctctcttgtatactctttcttggttatgcaaacctgaaacctagatgtcttcttttctatcaatgctcaccttcagcgacgcaacaagacctacacatagtccctctttcctatatctcccatcgcctctatttgcagaactgtttccctttaagctgtcttcaccatcctgaatttctttaatagtctccttggtagcttcctgcatctgattttgaacccctctgactcatacaccccttacagctgccaatgtaaatttacaaaaataccaatcttattctccttttttcatacattttacagacaagccatagaattcaaatccagatgtgcccactcttaagtgtaaaggactccaagggcagatgctatacaagacccttcattactgtcctctacctacttttccagcctcatgtctcaccattttcttcctgcttcataactttgcattgtgtaccacccgaaattctctagaatattctctttacctaaggagtcagagaatatagatgagtttaaaattgatatgctttatcatctatatgcttccatggtacttgtgcatctacaagaattacttgtttatttgacaattttccccactgcactgtgaggtccttaaggcagacactgtccttcaactctacatcctttgtacccagcttaatgtccaaaacataagaggtacttagtaaacattttctgagtgaatgattgaggcatcagcaacaccaggaagaaagtggcagacaagaattaaccccttcatttacattctctcttcttccaatgtcacagcaattttttcaagctccaattcacttttcttattattagagtgcttcagtagatgaacaatgttaccaacagtcaacacaaactttactgacatattcacaaaaaaatcatctctaaaatcactccaatgtttttctatgttgtaacagcaagcagcattggaggctgaggcatctaagatacaaagagaatacaagaaagactccaatgccttattttgttatacagttctgcatcattgttctgcccttctggtttccatatcttgaattccagctttataggcccataacttggctttctatctaactaaattcttcagctgttctctcctcagctatctctgacatgcactgttaatctttgtttttgttttttgcttttttagtatttatccaaacatcttcatgctcttgagtcattggctattccccaaacccaaaaggtagctattgtcatgacttctattactataaattagttttggctaatttacttacccctttacttcatatatattgaatcatataacacgtagtcttctccatctgggctctttggctcatcactattgttgtgagatatataattgttgctacgtacagaaatattttgttctttttattgctgtgcagttttctgtgtatgtatacacctcggtttatttatccaatctttcgttaaaggacatttgggttgtttccagttaaggactattgtgaataaaaatgtgtatctgttgggagacatgtattcatttctgttggaaatatcctagaaattgctggattgtagggtaggtactgccaaagaattttccaaagtggtttctgtgaaatggatatccacacatctaatgtatttaagttccagtttctccatatgctagctcctctcttctatccaaattttaattcttgttttttaagttgtggtcattctagtaaatttctacacagactctttcaaagtcgtcattaccaaactcctattaaccacttctttggatttcactcattgtttaacttatttcattatgtcctttgtctaactactcttatgtcccatttcaagctaactgtattttctccataatcatctttcttgaactgtattccttatttaactacaaactacttctttatccaaactcattcctgtgctgcatcagatgacaaatgagtgtcataattcccatgagactctggctctatttcattcttccactctataaatacagtgttttaaccccagattcaggcctctgctctggcttttttcatgtcaattgtcacctaaatgaaagtacatatccactaccatcctctctctcagaagtgtcaatcttctaattccatttgctgttcgacagctacagcaatagagtctaccatcacctcaaattcatcatgtagaaaagaaaagtaccactttctctagaaactagatcccctctagtccaaataccatgatgtacacagtcattcaatctgaagacctgagtcattcatttttactcttatttctcccctacatgcagtaaatgaataaattctcttgattctttatcaaattttatttcctttatcatctaaatatatagttatttcattaaaatagaacatttttaattataattgtattcattttctaccatccacaaatgaacccattatcacttgtcaaatttcacacatgcttgctaatttctaatttattgattgtggttctcagactatcatcaataccaccaccattaacaaagcatatcatcatgccatatttttgaataaatatattctcccttttgtgtgtgaaaaatagtacgttgttttattatttctatttggaagttgagaaaaaataagctttagatgcacagttattaattagagccaaggagataaacaggcatcaagagtaaggtaaatggctagaccagcaaagcagctaattacaatggaaaactctaataatcattttcctctttcctgaatcgatttcaactttttcaaaataaataatatttataatcatagacaatagatgatggataaatggctagaccaggaaagcagctaattacaatggaaaactctaataatcactttcttcttcctgaatctatttcaactttttcaaaataaacaatatttataatcctagacagtagataatggactagcaatctaaacattactaaaaaaaaggaaaaataaatttacagaagtcaaagctcaattaagcagaaacccaaaatgagtaatttatgagagaaaacttctgacagatttttttctctcaatataatctctaaaagacagatattctataaaacataaatagaatctaaattgtagtattccagcttttagaaaggaagaattctgacagcaagagtattggaatatatgacaaaaatataaaatagcctttattgaggaacttttgtactataggtagtccagtggcggcatcagtcatccaatagtaataatagttgtagtcatgtgttcaacaccctctaatatgccagtgagaagctggaaaaaattactgtagtggcttaaacatatgtctacaaatttgatacatcttccttcaagtggtcggctggatacagcaactcacttctcacaaatagcataaagtagaaaggatagcacgcaacgtaagaaactaggttgtaaaaggtaatgtgaatccctccttgtactttcttgaattgctcactgttggggaagttagctaccatggttaggtgttgtggaaagaagcccaagtggcaaggaactgaggtctcctgccaatagccatgtatacaaaccaccttagaagtggatcttctgaaaacaaaagaataaaggtactactaagaaaattcaaaaatcagcgtaatatcctagtacttcttttggtaaacttatttctgaatgtttccgtttgttgctattataaataacattgttttcttcatttcaaaaaaaatgtgcacagtgaaaatttaaaaagtagatcttgcagcaccaggtaagccatcagagaagcaccacctaagaaagcctgagaaagactcattcaggtaagccactcctaatttcctgacccatggaaactatgagatcagaaatatttgttattttaagccactttattttgaggtaattcattatatgtagcaataaggaaacgtaccaataaagaactaatactactaactaataaacaactttgatattatgttctaaataaaatcacaaaataaagttaaataaataaaataaaagtgagatgccatttgttatctaccaacttcgttgcctaaaaaataatatccaatattgaagaggagatagaaacacactatcataaactgctaaacaattccagatggataatctggcaagctctattcatagtttttaaataataataatataccttttgatatagctcaactttgagaatttatgctaaggaaataagaaatttgtacatctatttctatataaaaatgtttacaggattgatatttgtggtattaaaaactggagttcttctaaattagtcataggtactggcatatacatacgatgttgccattatgattctattttatatattatttattatgtattattgtatatcttctctataatataatattttctattttattattatttttagaaacaggatcttgctatgttgcctgggctgtagctattcacagatgtgatcatagcacactgaggccttgaactcctggcctcaagtgatcctcctgcttcagctacccaagtagctttgaccacaggagcaccctaccatgcctggattattttatttcatttttatatttgatgaaataggaaaacattctgaatatattaattgcaaatgaagggtataattccaatttaataaaagttgtgtgcgtatgcatgcataagtgtgcagatgtatttgcgcctgcatacaggtgcacgtgattatgtaagaatagaaagaagaatgaaaataaaagcttctcgatgttaataatatttatacctgggtgtagaattaagaatatgcttcattttctactttgcacttacccatattatcagtttcttaacaatgagaatgtaatttttctactgaagaaaataatcccagtcattgtaacacactgtgactgctgttctagaagaccatatgtcatttgacccctggctacccctctgaactctccttatatactctcgcacttgctcattaagctccaaccacagtgaccctcctgatcttggaactcaaacagctccctctgtcacagagcctgcgcactaacccctccttttcctagaatggcattttcacatcttctcatggctcctctcacgactgtatcttcctctccagtcactgagagtatcttttgaccaccaaattcaaagcagcctgccttggcaatacattaaaaactatgtttcccagatttccaatcttctcagtacttttatactataaaaagtctattattttctttattgcatatttactttaatttgtaaacataaaattaccatctggaaacttgcctgtcttggttactactgtatccctagttcctagaaatagcaaaaattcatgaaacgttttcttaataagtgagtcctagagtgaatgcttcatttaagttgctgaccatcacatattctttacactgtcttcactcttgggttatagacaccgcacactctaatttttcttcctacatttctaatcagtactgctttctcgttcactgagtcaatcactgttagattattcttatttaagtgcaaaaaggggaaagcaatgtggggagcaccatatctatattgaataatgtacaggggctcatatgaatacaatacacttccacactcaaaagaacactagattacaaactctatgaggggaggcaattcttttttgttggttctagctcctaaatcagtgcctgacatacattaagcacccaatagataaatatgtgttcaatacaggtatttatgaatgaatgaatgaatgaatgaatgaatgaataatggccaatatattttgttccatgcatcataaaaatgacataacttaaaggaataaaataaaacaagccaaattttattatctgcaaggtcacacagtatgacctaaagcatgtagcaacaaaagtatactgagtgaaaattatttgctcatgaaccaatctcatatgcaagcactaagcaaatttgatatgaaatatatagactgctttacaatgcacagctttttccatcaagcagccagctatccggtgatgccaattaaatcacagcataaatttatcacttaaatttattagtgataaaagatcaaaatttacttagaacctacagcaagatccttgcctctgtcatgtagttccctaaaaaagaactggaaacaataccacatttgaactgttctctcaagtaatcagaatttcaataccactcccctgtttataactcctttttaaaattcagatccatctcagagcatgtgcccagcagtgtttgcccattatttaacactttctttttaacttctctgatcttcttgaatagataccacagctgttcacccaaggtgaatgtgaaaccccctatcagattgctcgctgattctatcagtcccaaaagcagatctatcattatctctggaaggggtctttctgcagagagcccagagtttgtgtatgcttttagtatactctccagcatgacaaacaccatctatctggctttacactgtcatttccactgaaaacctgtaattactttccacaagcaacacttcatcctgccaagctgattaaaggcaatacgcacaggaaggcaaagagtagcagcgctcagatatcaaaacatttatcttataagcaacactgcaacggcatgcacacagtaagcactaaataattgtttttagatattacatttgctctttgacagacaatatagttaatgattttctcatgaaacataatagtctcttaaagagtgaatagggcagatcaaaatggacttctgaactgccgtttatttaaaatattccaccataacggacatatcattccagggtcttcactctcaccatctagtttacatctacaccaaataagttaattacttaactattatcatttcttgacaggcaaaccggtaggcaggtacttttcctatcatattctttaactgagttgaatctacttactttggctgattagagccatcaggtttctgcagaagagtgtttggagacagcatcaagaagtatttaattgcaattagataaactttatagtggacacttgtcacagttttatttatttgttgttgtacattaaaacatctttctatatttggggaatttcccaagatataaactatgttgaaagtcaatgttcacatccaagtagagaaatcaaaagcttgttttccctacttccttcgcacctgggacttggccaaacagtttcatttagccaatcagatggacctgccttggatttttaatcctaaactaatgacgtagagaagcaaggatagtgacagacccaccctggccgtggcagcaacatcagggcagcaatagccagtttgttttaggggcagaaatagtagctccaggtagcaatgtaaactatgtttctgttcagggatggtggcaagagtgtcctccccagtctggctcttaatgtgattttaagtttagttcttaattctgtgaattagccaatatattctttcaataaatatgtctgccatttaagtcagcttgtcactctattatttgaaaccacaaacacttactgggacagctttccagtagtgggtactttgatggatacattgacatccatctctccctttttctttttctttttcttttttttttttttagacagagtctcattctgtcgccaggctttagtgcagtggtgcaatctcggctcactgcaacctctgcctcctgtgttcaagcgattctcctgcctcagcctcccaagtagcttggactacaggcaaccaccaccataaccagctaatttttgtatttttagtagagatagggttcaccatgttggccaggatggtctcgatctcttgaccttatgatctgcctgcctcagcctcccaaagtgctgggaatacaggtgggagccaccctgcccagcctccatttctctttttttaacatcactttatgtttggccatttagagatcgttcaaaacgctagcagctaaaacacaatggttttgttggacagacttttcacatttatctgtgtagcagtgtcagtctaactcttatttgaatatttaattgcgttttgccttttcttttggagggggatgaagtctcgctgtgtcgcccaggctgtagtgcagtggcacaatctcggctcattgcaacctccacctcccaaattcaagtgattttcctgcctcagcccccgagtagctgggactacaggtgcccaccaccacgcccagataatttttgaattttcagtagagatggggtttcaccatattgaccagactggtctcgaactcctgaccttgtgatctgcccacctcagtctcccaaagcattgggattacaggcatgagccactgcgcccaaccccctttttttatattatacaacaatggctatagactggaaaagtaaaattgctggtacttggaataaaaccatgaatgtgattgccttagtagggttgtgacaatgatagacctaaaagaaaccagtctatcttcaacctcaaccggttgtgtgaggatacacacacacatacacaaaaatatgttgagaacatataattgaagattgtcataaaaaaatgcatatttgattttttaattttttacttttatttttttttttttgagatggagtctcgccctgtcgctcaggctggagtgcagtggtgtgatctcggctcacagcaacctccacctcctgggttcaagcaattctcctgccttagcctcccaagtagctgggaccacaggcacatgccaccacaccgggctaatttttgtatttttagtacagagagggtttcaccatgttagccaggttggtcctcgaactcctgacctcaagtgatccagccaccttagcctcccaaagtgctaggagtacaggtgtgagtcaccacacccagcctataactgaatttttaaaaaataatttttagctctctgacaacaaggctcctctctcctttaacatgtatgttaaccttcatttattcaacttttggtatgattcccatataaaaataggagattgtctgtatctatcaacttcttatgttaatacaatttattcaaaagatggaaggcaatttatttatttgaaacatcactgattacctaatatacttatatcaacaaacaaaattacacatcttcctggctgggcgcagtggctcatgcctgtaatcccagcactttgggaggccaaggcaggcagatcacctgaggtcgggagttggagaccagcctggccaacatggcaaaaccccataactaataaaaatacaaaaattagctggatctcagctactcaggaggctgaggcaggagaatcgcttgagcccaggaggcagaggttgcagtcagccaagatcataccactgcactccagcctgagagacagagtgagactctgtcttaaaaaaaaaaaaaaaaaaaaaaaattacatatcttcctgacaaaaagaaacttccaatcttgagtggagatgataagttccaaaaatggttaccaagtctgttataaaactcatgaacccttttatttctttggagtaagaaatacaacaattcaaacagaaattaataataacctacaagattgtaattgaatccccacatttttagttctattagttttattcgaatagaggatccaaaatttaaattaaaccttaatggcatcaaagcagatacagaggggtaagacttaaaatgcaagcacatgtaagggtctactcgttcagcacagacactcctgttgaaatgtcaacagaacacatgaattggttctcagtaatttcaaaggcttctaggaacctaagcaaaaccatgtgacttctctttcagcttctggctcccttaaagcttccaaccttccctcagccacccatcccagcatttcatccaaggaagctatgcagaaaagtcagtgccaaggttttctcttccataaaaatttcactgtattttgcaggccaactacatggtcagtatttggagaaagaatagaattttcttgttaaggtaattccattatgactaataggttcagaggggcaataaactgaaatgaatatgttctgcaaaagtatgtggatagagggttctttctgcccctcctctatttcaggctgcaatgcatccatttccattaataactggaatttatttatttatgtatgtatttatttatttatctgaagttattacaagtggtatagcccacttctgaacagttggcaattcaaattttagggaaagacacatactgcaaattaagaggccatctatagaatctgattatcaaccagtctgtagttgttataatccaaaatgactggctaataatgttttctctagggcatttcttcatcatcgactattaatacttctaaatctcagtgacaaagacctcttccccaagtttatattcatctcaatgaagataaatctgtataggactaaaactaaacagattccttaaataatatccagtctcttcttctaacctaacttttcataattgctctctccttagactgcagggttcccataacctactgctcctttaatagttccttttaataactgatctgttgttaagatttgaaaaaattaggtctccctgaataaaatcataataagtatatataccgcttattatttgtactctgtagctttagagttatttttttaacctaaaatgtaattagattgtgtcttaccacaagactaaacttggtccaggtaattttcacacaatctggtctctctgttcacagcttaagtgatcaaaactaattggacctaaatatctgtaacaatacaaaaatgatataattgcatgctattttctatgtcttctcttttaagtgacaagaaaaaaaggcacagtgattacacaaacaaaacactttttaaaaacctggtattgatttatttaaagtaaatcttgtgaatcaaaaagaaggactaaaaatatattaattttcaaatgaacaatgtattttattttgaatcataagtgaaaatacatgttacttgtatgatattttattgttagatttggctagtttccatttcaagacatttaacatataaaaatagtatgtgtgcatgctcatgtacatgtacatatatattacatatgacagagaggaaaatttgagtgacaaaagtactgacaaattataattttcagaattccaggacaaaagagctcataaggacaaaacacgaggctcaagtaattaataaaacagttctgtggcattttttgtttatgctaatatcttcccaaatgacactttgatgtgtgccatcttaatatatcctgaagagcacacaggcctgtcttcctactcccaagctgtagtccagctctggaagaagctaatgatcttcaccattacatgaaatttacattttttaaatttagaaaccaatttaggatcacagattctagaattttagcgttagaagctttttatgtaatctcatctaccccttttacatagaaaccttacttattaattattttaatttaattttattttttagagacagagttttgctttgatgcccaggctggaatgcactggtatgatcatagctcactgcagccttgaactcttgggctccagtgatcctcccacctcagcctcctgtgtagctgggactacagacacgtgcaccagtgcctgcctggaaattatttatttgtctgaggtcaaactgcaagtaaatgaagaaccaagacacaaatttaggctcctgatttggaatccattttagtgtatttccacagcagcaggtatatcatttgggtttcctttagctgcaagtaactgaaaatccaactcaaattggtctgatcattaaggaatttactaaactggagaacaaggaagtccagatgtaaagtgtgattcagtgttagttgactgaccacctccacatcagcatcaactaatcaagtcctccataatttaaaggctcctcttgttctcaggagactctggtttggggccagtggaaaagagagatttttcttcctcacaccactactgaagagacttgagctttgcattgataagactgctcttgaaccagtttttctagacaacagaagaccatgtgttaaccaacggaatcttgggtttttataagaacaagtcattgtgtcgagagacgcagtcccatgtcagtaactggtcagtgtcatccaaaccagatggatgctacacaaaggagaggggtggactcactgttcaagagacagccacaatgtccactacacaagacaatgtggacatataattttttcacccaaattcttaccaactaactgtcattccttagaaagtgaatattctcaattatatggagtttcacatagattaaaaagcaacattatgccaaaaaaattctgtcctctataatatttataaaattcagagttatgccttgcctttcattttatctgcacaaatatttctattaaaaaatagttcaaaacactgtaagcatatagcgggatatgataaagatgctatttttatagaatttgtatcaatgttaaatgtaagaatgaatataaatatcaaatgtacgtgtcattatgaactttcatttaatagctaaaatgatttataaatttaaaatattatatttaaaactctctgattccattctaaaattgacaattccctttataaatgtaatgtcatacatcctgcaataacttaggatgtttttcatgatagcaattttgaaaatctttcataatattgtaaatatcaagaaaacaaagcaaagaaaaaaagaaaaaagaaagaaaaaaactccatgtgccaaagctaaatctaatctgttggccaggcacagtggctcatgcctgtaatcccagcactttgggaggccgaggtgggtggaacacttgaggtcagaagttcaagaccaaccttgtcaacatggtgaaactccttctctactaaaaatacaaaaagttagctggatgtggtgacccccgcctgtagtcccagctacttcggaggctgaggtaggagaatcccttgaacccaggaggcggaggttgcagtaagcagagattgcaccactgcactccagcctgggggacagaaccagattctgtctctaaaatataaaataaaataaaaataaatctaatctgttattgcagttatgttcggatccaccgagtgatctagggaagttggggaatatcggaattgaaaatacccagtatgctcccaacaagttccagggagaaaaatctatgtgaaagttgtaactgatgcatcctgatccatgggttgacccctttgagacaggtaagagctgtgggcaggaaggttagcaggatttgtgagaaaaactcttagcagaaggagggcgtgtctgatttcccagtatacttaacctaagtaattatcctattttcttatatttataactagttcatatactgccaacaaataaaatgatgttttcataattccattttattaaacaaagtgttgtgtaaataaaattgtaaaatgtgggggggggaatcacagagggttatctataaaaatatccaaaacaataaaattgattcctaagtaagaagacatctttgaggatatttctgatttgttttcctttagttcaaatttattttatgtgcgtgtggcagggagggtgtgggaaggggcacctcaggtacaccatgcacattcctacaatacattacaaatttaaacgctgcaattcgcctaatataagaatcaaattaaataaaactggtaatgccatggcaatggtgactatgcattcagaatttttcaaatatttttaactttataatagaaccttcatttaaacatctgaatcgagagacagattttgtttcccacgctccttacaatgtattataagaaatctgctactacaattgtattttgaccatattagaccttccctgaagaataccaatctaactgcggctattaaaaaaaaaaattgaagttaaaaaaatttcatttcagaaaatagtgtacctatcttttccattctgtgttccagaattcaacctgagttttctcaaattgttgttttatgagacatttacaaagctgtcttccacaaagtttccttctaacattagaagaagacaactcaatgcttattatatgcaaggctgggcaggtgaacagtgaaaagataagccaggaaggatccagcatctaaatagcttatgattttatagaactttaaaatttacaaaaaagcatagatatttattcaagtattaaaacatataatcaaatagcataaatgttgatagagttcctaacaagcaatttcatatggagattaaaacattaatggagaattttaagtgaacggtatctgtgaaaatggagagcaagttctaaggacttaggagtaaaaatgatatggtcttggaagaagatgataggaggaagattcttatatactaacaatcaccataaagaatctctattttttttagtaacataaggtcacacatggactttgggacattaaattgcataagggaaaaatagcattaatgcatgtaactagtacaataatgcaaaaactaatgaaacagagctgaacatctagaaacaaattagcagatatataattttttaaataaatgagaacatgattctagaatgatcacttaactatttggaaagaaaaataaaaagatgcccaccttgcagcatgtaagcccattcatatagattaagaggttaaacatgaggggaaataaatcagaaaacaatgaaagcataaattaaaagaaaaggaaacagctcaagttagagatggtctgtttaagcaaaacttcaaatatagaaactacaaagaactgggtgtagtggtgtgcacctgtagtcccagatactagagaggctgaggcaggaagatcacttgaggcaggaggtggaggctctactgtgctatgataaccactgtactccagcctgggcaacataagagccttctccaaaaaaaaaaagaaaaaaaagaaaaaggaaaaaaactataaagaaaaaggtaaatctacacaaatttaaaaataaaagataaaagcaaactgaaataaatatgagcatcacgtatcttgtatctccaagggcgagaccatgcaggttaatgtagaaactggcttagaggtttaactgatacattaaaaaaccactggagtttgcccaggtatttactattttccctcttgttgtgagggttaatacagttgtcttagtccattcaggctgctgtaacaaaataccctagactgagtcatttataaacaaagaaatttatttctcagttctgaaggctggcaagttcaagaccaaggcaccagtacattcagtgtctgatgagggcttgctctctgcttcaaagatggcacctagttactgagtcctcacatggcaggaggagctgaagagcaaggaaggtaaactctctccttcaagcccttctgtacagcgctaatggcatccaggagagcagagccctcatgaccttattacctgtgagaggcctcacctcataataccatcaccttgagggttaagttccaatataggagttgtggagaaacatcaacattcaggccataggaatagtatatatgtggcttgggttgtctttgtaatgtacataagaccctgagaggtccagcccttcagaacttaacaaaactcaaatttttacgcatccattttttttttaaatagccccaacaaacagatttttagccacacaggagactgcctcctttgtgtattccttaaaactccacccacatctactagcaatagatcaaataagcccggggcgatgaaaatcccaaggccctgctgccatgcagagctctttgatccacaaccacccccagtgctgcttaatcactgcacatagacatgtaagcctcctctctgattcccctcttcccaggagctccccttgccctcctcctcttctcgatggtggtcatggccataagcttccagatggcttcatgctgtgagagacttcctcgctcttgcattcctgttcaagggctgcccaataaaacctgttttgtggtaatgcctctcatggtcatatctttcctcaatcaggccccaaatcctttgaaccccctacacagcccaaccctgtgcaatcctgcagtcctagccaaggtacctttcccagactgaaaagtgtcatgatatgcagtacgtactcttgaaatagttattcccttatttacttataacatataagtaactctgaaattcttcagctcttaaatgaagtacgtaactgttataaaaaaagtaaatgctgagcagggggtgataaggaggtgtcagggcagtactatccatatattatggtagctttgggttgcagcacattggctggatccactatgattagtggactatatgtaacattttaaaattgaaccctttgaagagtaaatgtgagtagcatatatgaacgcatgggacaggacttttcctggtaaactggaacatatggttaccctaattattttgacaatgacatatttaaaaacttgatactggaggccatgggaccctctatgaaaaacacaggttatgaagactctttcctacttggtgatgtcttacgttaaagtacgcaacactggcacagctgataaaatacagttgggggtatgcacatgaatgaatcattctattatttgtagatcaatgattaaaaagccacagatggattccagtgaattactcctgaggaactgaaagcattttcttgggctatccaatggcaatatttgttgttctccttttcccttgtctcttcttcctctctgtctctgctctgccacgcccccttgtaatacaccactgtttcgtactttttctcctttttttccttctctcccatatctgcttatttaacatttgtgtgtctgccagtagcttttatagatattacttgctatctaggggctttaatcacctagacagcaacataaagttgttttggaagaaagggtcccaagcgattgagaaacaccctttctctgggaagtctgtttttcctgtcttatcactgtccctgttggtgcttgtcctctgctctcttaccctcatactcgctatttttcttgctgaaaaagaaacagatttataatcactcgcaggaaactctgattctcacatatttactaaaacacacacacaccccaaaactacctactcaaaataattttaaaactcattgaaatggacacaaggtttatccaggcaaaaacagatatacaagtatcttatagctttttataatctaagcaaaatacaaagttgtacaatctttccaaagtgattttctgaagtcctgtttctagcttggttcattgtcctaagtttccctactttcatattctgaggcagacactgattattgacgtagcaaagcctggtgggagaaggcagattagatcatgtctcaatacctcatctggtcttaaaaagctttagtttattctcacacaaaaaaagaaagaaagcaaaaagaaaaatgttttattttcttttttttaatcaccaattggtttttgcttctttagccaagttactttgtccccatgcctatttaagtgtgtggagatttttccccccatttacaaagatgaaatagactccatgggctgcttggaacacatttaacttatctataggtttcaaaagcacagcaggtccagggcatgaaaaaggcaggcaggtgctctttgcatcctgcaccatttaacaagcacgcacagatttaaagagtaatttcttctcttctcaatcatcagctgatctaatttatagttcatttattattaattatcactgtcttcacattctttttaatcatatatgtctccaaccaagggtaatgacaattagcgccaatgtattatttttccttttcctgtagaattccagtaagtaacttcaagtctaattgcacagtccctgacatacaaatatattagcatgtggtaaatctagcttagacttttggcttcttcttttctttctttttttttttaatacactagagtcccttgtttatttccaaaaacaaatttcttagtaacttaaattatatttaggcaggcagttttagcaataaggtcactggcctcaaggatggatgttatccttggctgggatgttctggagaaataaccacattgaattctattatatctcctcccacatgcaccccaatgcacagttgtgtttgttttccattttctttctcatacacaacatctgtcctatatgcttcactgcactgttttttagtgaagaaaatgcagctgagaaaggaaatgaatatcaaattcagagctcccaggagaggtgacccaaattctcaaatgatagcattatgatgcactttctactttcagatctgggataccatagtatgattccttaatgatttaaatgtcatgtactttggcaagctctctctgacaacccttttaaaaatgatgcagacaattaaaataatgagagaacaaattatcagccatctaacaacaaacataaaagtataaagctctgagagttacaagggctaagaatagggcttgtttatctccttacttttttttgtttttttttgagacagagtctcgctctgtcgcccaggctggagtgcagtggtgcgatctgcaagctccgcctcccgggtttacaccattctcctgcctcagcctcccgagtagctggcactacaggagcccaccaccatgcccggctaattttttttttttttttgtatttttagtagagatggggtttcactgtgttagccgggatggactcgatctcctgacctcgtgatctgcccgcctcggcctcccaaagtgctgggattacaggcgtgagccaccgcgcccggccccaagttttttatataaaggtcttcaagtgccatagagtaaactttcctgcaattctcttcttagcatccattccagtattaaaacttgttttgtttttcagtatttcttaaaagatgttattatttgtgactcccttttatcctacccttgtcctctaaaagttatattatgaataattttaataaaattacaggaagagaagattgtttggggcagttaaggtaactgaagggactatagaaggagcactcacattaaaagatgtattattttgcttctatacacacacacacacacacacacacacacacacacacatttgaatgcttagcttcttttaacaaagagttattgaattgatacattctgttgagtcatccaggcagactaaaaattattcctgctaaaatatttgtatctcacaaggcatacttgtctctgaagacactgatttaatattccatatctgtaaggaatctgatgctaattgagcaggttttcttctagtattaattttaattatttagaacagcatgaagctcttcgtaatttcccacctgacaactgggacccaaaagaacagctgcctatggttttatgctcctatgagcatgctggatatcagagtcaataagtttaggcatgaattctctgtgtgttccattgaggttgtgaaaatcaagccttttggaggagttcagaggaaacctgcaactgagaatgatgtccatgccactgtgcaaagtgttatgacagtcatagatctcaaaggagctacaggaagcgaggctccctgctgtaatgaacgcagcccatagttaaataataaatcacagtcatgtatctagtctgcaacagccactacctatcagaaagtcaccatgaccacatagtgcaaatatttagttccacacagttataaatctggatgggatccaaataaagtagttatctatttgtcctttataaaacagaaaatgaatgctatttgtttatggtgaattgaaagtcaaaatatttgaatttatcaaatgcaaaaaagtacaataagacctagtcatatacctccacatttaaatataccccccagcatgactttaagaatcaagtatccaacatatacataatttagtacaaacatcttttgacacctcacatttttttcttttgcaaaagaacaaaaggcttcttgtacaaacacacaccattgtatctgctctcagatatgccaattcgcaatacaatgaacaagatgaattattcatttgacaactgaaattgtttgtggacgtaagtttgcagaggcctagaataaaaaggtaggtaaaaatgggactagaattgaacacagtaaaaaggcattaaccattccaaataatttaaccaactacataattaatttctaacttcaaggtatgataaaggtctttcattaaaaaattaaatatgactctcactgacttaaggcatagagggaaaaaacaccatttaacctaacagagctcaaacacagttcatttatcttgaatctctatcaacaaatacttggctctgaaacctcactcatctttgagaaaactctaatatttacggcctttttaaacgtgactgaaaagggaggaacttgtctttctaatgtttatatccctagtagttggcagagtgcttggcatatgccagtgatcagtaaatattgttgaatgaataaccttatcaatggcaccaggtatagggacatgacatactgtccccaagacaagtattttccactgaaaagactgcctcatcttacccttaacttttttgttgctgttgttcacttaaagtagaacctacattactgttgtgatttctgaagttcaagctgaaggctctttagaacaaattaaagcagagagaggctagaagttgaaatatcatttcagaagttgttcctattaggttggtgcaaaagtaattgcggtttttgccattacttttaatagcaaaaaccacagttatgtttgcaccaacctaatatattccaggtaagagttaatgaagttctgaactaagcgaaaggaagactaaaggacagaggcaagcataatacaggaaaaatcaaaaggatgcctcaaatattttcatgaggaggtaaaggaggaggaggcattaattgttgttattttaattttaggttatggcaaaaatagacaattcgacaaggaaacaggtacatctttcagcagtaatatactaagttgaaataagcacaaacctagacaagacgtaagagtccaagctaatctttgagggtaacacattgttttatataagaaagcaatataaattcatttccaattgcaaacagtttcattttattttttattaaatcatattttccccatataatataggtgttcaatttaaaagtcaatgagtactacaggtcgtatattaaaaaaaaaaaaaaagccatgaatttttttttttgagagggaatttcgctcttgttgccccagctggggtgcaatggcatgatctcggctcaccacaacctctgcctcctaggtttaagcgatgctcatgcctcagcctcccgagcagctgggattacaggcatgcaccaccatgccgggctaattttgtatttttagtagagatggggtttctccatgttggtcaggctggtctcaaactcccgacctcaggtgatccactcacctcggcctcccaaagtgctgggatttcagacgtgagcccccgcacccagtgaaagcattatttttaaaaagcctgccaccttccccactcttaattcacttctagagccagtcattttctactttcttttctttttttttttttcctttgagacagggtctggctctgttgcccaagatggagtacagtggtgcaatcacacctcactgcagcctcaaactcctgggcttaatggatcctcccacctcatcctccaaaccccatcccctactatctgggactacaagtgcaggccacttgtacatataattctatatcgatatagaattataattctatatcgatatagaattctatatctataaaattctatattatatatttaaaatattctatatataatatatatactatatagaatatagtgtatatataattcctttatatatagtatatataatatataaatatacatctatttagatatatagatatctttatacatctatttagatatatagatatctttatacatctatatctatctacatctacactagatatataatatctagatatataatatataaaatatatatttttattatatatattaaatatataatatataaaaatatattatatatatttttatatatagatagatctatatatagatagatctatatatgtgatatatagatatatataaatatatatatttatatttatatatactagatatataatatataaaaaatatatataaaatctatatttttatatctatctgtgtgtgtgtgtgcatatatatatatttttttttcttttttttctttttgtagagacgtggtctcactatgttgcccaggctggtctcaaattcctgggctctggtgatccttctgcctcaacctcccaaagtgctgagattacaggcgtgagccactgcacccagcccagagctaaatgttttcagttatgttagctatttttgttatatacttccatttttaaatataacactctaaaactgctatacatttttaaaatttagataatatccacaaaattgttttatcaaaatacatatttatttttcttttgttactttcccttccccactacaaacacacacatacatacacacatgcacgcacacacacacacacacatttttctcttcctcaatttttccagtttagctagtggcaacttttaggtagttctataattcagtgctgacataattatgataatgaaaatattactcatagctaagcaatgtagtgtgctgtgacacttcctttattttacaacttattgatttccctggagttatacattctcaggttctctaaaggaaaacttagtcacttcaacaggatcaaatatattcagcaatccatctgcctcatgttttccttggagacataagtcctggataactccatcaccctgcacctatttgatgggattaaactccttgcttgctgctctgctgacatcagtaattgccttgcttcttcgtttccaatttcctgtttctttaaaacaatccatgtattccttttactgtttgtttccttgttttgttggagcacttcctccagtagcttcctgagaaaaggtgcatcgggaaaacaattttttgaaaatttacgtgctttaccttacacttgattgataatttggatatacaattctagtttggaaattatcatttctcagaatttttaaggtatttcacattgtctttagcttccagtgttattaaaaagtctactgcctttttgactattattccaatgtactgtcatttatctttctctctggagctgtaatataatttcttcagtgttcccaaacctcttgtcaacgtcctgttcattatttcacttcctacttatgatgtctttcaatctggcttccaagtccattagttatgggaaattatacatgggtatatataatttaaataaacaaattttatatgaatatatgagtaagcattcttactatatacaaatatatgagaatcacaaatacatatgtatgcatatatgtatatgtgagtatatacaaatatatacacacacacacatacacattaaaaaataatttcttccccttgattttttttctttcttttcggaaaccttattttatacttcatagactgatctaatttcctatgactttatcttctattttttatttctttgccttttttctaggagagtctccttaactttacctttcttcacttctacttaatgttgcagttatgaatttttataaattatctcaatggcccttttatatagcactctaaatcttgttttacacatgaaagatctcttatctaaggatgtataatatcattttttgaagttttcttcagtttcctgcattgtctcggttgcctctgttttttgcttttgtcttttttttctttttatcctgtttgtcattttgactttctcattaagttcaaagctttcttcaatcatacataatctttgtttatccatatttaagagtaagactttgaaaagctagttgaaagcccattctgcatgggcaggtttgctaacaggtaagtagggtgttcagttggtgacctggccattttgtttgcaaatcccaaaatgtcagtctctgaagagctcctctcttgtgccaatagctgcagaaattacgtttacaaactcctttctaattctaggattcaagaagggaggagcctgggtatctcacacctcaaagaagaggctttatttaattctaaaatagtttcctgttttagaatgatgcctcatacatctcttagctccagctatctctgagtccagagcttcttgggttcaacccagggctgagttcagtatgggaaggatctgggaatataatttattttaaacactttcaatgaatctttatgttttcagctatattttgcacccagctttttaaaggcagcttgtggctcctgtttctaaaatcttccagagatatgaggtgcaaatgtgattatttcccaatagaaatatttattatatattatcccagtagaggcccttagctttttgctctttctgctcttagaagacaatgatctctcttctggctctacaattttgttagcatttcttatctgacactatcttctcttttatcatctttatcctcacagatttaagtcttcatttttcctttattttattccaatggggcatttgaaagaaaataaagatagatatgcttgttcaagccaccatgcttaatcaaaactctagtaaactgaactattttaacataacataaattgttcggctatattttaatatggctaaatatctagtcaagatattcttatttcttactactaaaagtacttaaaattgacagtaaaaataacttggcctttattacataaaattcaaatatttttggtttgatgtagaagtcagctgtaacatagatgcaggatggaaattttaacttgatattaggctcctttatcacaggtcttctcttgaatctaggaattcggttattcacacttgcaatttctatatggtgacatgactcatcatttatttttactataattaagttttctgctgcaacagaaatatgactttttgtactctgagatgagctattttattctggaaggaaaaataaatttcacaataaaaagcagattgactaatggttaatgataagtcatgtcattaagtatctcccaatgttaaaaatatgtcatgagtcatgaaatctagtaagctaaaataattacagaggaatccctgcaacaaaacagatgataaaccaaatttaaagcagttatatatctgaagcccaaccatgtagaagaaaatttaaaccaacagcctacaaagtaagtatcaatcttatcattctgaaactttgtaaaggaattacactaataaatttgagttaattttttaatttatatttttctagctacattttatgttgttaaaatgttttacttttacatgatatatccaatttataaacatctacatgacaaaaaaagaaagttaaatcagtccaagacatatcaactgcagaaaactaatacagggctcatagttataatttgtcaatattttacttgctaagttaaaaaggagaaagacaaaagacttgccatctaattattaattacacaaaaatctttcaggaaaggaagtgaaacttgagacatcgtttttggagaacacctatatttccaatacttcattttgcccatttcctcaaatattctataaaggaaaaagaaccttaaacataaatgttaatgtaaaaggtttcttgttacagtaaaataacaaagtggggagatattgatcaaaaggtataaaatttcagttagacaggtggaataagttcaagagacacaaggtgagtataattaataacaatttattgtatacttgaaaatgtctaagaaagtagcttgtatttttttttttttgagacagggtctcactctgtcgcccaagctggagtacagtggcgcaatcactgctcattgcagccttgaccccccaggctccagcgatcctcctgcctcagcctccccagtggctgagattacagctgtacaccactatgcactatacctcgctaatttctttctttcttttttttttcttttaagagatggggtttcaccatgttgcctaggctagtctcgaactcctgaactcaagcgatcctcccatctcagcctcccaaagtgttgagattactcagcctcccaaagtgttgagattagtgatttatagtgtataaacataaatgagtcactattgctataacacagggccagtttgtgacaaaaaaaaaagtgtgaggatactgggttaacatgtagattctgatacccaaaggactataaatcatgctgctataaagacacatgaacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacacctcatgttctcactcatagatgggaattgaacaatgagaacacatggacacaggaaggggaacatcacactctggggactgttgcggggtgggggaaggggggagggatagcattaggagatatacctaatgctgaatgacgagttaatgggtgcagcacaccagcatggcacatgtatacatatataactaacctgcacattgtgcacacgtaccctaaaacttaaagtataataataattaaaaaaaaaaacatgtagattctgaagaggaaaaactatttctgtaagtgacccctttaaaatgggattaacatctcagagcatttctgacatccgaatcagttagctcaatgtgtctgctaaaattttgcagccttgggcactatagctgttacaagtaagtgaagctttatgctactgcaattaattagcagaaagacacctaattataaacctcttagaatagcaggaaggattttagagaaatttagacccaagatgcttaattgcacattttatttaaacaagttgtatgtctccttttaaagctatctgttaaactcctattcacttcagtatggactgatttaaaatgcagctatagcattccctgaccccatgccatcccacaacaaaacagagttaatcattctctcctatgtattaccactgtatgtggacattctttatgatttcatttgttatatagtattctgattaattgcatatgtaggtgaatatgaatttttgccactccaacctgtaggagcctagcaaatagttggcattcaataaataagaatctatgagatttaaaattaaaaggatttatgcatgtagttggtgactgcctatgtatctgcaaaaatcattttaaatgtcagggtttaggatactattatttctcattagtaaaaactcatattggcggggagtggtggcttatgcctgtaatctcagcattatgggaggcggaggtgggaagatcgcttaagtccaggagttggagaccagccagggaaacatagtgaggctctgtgtctaccaaaaaaaaaaaaaaaaaaaaaaaaattagccaggtatggtggcacacatctatagccccagctaatcaggtggctgaggcaggtgaatgaatcccttgagcccaggaggctgaggctgcagtgagcaaggtcgtgccactgcactccagcctgagcaacagagaccctgtctcaaaaaataaacaaatagaaaaaactcacattaaaatgtattaccctatttaatagtataacaacaatcttgatcattgatctgtaacatgaatgtctcctggcagctaatactaagataccacacctgttaatacttcctttgtggggggagatgttgaatggcaagctatcacttgttttcagttggtaacttcacataattagaagtgtgtttcttctaatattaccaatgctgttgcacaatagaaagaatgtatacaatttgtagactagcagagtcaacattccttttcaaaaaaaatttttgtaaaaaagtcattgtaattatagaataaaaagggtttctattaaacaaatgaacaaacagaattctaggatacaatggctacgtttttattcctgagatcacctttagcctttttaatgtagttgtagtctttaccaatatctgtgccttataacattggccagcttattctatatagcacattttcttgggaatgtattatatttcagatgctggaggctgttaataaagattttactataaaacaaaacgactaataagcaatcttaataaataattatgtattcatccaccttcataaacaagaaacaaccttaagtttcctcaattattttcttgtaatacggatatataagaagcagaatttattgccaaggggtggttttaattagaatcaagtagagtaaaattgaaattttaataattttttaaaaacctttcctcattaaatatattaaaacaaaattattatgaaatacatcactaactagaaaatgttattcaaaaactcttcaatacaaaaatgtttgcagctattgtagaattatacacaccgactggtaattattgagtaatatttagtatgaatttttaaaatgctccagtagcaaataatgactctaaaaactagtatcatgtaaatgttttccaccaatagggaatcccagggcaatgcagacattcccatctaccacccagttctttgatttctgagtgtactagtatatataaaaggactagaactgtaactgccactaaaagataacattacagagtggcattatgaagtcatctgagattccactgtcttctttcttcttctaagcttatatatttcagaaacataatccaggttttccattcttttctataatattgttaacatctgaatgaccgtatttactctctttacttaaaattggtgaccagaacttatgaataagtttcctttctttactttaaatttcatatttatagttcaatcatactatgaaatttatttttaaaaagagtgcaaatgtcttttttttttttttaagagacaagggtctcactatgttgcccatgctggaaagcaatggcttttcacaggcacacttcagcctctaactcctaggcttgagtgttctgagtagcaggggctataggcgcatgctaccacacccagctccaaatgtctaatgaggcaagtttatgtacatataattcaattaataagtaaaaataggccgggcacagtggctcacgcctataatctcagcactttgggaggccgaggtgggcggatcacctgcggtcaggagttcaagaccagcctggccaatatggtgaaaccccgtctctactaaaagtacacaaattggccgggcgtggtggcgggtgcatgtaatcccagctactcgggagactgaggcaggagaatcctttgaaccggggaggcagaggctgcagtgagctgagatcacgccattgcacccagcctgggtgaaaagagcgagactctgtcaaaaaaaaaaaaaaaaagtaaaaataatagtaaataccaagtcattttttactcacctggttaattgggaaaaaaaaattctctgcttatcatacaaacatgttgttaacattaaagacatactatgtacaaaatgaaagttgatcatataccaaattattctcagtaggtttttttgtttgttttggggggttttagggagaaagtaggttaaagtggaaacttttactttctcattattgttttgggtattttgcaatcagcattttctcagaaagaacagtgaagatagttttacttaaaaagttagatgagaatggctgggtgcggtggctcacgtctgtaatcccagcactttgggaggcaggagtgggcagatcacttgaggtcaggagttcgagaccagcctggccaacatggtgaaaccccatctctactaaaaatacaaaaattagccaggcgtggtggtaggcacctgtagtcccagctactggggaagctgaggcacaagatcacttgaacctgggaggcggaggttacactgagctgagatcatgtcactgcactccagcctaggcaacagagcaagactctatctcaaaaaaaaaaaaaaaagttagatgagagtagaatgcataatttcaaagtgtcttcacttcactatcacatctttcaaacttcagttttattatatgagtagcaatcagataaacataattgatttctacagccctaaattaataggattatagaaaatcagaaaatattagagagcttataaagggaaaaaacctatattttactcattaaccaacttattcattcagtaaatatttatagaacacccactatatatcaggaacgatgttaggcccaacaggtatgaagataaatatgaactgaaatgggcgcgtatggattttaccagttaggagacaatgaaacaaacaaaaacttgaatcatgaccgatctgtgatcattgctctgaagataatacaggtaggtgtctctcattcagaataacaataggggtgggtgtctgatttaaacaacatcgtcaagcaggctattttgatcttcacactgagacctaaggtaaagaaagaaaaagtaaataaagcacgaagttagggaattttttttttaagtaaagggaacagaatgtgcaaatactctcagacagcaataaagataaagaaggcctgtggactgaagcattgtaatgggtaaagaggaattaaatcagaaaggaaaggacaaactagatcatagaaggactcatagcccttaataggattacagataccattttaaatgaataatattttatacgtaaaagaatgaaaatttgaaaagctctttcatcatgtaatatacaaaccatgttgtccacataaaacaaaagtaaaagccatgagtaattcatataaaactaaaggttatcagaatatatatgaaaagcctcagtaatttgctatatttgctaccgtaagtatgcaggaaagaccatgttttcacagtaattatttctaactcctaaagtttaaacacgtcaaccatgttttccaacttaaggacattattaaatgatagtcaaccaaaggaagaaggcttcttaaattagaatacttagaatagtgaggttacagcaattcagaatactgagaattcaaatctaatccacaaatctgtcttctataataaaaataaataatgtaaaactaaaatattataaatataataatctagatttagtatttactttctaaaattaaaatatgcgtgaaactgatatagtctcatttttcaaaacagtctgaatactttaatataaggaaaaactaggatctgtattactggtgttagtgattataatgaagcagttgataacttccaaatttaaatttcacaaaggaagatttgttaggttgataaataacatccaaatgtagacattgcaatttaattaacatattacagtttcattgaatttgcataaaagttgagatggtaagaatgtgaatgactaaagaaaggtttgctatctttttttaatttatttttctttttgatggcgggggagggatggagtttcactcttgttgcccaggctggagtgcaaaggaatgacctcagctcaccgcaaactctgcctcctgggttcaagcaattctcctacctcagcctcccaagtagctgggattacaggcatgcgccaccacacccggttaattttgtatttttagtagagacggggtttctccatgttggtcaggctggtcttgaactccaacctcaggtgatccgcctgcctcagcctcccaaagtgctgggattataagcgtgagccaccgtgcccagccaggtttgctatcttaagagagtaacccaatgtcttagggtgatcatttttctcttataaacttgatgaatcaaaatataaatatatacatagtacaaaatgtaaatgttgccctaaccatacacaacgaaaaaagagttgttaagagtagcttgataatgatcctttttattcccaccaacatagatggtagaaaatttgatacctaattttcaagtatttcaaatatgaattcttttttaaataaattttcttacataaataagggatgtttgcattaaattgtgtattaattttggtaaataatacacacacacacacacacacacacacacacacacacacacacatagagagagagagacagaggctctcccaggctggagtgcagttgtgcaatctcagctgactgcaacctctgccttctgggttcaagaaattctcctgcctcagcctcccgagtagctggaattacgggtgcctgccaccatgcctggctaaatttttgtattttttagtagagatggggtttcaccatgttggccaggctggtctcgaactcctgacctcaggtaattcacccacctcagcctcccaaagtgctggaattataggcatgagccaccgcctggcctacgcttttatattttatagacagaatatatttaaattttctttcctaaataatgttccatgaacctataaactctattgaaataacaaaatctacatataactgtaccccttattagagttctagattttgggggtttttggtgatttttcatataaaaaatgttttatgtattaataaaatttccatttatgtaattgacacataaatttctaaatggtaacccctaatgtaggcaaagtgtgagagaacaagtacatccaaacattagaccatactttcacggcccaatttgatgatgtgtaataaaacgccttgaaatacacaaatcctcatctccatgatttctaattctttttttttttttttggagacggagtttcgctcttgatgcccaggctggagtgcaatggtgcaatctcggttcatggctggcgacctctgcctcccgggttcaggggattctcctgcctcagcctccccagtagctgggaaacaggcatgcaccaccacacccgggtaattttgtatttttagtagagatagggttcctccatgttggtcaggctggtctcgaactcccgaccgacctcatgtgaaccacctgcctcagcttccctaagcgctggaaatacaggcgtgagccactgtgcccagcctacaggatttctaattcttaaaatttattcaagcaataatcctgaatttcagaaatgactatgtacaagtcatgcatcccaacaataattatatatgtagacaaatataagctaaatataattgtctactaaaggggaatagttaagtaaatcctagaatgtctaaaagatagtttatacaaccgttaaaaaccatgtcacaaaagaagagttaacataggaggcatgatgatatgttggagaaatgacacaacatttggtttgttttttctgtttttttgtttgtttgttttttgagacagagtctccctctgtcgcccaggctggagtgcagtggtgcgatctcggctcactgcaagctccgcctcctgggttcatgccattctcccgcctcagcctcctgagtagctgggactacaggcgcccgccaccatgcccagctaattttgtttttgtatttttagtagagacgggatttcactatgttagccaggatggtctctatctcctgaccttgtgatctgcccaccttggcctctactaaaaatacaaagtgctgtgattacaggcgtgagccaccacatccggccaacatttggtctttaagaccaaaataattattatcaagacaactatattactcaaagcaagtacagatccattgcaatatctatcaaaattccaatgttatttttcacagaaatagaaaaaaaaattctaaactgtgtatgtaactaaaaaaaaaaaaaaaactcaagtagccaaagcaatcctgaactaaaagaatgaaactggaggcatcagtacctgacttcaaaatatattacaaggcaatagtaaccaaaatagtatggcattgctataaaaatagacacatagaccaatggaacagaacagagaactcaggaataaatccacctgtttacagccaactgattttttacaaaagcgctaagttgaaactgggcccctatctttcaccatatacaaaaatcaactaaagagggattaaagatgtaaatgtaagatccaaaactataaaattactacaagagaagataggggagacacttcagtacattggtctaggcaacaattctaaggccaggaccttaaaaacacaggcaacaaaaacaaaattagacaaatgggactatattaaacaaaagcttctgcacagcaaagaaaacaacagagtaaaaagacaacctattgaaggggagaaaatatttgcaaactattaatctgacaagggactaatatcaaggatatataaggaactcaaacaattcaacagttaaaaaatgggcagaggacatgaatagacatttctcaaaaggagacatacaaatggccaacaggtatattaaaaaaaagttcaacatcgctaatcatcagggaaatgcaaatcaaaaccacaatgcgttattatcttattccagctagaaggactattaataaaaggacaaaatgtaatagatgctgtgagaatgtagagaaaagagaactcttatatacttttggtagtaatgtaaattactacagccactacagaaaacagtatggagcttcctcaaaaaactaaaaattgaactaccatattatccaataatcccattagtggatattaatccaaaaaaaaaaaaaaagaaaatcagcgtattaaaaggatacctgcactcccaagtatgttgcagcactataacacaatagcaaagatagttatcagtctaagtgtccatcagcagatgaatagataaagaaaatgtggtagcatatagacttaatggaatactattgggccacaaaaaaagaatgaaattttgtcattagcagcaatatgaatggaaccggagatcattacgttaagtgaaataagccagaagcagaaagacaaatatcacatgttctcattcacatgtggatgctaaaaaagtttattttatggaggtaaaaagtataatgatagataaccagaggctaggaatattttaggggaggggtgtatagagaggggcataaagacaggttggttaatgggcacaaacacacaatgaaagagaaggaatgagttctaatgattgataacacagtaggggacaatagttaacaacaatgtattgtatatctcgaaatagctagaagagaggacttgatcagttcccaacacagaaacggaaaatatcaatgcgacagacaccctaaataccctgacttgatcgttacacattctatgcatgtaacaaaatatcatgtgtacaccgtaagtatgtacacatattatgtaatgactcaaaaaatgttaatgttaattttttaaaaaagaattgctattagtctcaaatagtcctaactctaccactaattaatgttgcaatcttgggtaatttatttatctgaatttcagataacttctctctaaaatgataattgtgaagaataacttatgaaattcatttgaattaagacactgtattttgtaagagtctcatgcacacattcacaggcatacaaagtattttggcataacaatgattcttaaagtaaatatatagaaataataggatgataataaagggaaccaaaaatatttcgctccaaaatatacttctttgacatattttgatatggctattcagagggtctacaaattaacgataatcctgaaagctgtcttttgtcaaggagacttgctctgtttaaaaagaatcttattagtgaaataaacaatcaagattgttctggggcctacaccttacctgcagatctaggaaattaactcaaccacagcctaccatccattatttctcagagctgctacctgtgaggtttcatctacataacaagactacctttgcccctttctctcctataacctgtcttgccatgctccaagtccctatactttttataacacaagatggtataaaaacaacaaccatctggcctattccttgagttttcatattttctatgatgctcatgcacatgtgtgcacaaataataaatttatatgattttctcctattaatttgcttttcgtcagttgattttcatcatatctatagagggcaaagggaaggtttccctacacttttggtgctatgagcaacgtaaccaaaagctcttttgaagctcttttgaagctgcagtcgagggaactcagaatctgtcaggctgacagaaaggtaaaaatttcttactagtcagatacccaggtgtctatctgtggaatccaattgagcagatagtgacagttactgtttttccttttccaaatttaagattaatgagagaaaagcatttatacagactagtcttaggttcagcgactctggtatatattttggaatattcatattgtctgatccttttcctcccagaaatagtcatgtgttttcctttgtctttgttttttgtgttgtcataaagtccctttggtcttgttttatgtccctgagagtctaccttgtcatcaaatggaatcactattttttggtctcagccatccagatggcatgattttggggtcatgtctggtagccagcgtgaaagaagtgagaaccctaagacaagtaagattttaagcagcacactctttgttctgaatttgccaacctctcaggtgaatatgtcttaagaagaagttccatccctttaagaagaaggggattttgctgtctcaagaagaaattgtgtcttaagaagaagttccatcctctaaagaagaagaaggagattttgctgtctcaacttttactacatggttagatctgggaaagtccaattgcacatggactatccattgtcacagattaatgggttagtgactggcagcttcccacaaatttctgagagactggagacatcgtatgcagaaataccatccttaacctgtggcaaaaagagacttctgctatcctaatctatttctgggagtgaattttctggaggatcatgaggcctgcatcttcgtttttaaaatgccacttatatccatggtgtgctaaacctggaaagttatctctgggactttccaagtaaaaggcttattagcttgagtcattaatagaataaataaaattggctacatttaaaagaaaaccttttagtgagtgtttctcttcaccagctctcttactggtatctacgaaaaaatacaaaaaaaaaaaaaaaatagccttaaaatctctcttggcaaaaacaacaaaaaggcagacaactgatttaaattaaaattaaaatcctttgtgttctcaacagcctgctttggtttctccatgggatctgcaaaaaaagcactccagcctgtggcctagtggctagggttctatgctcccacagctgcagccaaggtttgaatctcattagacactcagagagatgtggatgtaaattccttaacttaggagaaaaaataaacatttataagaattatataattctttttttaggtgtgggaatagagtcttgttctgttgcccaggctggagtgtaatggcaccatctcactcactacaaccactgcctcctgagttcaaggacttctgccttggcctcccaagtagctggaatttacaggtatgcgccaccacacctggctaatttttttgtatttttagtagagacagagtttcaccatgttggccgggctggttctgaactcctgacctcaagtgatcctcccgcctctgcctcccaaagtggtgggattacaggagcgagccaccatgcctgacaagaattatgtaattcttataaataactatataatttataaatttataattcttaaaataattatataatttataaatttataattcttataaagaattatataagaattagtttgaagttttgtaacttttgacattttggggtacccatttgttatagatcattttcccctccaaggagggctattgctctcctgttcatatctatgtccctttcttcttctagccatctttgggggtggctcttgatcttgttaggactgcttctttgcatctcttttgagatacctcttgcatccttgcttagtcattaaagacttactggttttgattctgagtcacttggtagataccttctgtttaaatgcaaagagggataaaaaatattcaaaagctggaatactggcagtttgtcccagcaaaaacctgatggtgaaagatttgaaaagattttacaagagctctatggtcatcagcttaattaaaagctgacattcaaactacatattttttaaacttctctgttctcttttggatcctgtttctcccacaggaatctttttcagtgaactaaaacgccatcctaattgtatgttcagtccctctgttgacttcctttcttattggcaagatttttgcttaaagaaaaaactaaaacttcattggccttttgcgaagcttgagatgtatccacactggctcctcttggactcaatgctccatttgattcttcccctcctttgccaccttcagtcttctacccagttccctttaatcattgattgttcccccttcaaacccatatttcttccattgggtcaatcaatggataaaaatgtactgaaaagaaacatgagagttacggttgtcacataaagggatcaaaaagggacttctaggaacgctgatatgccttcaaaacacagcgaaggtgccattgtctcctttttgggtaacctatcttcctcatagagccccaacagtcacaagtaggttcagccctaattcattcatgggctccaccctgaattcggtaatctagttaatttaagaaacagaaacttaaaaagccacctgttcaactaaatggatcttccaaatacaactctccaatattttgctgcccattttcaaacttcttgtaaaaaagatttacacctataagaaaactctccatttgtaagggaatctccctctctacaccaaaaccactggaaacccataccatgggaaaggcattcccttaaaaatttccataacaaacttttgtttaaggtatttttcctggctatgtgtcttaaatgggcctttacctatgcccttctttgtcttggcaaataatgaagtttacatacaagttctctgtctttgagacagaaattttctctcttaattcacctagggccatccctttagaagtgcaagtttaaggttgcctagctaacagttgcatagggcaatgaaacaggtgatctgaagattgatggtctaaatcgggtggagaagggctatttggaagttggcaaatgagaatttcaatgaaagctgcaagatttgattctgtgtctctttatgttatatgtctatatctgttatgtatatgtgatatttctaagtgaaccaacataatctttggtaaacaaagctagttttaaaattgttggtaaaggccaggtgcagtggctcatgcctgtaataccagcactttgggagaccgaggcgggtggatcacctgaggtcaggagttcaagatccacctggccaacatgacgaaaccctgtctctactaaaaatataaaaattagctgagcatggtggtggatgcctgtaatcccagcaactcaggaggttgaggcaggagaatttcttgaacctgggaggtgggggttgcagtgagccaagatcatgccattgcactccagcctaggtgacaagagtgaaactatgtctcaaaaaaaaaaaattgttgataaaatggaaagtcttcagaactatactaaatataattcagacatttttgcctgggtctactggttagccaggtaatttaaggtgtctgagctacaatttttaaggccatgaaactgctgcctctgtaatattttttatgcttgtttaatttctctgtaatctaaagctgtaaacgctggctgctggattcttccaaatccctgtaaatatctttatgtgagcttctatctttggttttgagcctctggatgctggagtctggagaagtggccatagtaagacctggaaacacatgtgtgtccatggcacgtggcccaccaactgccatgttcacacctctgtcctctgtcctgggttgtaaacctggtatatggatccaggacccagatagtccctgttcttcatacctgtcctgaatgccatgtgagtactcagaacccagggcaactggggaagacattcgcaagggtacctgtgtcatagttgcaaaatacttttcagtaaagtctttaaggcttgttatgtgaaattaagtaatagtcataaaaatgtctgtatcatttctaagttaaaaatactataacattaattattaaatataactctaaatttatatgctttaacatcttatttttatatggtatagaaaagctaaatatatttagatctgtcaattaaaaactaggaaaacatatctttcttacaaattatgaaatggttttcatctacaaacactgatatgaaacagttcaaaattacttcctaggttttcactagaaattaaggttactaagagttaatatttaaattaatataattaaatctattaaataattctatatgcaatgtgtacaagaaaagcagatatattttttggtaagaaaagttataaaaggtatgaggatgtatgtgtatttgttgagaaaataattttgtctagtttagaggtaatttaaaggttgctttaaaattaagggaaaaatgatgcagacaaaactaaatgggcatagaaagttgagggaaaaggagaatttcaaattttatgcggttaaatggataaagttaaataaatttattaatatggttgttaaattgagccttcatatcaaaaacacatattaatgcaaagctataatttgtttttttcttttgaataagattttcatatactattaataagaaataataaaagacttgggtttaccttttaggaaaacttcaaaaaaaggggaagggagagagaaacagattctgtgtgactcctgctgtctttactaggtcttttaaatatttggaaagtttgagtcccctctctatcaaacagtaaaggtttttgtttttgaaatcttttaattatcactttggctaaatcaatgactattatttcacaatgacctgtgatcctatttttgataaagtgttttaaacctctgacatgtttaataggcttcacagaataaaattttaagttgtaaattaagtgttctgaccacaaattagctttgggatgttacagaggacccctaaggcatccaaaagagagacaatccggcttatttgatttattaaattgtatagaccacactgtcaaataagaaatgatgtttaatcttctttgagttatatgtgtataaattaatatgtgtccaaaatttgatgaaattcctaaatatctgatgtgttaaatttctgtatgccacagaaaataacaaaagtccttgttagttccatctttaaccatggtcattttaagtcttgttgtcataataaattgcttattctgatgctttttgtccataaaagctttttgcaaatcctaaaatggtatgtcttcaaggaggttcatggaaaagactacaagtattcttaaatacacatttctgacaactttttagatcatacaaatgcactaggtaagaatttctaaaactccaatacaaaaaaagaaaaaaaaaactagactcataaaattgctaacctagtatcaagcagaacaagaattacatttagctgaactgatggaggacaaaactaattttttatcactgtttttgactgaaacattgttgatgctgtttactttttacagttcttttccacaatcaaaaaaaaatcttttttctttcaagttacttacagcttgtaacaattgggtagaataaacttttgtgagcacaatttaaacatttacctttctactgctctctccagaatttggaagttatttataaatattcttattttatagcaatatagttatttgtgtaagttcaataacaatctgttttattttgtaacaggacacaattgaagacactggttattttacccaggctttgactagaaagacatattttaaaatgtgaccagtctgctttgaagcactgggactgactttataacaccaacagacttggaaaaagactggcccaggtaccttgcctacacagttcccttaaaaaattcccgaccttgttgtgataagtaaattatgtcactttctgacaggcccccaagaacctcaacatattttaaggaccttgagaagaaagaaatttactcaattcagactggtattatagacacagtctttggcttggctctaaaccttaagtgattttcaaaagtctaatatgaaatttcatatgaaaaagttacagcaaagtcaacttatggcctatatgactaatcattatccttgttgcactttaaacaaataatcaggccaaggttaataagactaaaacgtattttataaataaattggtcttactatagcatacccgttactagtttccagctcactgaaatttttcttgtttgattttgagattttattattacctgcaatctggactgaatcttaaatttttagtcccctgtgattctccaatctactgtttccaatttttcatccaccattctgacttaaaaatcactagaaattaaaattgtgcttttgttaaagccctacaaactggagctggacaatctgtcataaactttgggagaaaccactatagccacttatatataaacagtcttcatgactattgaagtagactcagaaagttaactgaaacttttttttttttttttttttttgagacaagagtcttactctgtcacctaggctggaatgtgcagtggcacgatctcagctaactgcaacctctgcctcccgggttcaagcaatcctcctacctcagcctctcgagtagctaagattacaggtgtgcactaccatgcccagctaatttttttttttttgtattttttgcatttttagtacagatagtgttttgccatgttggccaggctggtctcgaactccttaactcaagtgatccaccagcttcggcctcccaaagtactaggattacaggcatgagccactgtgcctggccttgaaactcttgatttgaaatacaatccaagactgtggattcccactgtgcccatttaaaccgaagatgcttcaaattctaaaagtactaatttacagatgagtccagacattagcctttgtttttcttgtttccatagaaatgcctgttattaacgatccatttaagtgcatcgtatgtacagtcctggtttgagagtccatctgcaatgcaacgtcctagaataagaaataactgtttaattgaactgatctatcctcaggactaacagactgattcaagaggatatgagctaggttttccaatctacctattttttcttcttctttgtcaatctatctcacaatctccaacccaaatttccccatagctaccaatctttgattaatatgtgaatctttgtgaagataaagtttcaagtgggagactaaaggaaaccaaaaagatttcaccctcaaatatatttctttgacctattttgagacggctattcagagggcctgcagacaacaatagccctaaaaagctgcctttcattaagatttgcatctgttgagaaaaatctatattggtgaagtaaacaaccaggctttctcagaggccctacttatctgcagatctcagaaattaactcatccacaagttatgctatccattctgtctcagagatattatcagtgaagtttcatctgcctaatgagaccacctttgtcccatgccttccattctctcctagagccagtcttgccatgctccaagctcctactccttccataacctcaacatggtataaaagcaccaaccaactggccctttgagttttcatattctgtatgacttctctgcacatgtgtgcatgttaataaaatgtgtatgccttttctcctttcaatgtaccttttgtcggttttcagcatacctttagagggcaaagtggaaactttcccttggttctttcaatatacaccaaaaatacaaatcatggttatttatgggtaataggatttcgagtatttctcattctcatatttcctacattgaacatgtatattttgtaatttaaaatatattactccaaaatcagcactaaaaaataaaatcatattgcatatcatgtcaatgatttagatcaatctttttttaatgcaaactactgtagtaaacattctttttgtacatttttacatatatccagtgcttctctgggagaatatatacctttctaaaagaatcacatgaataaataatgcttaagccatttactttttcaatcgcaataatgtttgggtttcttttatatctgaatcccaaaggatcaaaggttgctagggtagataagtaaatactttggtttgcttgatttaatttttttctgtatttgctatactggccatcttagctcagttgaaaattgaaggaaaaaatgaagttatatttgtcttcattaagtttttatagacactaaaggaactcaacttgtattcacaatgctgagagcatttattcttccagtcagctgtatgtgttggtcattatcgaatgtgagagagccagagaatattgttttcattccattcttccaaacaccaggataatgaaacttctggcaaaaacagtattcttatttgttcctatagtcagcacagcaaacaaatgttttaaatatcaacaatatgtgggaagaattgcaagaaagtataacattagtgaggtgtgctaactattagtaatcttacagctcctgagagaattatttcactcaaacgtttgcatgccaccttttctatttaaaaaataataaaataaaatcttatttaatttacattgttcatatttggataaaaaatatttaccaattttaattgtgattttcaacagcagcccttctctccggactaaaaaaagaccctgtcactgtagcagcagtaataatgatattttaatatgatacaaaaatgcctgagataaacttatccgtcattatgccaatgaaaatgtgataattcaaagcagatatgactgctgttaacagtggcttcagcaacctgtgttttaccaccccatatcatatcatattccagtgttaaagaaacagggaccaaaaacttcatctctcctgctctaaaagttaagcatattatcttttttttttttttttttttgagacagagtctcactctgtctcccagctactcgggaggctgaggcaggagaattgcttgaaacctgggaagcagaagttgcagtgagccgagattgtgccactgcactccagcctgggtgacagagtctcaacaacaacagcaacaacaacaaaaaaaaggaaataacgtgtcgtgtctcttaaagttgtatcaattggatttaggagggcaagagaagtagggagaaaggagcatcagtgtagagatacagtgcatcttaatttgcaaaatagctggtaccatatttaaacagtagggttattgaaagactaaggaaagaatagaaaccatgatgaattcaaaaagcacaactttcaaatgatcatgtacaaagatggaaagaaatacaataagaaaaaaaagcaacagcagcaattttctaaaacaataaatggtaagttggaataaataaaaacaagtttttcagtcatcaaagtaaacatcaatggattgaattttctcattaagagacagaaattttcatattgcatcaaaaattaaaagctacatattgcttgaaaagaacagcactaaaagaaagttgaaaatgttgcaaataaaaagaaaggtatgccagaaaaaaaatcaggtaagataacactaaaagacaaggtggtttttaaaaattaacctgctacatgcaaattaaaaatgtcatcctctactgataacatgaagaaggggaggaaatcagaattctagaaaaataaatcctgaataatagataagacaaacagtattgtatttcaccacacaaccaattctacacacagtgtaaatcaactaatgcccgctaacagtagaattaatcaaaatttaacttgatacttttttcttaagaagttttagttaatcactgcttacattttgcaaatactgggtttggctagaaattaaaattaattccttagatcaatgtcaccaggtgttttttttttaaatattatttgctttaaagtatgggaattctaggcaccaaaaaattcaacaaaaaaaccttcaaaaataaaaaatctaatatgtattttacttgacaaatgataagtttgcttatgttttaaaacctataattataaattttaaatacaatcactaagaattcctaaaagacacagataataaataaggtagttttaattattttatatagtaactacataagaatttaaaataactgttttaacagtattcaacactgttctaataactgacaggacagaagtgttcctgaagtctctcactgaatagcattgcttgtttgtacttgggtgtatgtccttgataactcgattatttcctttcattacttactgcctttataaacattaataaaattatttcttctctgactgaattttttttaaaaatcaaatatttttacccttgccagttctaactctaattctcctttctctcaccactcccaaattctcacaaagagaacaatccggttccttaaaataagacatgcttataagatttttccctctctgatgagaaccaaatataatagaatgatgttctatctgaaagaaaagaaaactaaagctattcaatcagtagctaacatataaatcaaaatatctgtatattagtctgttctcatgctcctaataaagacatatccaagactgggtaatttataaagaaaagaggtttaatggactcacagttccacctgactggggatgcctcacaatcatggtggaaggcacaggagaagcaaaggcatgccttacatggtggcaggcaagagagattgtgcaggagaactcccatttataaaaccatcagatcttgtgagactgtcactaccacaagaacagttttggggaaactgcccccatgattcaattatttccacctggcctcacccttgacacatggagattataacaattcagggtgagatttgggcggggacacagccaaaccatatcaatctgattcagtaatacactcttaacactagaaagtaaatcagaaaaggctgtacaaatgtcatcaaagccatgttaggcagaccccagtctttcactggttaatgttagttgaatattaccgaatgagtaaacattaactataccatacatgtgattctgcatttatatataagctaccaagagtacctagaagtcttttggggctcactgcttcttaaaatgcatacattattttctttttaaaatgctgtcactaaattgagaagtaggaaattactactgtcacacaaacacaacaaaaatgtacactgccagcttcctctgtaatggatgcctacttatgtggcaatttaaaacacaggcagatcatagggataattcccgtgtgtgtgtacggctgagaggaaaagtatggcctgccttgacagagactgcttttaagtctttaaactgtcctccttccagtatttattcagtatgccttctatgcagctgaaaaatgttgtttcaaatcagtgagcatgtctaaaatacttaaggaggagcagctgagaatctttgcggtgactaaaacctagtaactttcctcaggacaggcattaggtaccacttgctgcttcttaatatgctgatttagcctccaacagtgacagggcaattggtgtgaaatgtcaactaaggactggagactactatttagaagagaaatttgatcatggcagcatagcaacaccaagcagccctgattttccttgccagatgactagcagacatttggcgtcatttaaattaaagaaagagcaatctccaaaagatagcttcatttgcaaaattataaagctccaataaacagttatttggggaaaaagaatgacggtgaatacattaaacatctgtaaatttagtgaagaatgaaaatccgaagagagttttcccaagctctttgtactatactagatcaactcagctgacctccatggtttactttgccctctcatatgatgcctctctcctttctcctttaattgtgtaagaggtcttgtattttaactatatacttaccctccatttctcactagttgtaattaaaagttggttaaataagcatgccttatgcttagaacttcaaatgatatacttcacttttcaattgcctacaacctatgctttagaagctagcaaaaatcacttcttgaaataccaacagaccagaatgatttttttgaaagcttgctagtctcattgctaattaaaaaagtgaatgtctgcatggtatctaagctcaagttcagaaataaaaactattctaattaattttgatctttatgcaactacatatgctgtaatatctagaccagagtttccccaaaacactcctaaaatatactcacttatgagtataaaagccccagcacactatgtggcttgcagatactctaaaattcttgtttttcacacataaaaaactaagtaattacagtgagattaacaaaaactcatggatgttacaatctccatctccattaccaaattcaccacacattttatgtaaatacttaatgcaagtaagtctagagaataaaaaggctagaccccttctcctttgttctctccatgccttcttctctttcaatccttctctccttttacataaattgtaacaattaaaataagctaccattatcacttttctataccacatctgatgtaaaataaaacagtaatacataatctcatttagaaacaaaaatgccaacctagaactacatgacctcagataatatacttaaaactttttcattctatacttcttggccttatcatatcatgtaataataatgagaagacaaataggaaaggcaatagaaagaggaagaagaagggacagaggaagagggagaagaagaagagaaagagtaggaagaggagaagtcagagaaaagagaattaaatggaaaaatctgtgtaaaacactaggcagagtgcctgacacatgataagtgcaaggcagagtgaggagatatgctgccagaaagcttgggaattaaatggatctggatacaaatacatgggcaaaatatctctataaaattgagactatcaataccaagtatagaagtatgttgaaaggattaaatgagtaaatacaaaaaagtccttagtacagtgtctagtatatcagaagcacataaaaaattgttattaagaccttctattttaaggtctcatataagatacttgatatttttagaacattttaatatttaaactaaaaacataattactctctactgagaaatcatgaggattaatttcatttcaatggatacaatttttgaatcaaaatacagttgttaacaaagacatcaaaaattatacattatattcatctttttatctaaactaaaaaatacccatttgagaggtagaaattgatatgtgcagtcacttaatgaaaatgaacatttctgcaagagtcaaacttgttactatcaatgacaagcaaaaatggctatttgaaaatccacattttaaagaaatgttctgagcacataaatataacacttgataatttatttagttatttttttgtttaagaaccacattatgttgttgtgctagaaaaaaagtggcacaggcagtaagatatagggcaataaattctctctaaaccctcttgtagaaaatgagtcattattatttattattagacctttaagttgacggacctagaatttctcagaaaagacagtgtaaacaatcaggggtgactggttcacaatagaccaacatttataggagtagctgtaattggggagtaatgagtcctgagactaaatgaataaattaaccagagaaggagtagacagtcttttgtaactaatgtctcagctgtcaagacacaacttggtttttgctcttaactgggccttgacagcgtcagctcccgtagaatacaaggactgccaacagcaggagcactcatccacactgcggcctgttggcatgctgcctgtggctggataatacatgcaagatagagcatatgagctggtatctggaatcagtaactgcaactctgaggctgattttttttttttaaataaatctggaagacagatgtttgccccaaccagcctgttaattctgaactgattatgttgccaacaacaaaggcactaatctgcagagaaaagtatgagtttttgacattattataataattaaaaatatatctatcatttaaaattaagtcctacttacagaaccatatttaacttattatactgagtcaaatgtaacttggtcgctgtcatttaagtctattagaaattctgttatttaaaaataaacaaaaaagagagaaggaattaatggaagaattaaagatttctattttgttaaaaggaaaacaaacaataaataatgcaccatctgtggttttgagggagacagggtctcactttgtcacccaggctggagtgcagtggcaccatcatagctcaccacagccttgaacttctgggctcgagtgatcttcccatcctagtctcctgaggagctgagactacaggtacatgccaccacacttggctaattttttttttttttttttttgagacagggtcttgctatattgcacaagctggtcttaaattcctggcctcaagcaatcctcctgcctcagcctcccaaaatgttgagattacaggagtgagccaccacctgactcccatatgctgttagacactacaatttcacttacatgacttaagtataataaagcaatcaaaagttttctcatatatgtgtaaagatgtgctataaacagtattcatatcacccacataaaaaataaactatcagtaggagatagctaaataaataatacattcacaaaattgaatactataaaattagtaaacagattttatataagttaatggcttatataaagccatttatatatatataaagccaaaaacttatataaagattttatataagttaaagtcatctatgacttaatgaaccttttagctctagctaaaagcacattgttgaaaagcacagacataagtcagacatacctgggtataaaacttcctctacctgacacttgagagtgagatgggtgctgggcgcaatggctcacgcctataaccccagcactttgggaggccgaggcaggcagaacattcgaggtcaggagttcaagaccagcctggccaacatggtgaaaccccgtctctactaaaaatacaaaaattagcccggcatggtggtgcgcgcttgtaaccccaggtactcgggaggctaaggcagaagaatagcttgaacctgggaggtggaggttgcagtgggccgagatggcaccatttcactccagcctgggtgacagagcaagattctgtctcgaaaaagaaataaaataataaaataaaatagagtcttaccccctcctcaaaaaaaagtgagatggctttcgcctcaaaatgtaacagattacagactgtaagaagactgtatcttatcttcaaacacaataacatatcttcctcataaggttattctgaagatgaaatttgatactgtgtataaagcacttcccacaatgtctggcaataaagatggctcagcaactgaaagccatcattatgcgccaaaaacactaagttgtgaggaattgatgatagctcctaccatccccaacgccccccatgcacatacatacaaaatgagatattcttctaaaaagaatgccaatcaaattttagtgtacacaggagagagaaaagaaaacatgtttcaattagacaaggacacagatgttaggaatcatttcttaaaaaacaagctaagtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaaaaaaaacaagctaagcaacaataatggggttttacaattgtggaagcttaatcactaaaaatatttgagaaaagaactgccaactcccttgccttggtggcttagacattcaactgcaagagatgaaaagaccagaaaactgaaattccaaaattcccaaattccatcaagatttatgattttgggccgggcatggtggctcacacctataaggccagtactttggcagactgaagtgggaggatcccctgaagtcaagagtttgagaccagcctaggcaaaactggaagatcctggctttacaaaaaaaaaaaaaaaaaaaattaaaattagccagacatggtagcatatgtctcgctactcaagaggccaaggcaggaagactgcctgagcccaagaggtcaaggttgcagtgagccataatagcgctactgcactccagcctaggtgacagaatgataccctgtctcaaaaaaataataaaaataaaatttaaaaagatttatgatccatgatactttaattaaagtgacagagcatttcatcattctaatgataaatcgtatcaggagattttttaaagaatcatagaaatcttatcttgcgaatgcagtttttgactttagaagctttaaacaattatgaagaacagatgcaaagaacacctgtgtatataaaaaagccaggatgggtttgggcatctcacaacgggcttctaccttcatgtcattcagtaaaagttagcaaatgaatttacagaggaaggtttagagtttatttcattctgtggggagataataaggggttaacaaggaaaagggaaaactaaatatcaagagattaaaaaacaaagttaacatttaggaatcagaacaccacttttagtccaactctataaatggctaaatgttgtttaatgttaccaaacattacttgatcagattgtctttgaatttatgggataccatgaagttctctttaaagattccattatgtgaaataaagaggttggccttggatcagcactgtttctctatatttactttcacccaaaacactattaactagcacattcagatcagagcatttctgttgaggcgagcttgctatgttgttaaaaaaaaaaaagaggtgaaatgacatacggatttttttctttttttgcctcactttgggattatctttcaacaatcatcaaggatttcacagactctcaagtccccaagtaaagtttgatgactatcatcatagaaagaacactgtacaagtagctgagaatcccaagttctggttctagctctaccactaacgacctatgcgcaggaccagccagctttggtgggtgtgagacctgtgcagtcagacgaggctgactgactcagtgaggactccacattcagaaggaccccatgtttggtttcattctctgatgctgccattttgaaattctaataatttcttaacaagagcctcaaatttacattttgtactaggctctacaaattgtgtagtttttgcctgtgtgagttttgcaagccacttgagctaattctcattttgctcaaagtaattacaaacccaacactccctttcccccatgctgcattaccagaacataaattttacattagatagtgctttctgatcctaaagccaactcaaagaatctcatttccaagagatttcatttagaagacagagcctatcactgttgccccaaccctttccttgtctgaaccttccattaaataattaggtgccctctaccattaattgtgctttctatcttaaaggtatatttgattaccacatttttttcaaaagtgcctttgttcaaatactcatttagtgctgacactactccatggaatgtgggaggaaaatgcactctctagcactgagagatttaaaacagaaagtgtggttggctgggcatggtggctcacgcctgtaatccccgcactttgggaggctgaggtgggcggatcacttgaggtcaggagtttgagaccagcctggctaacatggtgaaacccgcatctctactaaaaatacaaaaattagctgggtgttgtggtgggtgcctgtaatcccagctactcgggaggctgaggcaggggaatcctttgaacccgggaggtggagtttgcagtgagccaagatcgcgccattacactccagcctgggcaacaagagccaaactccaaaaaaaaaaaaagaagaaggaaggaaggagttgttttaaaaaaaaaaaaacttcactgctaacctttaaataatacattaatcagaacaaaatgttacgaaaattaaaatgctgagtgcggtagagagtatagcacagttacaggtatatggatctgtctccttagtgtaattcaagaggtcgtaaacacagcacttagtgtttcaccatcacttctgtttggccccaaattcctaccattataattattttagacttaaaaatccataaagatgctgctccagtgtgtaacgtaagagaggaaatgtgatggtgtatctggggctttccatttaccacattaacaaatgatatcaagcaggacaggtatctcccacttaagcagtaatctgcttcagaaaaacctgatgttctgagtgaaaattctgatagcctattatttattaagtggaagaaaatagagcgtttttatatcaacctaaacccctcacaaccagcttttaaccacctaaagaaaacagtaaaatagacactcaccaaatgccaaggtgcgtggacaaatgttataaaccatatattaaggtgtaaagggctacaagcatcacttcctgctcatacaatgaataagatgttaacatacagtgtcgtaggccctacttggcctttcgctgtcagcagaaaacatgcacatctccttagttggcacctgcactacatttcaaggcatctccacatgattctgatgttctactaactgtaatgtaaatcacatgttattttgttaaaaacattgagattggaagatgtaaatgtaagtaggtgccttataagcatcagcaaaaagcaaaacaagaaacaaaaacatcttagtgagagctcagtctagcctgtggagattggatttcaaaaatcaggaggcaatccactgggcaaccattcactggaaaaatattcttcaggttatgtctgaattttattcggtagctaaactagctaaactacactctaggtaggtgttacaagctgtagggcaagcaaaataaatgacgttgctgactttaaaagacttgaaaataatggtactatgagagcccagtagagcattaatatggcttttttagttataataagtacatgccaactggacagactgctttgatttaactggacaaatgacagacaaataaattttggctaagattattgagatgccatggagctgagaaacatgatgcagccacctaaaagttagataacataaacacaagaattccagaccaaatctctcactctatgtaagatttggtgaagtcatttaatctttcttagtttcagctatgtactgtaaagattagatgagttaatgttgtaagcttttaaacaaatgacaggacacacaagggaacaccaagtatttttgtagatacagcaggtcctcgaataatgtcattttgttcgatattgttttgttataacgctgatgagaaaaaatgaaaatcaattcccggccagagcactgtctgtgtggagtttgcatgttctccccatgtctggataggtttcctctgggcactccagcttcctccagcatcccaaagatatgtacattaggtaaactggcatgtctcaattgccccatgacaagtaggtgtgggtatgggcatgagtgcactcagtgatgtgatgatgtcctgtccagggtaggttcccatcttgcaccctaagcttctgggagaggttccggtcacccaacactctgaactgggataattaggtaaataattatcttacttgttcatattaatctttcttaaatgtacgtatagctcacatttatttcagtgtttaataacagaagtttttggtgtttacgtaaaagcttagtgatatttttgtgaccaagaatatgccatagacacttcacatttgcttatatcaattagtcagtgggaaaattggtttgttatatggcgtgtcatttaaagtcacagtttccaaaaacccatcaatgatgttaagtgagaacttactgtatacacagctgggtttgaattctttgccagctgtgtaagcttgggcaaattattgaacttctccaggctttcattctcccatgtgcacagtgaaaacaactatatgtactttgcagaacagaaatagtgttagaaatatatggaaagtgcctagcaaagcatctggaccatagcagacagtcagtaaatgctactgattaatttgccccttactagtaaaactccgaaaactttcactcttctccatctaagtaaccagctcattgactcatgcctctaccttgtttttacccagaacacttaacttcttaaatttctgtcccttaccacaacttcttgtttctccactgttccttacaaacttacactttatccacataaaaatgtctactacttacttgaactcttatttcttgaccattatcagatcctatctaacgtgattcctggtttcaaatacttcaactaccattgactattctcaaatatccttgatgtttacaaagtttactttgccaatcctcaatcctagatggattcaacagtctttttcattctattaagtttgtgcaaaagtaattgcagttttctactcttcgtattgcgccaagccatattagagaaagctgatttgatatgaatataactgttacattgaaaggtggggctccatataaaaaatgccaacagaaaacaatatttcctttcctctcctctgcttctttaaaatgaattttctctagaccatcttccataaaactcatattaaatcctgaaaaagtcttaacatagacatcaactgatgggatatacattgtaattgagagtttgcccaattttgttcagagaagcagtggcctagctaaaaccacatttcttatcccccttgcagccaaaggttgcccagtgagatagacacagaagtaacagagtgggatttctgcaaatctcttgagttgcctacctacgtatatcttattacaggaggaaaaataaatccacactctgtttaaatcacccttttgttgtcttgtctattaatcatatttgaacacaacattatgcctttcaggttccctaatttttccattcaccattgtatataaaagtgttactgctaaaagcagtctcagttaatcaattaaaatatctagtctggaataaaaatcaaatgtctaagcttaatgtaaaattcatttaaaatcccattaccaggttagtactgcttcagaccaagaaacttcagatggagaatgtggtagaggtctatggccactctctgagtttttcctcctgatttcatcttgacacttcttagcagctcaaacacggtgatttcagcaatggcactaagagaaagttggcaatggatggcttttcttgactataattatgtgttgttactctctggggctgatcgatgttcaacactgacttgttcccttattaagatactttcctagttgtttggaggtacccaggacattcaattgcaatgtcatgcttctgagggtcatttaaaccccagcccctcagctcccatttgacagtgtatttctaccctctttctgctaaactagttttgttcccggagggaagccctgttgggtcctatctgagaccagctccatctcactgccttgtttttatgtaagtttgtgccccttgatgccgtgtctcattgccctgtcactgggtaaacatgtcgagccttagcacttcccttttaacatccacaggcatgtatcaaatccaaataaataaaagtaatctcaattttgcaaaacaattagtggattacctaatcccttcaccactcagactcaaaggcctggataatttataccctccagatagattctggattaatggtcaaaatatgcatatccacataaacacacagagttttcagaaagctctttgaaattcatatgtagcttgggcctcatttttattgggcctcatttttagaacatgagggtgttttatatcttctgattgttctcagtgttaggaaggccctagattttattcctcagtaattttacttacccataatagactcctttcaccttttcttactttgctctcccaaatcttcaacaaaaactgtctttatttatatctaataatattccttctgtcccaagtgaaatattccgccatcttttcaaagaaaattgcatgacctcgatcttctctgtctgctttttctggaatcatccttctacattcagactattttttcttattttcaaatttcatggatttctgcttttctagctataagcatgcttatatgtcctccagtctcaaaaatagacaagaaagaaatacattctttagtagtactccacattttccttcactgtcctaccaaacttcatgaaaatccagataaatttcttgccaatgtctcactttccaataactccttaacactacagtctttattctgttccagtatattctattgaatctattctcacaaaagtaaatcaatgacccctaatagccaaacatgataaattttgtattcttctttgagtctctaaagaatttcagaattccttcctggatccccttctcacttctttgtatctaatttttcttgagtttctttccacattttttagttaaaatccctacagataaagaccagaaagctacatttttctaaaatgttactggcactgctgacaaatagaaatgatatagaatgactggcctaagagttaaagaaaaaaaaaactatttggttaaataacaatcatctagcacttccaggaaaacaaaaacaaaacttactttaaaaatcacttgaaaacatttgtcatgttcctttttttgttatctaatcataagctcaatatcaaggttgaattaagagttggagtatattacagtatttaaagcttcaaaatagattggagcagctttaattaaagttaccaggacaaccagagggagacagaatatgccataattggaaaatgtcaccagaaaaatttgtttattataaccttgatcctattttctttgagcaaaatgcctagagaccttcatttactgagtagatccccttggctgggctggttggtgaacaatgagaccacagatttcatttatctccatctctcagaaggccgcattggaggttggattgctttgttgaaaagctttctcctgtaaattgttcattaacacttgcagatatttcagcctagttcaagctgaaatgtatgttcataataatgttaaatgattatatcttttttgcttcaaaacattgtttgatttgagattgcttaagaataatccaatgatattagttatataatcattgcagggagccagttcctgagatatagacgtagcaaatgtcagaaaaaaaagtcatttagcagacacatcttggaaataaaatagttcaaattatgaatgtgggtttagaggggaacaaactggattttagacagaagtcataaagttgaattctaccactacctcatgctatctacacagtcttggataagaacattggtcttctgaatttcctcatttataaaataagaatgtataaatgtttaatgtgtctacttcacagagtttctgtaagggcctaatacataagagtcatcagaatcataacatgattttatatagtaacaagcccccacccccaacaaaaaaaaagcaaaattgctatcaaagagatagcaactaaaaggttttgatatcgttttatctttcagctcttcataaggctggtagatggagctgatcaaaagacaaaagcacaaatgagtgtaaaataaagttgcaataagtagtttagagtcaaacatataaacaaaaacaagctagcacataaggcaataagttaaattgactttttattcaaaaatattataaaagataggattaacaatttaatcttcaaatacataaaatctgtgttcatgtatgcacaataacaattactgcagatactaaaaagcaataatttcaccaaaaaaccctccactttttaacttccttttttcaaaaacctgaattatcaaagactgttaagtaatttctttagtaggcttataagaaaacaaccagctacatttatttttctttcacagtgtttacatttatattttcaaagatatcttatgtttactgaagaataatgaaggttttaaaattttccaaactcaaataaaaatgaaaattgtttaaataccatatattttctttcactaaatcattcttttgaaaatggttaattgatacaggattcactgaaaaattaatagccttccagaatattctattatctagatcatcgaatgcttattcagcatggatgaatagaactttacaaaatactacttagcttcatttcttcctttgtataattatacacttctttaggtcaaaggatgtatttatgtaataagtaggaatgtagatcttgaagccagacacacctgaatttgaatttcacaatcaaattcacattcaaatttcacattcttgctgctcaaagtatagtctttgtaccaggagcataagcattaccttatgcttggtggcttataagaaatgtactatctctgtcctgatctactgaataaaaatctgcattttaacaagagccacgggtgatctgcatgcatattaaagtttaagaagcactggcaaacattacttattagatatatttccttgggcaagtttcaggaactctcaaagtcccagtttcttcattgaaaaatgagactaataatggtgtctctaccatagtattattatgggaaataattagataatgctacttagtaaccactcaataaagcctaactggtattaaattttatcatctaccttagatttgtatattcatgatgttttccactgtatttacctataaaattacattagtgtcccacccagaagaaataaagctcctttaatccagatgtctccctgagtataagcctacaactaaaatagaagcaaattaacaatgccatcttgcattcatttacaatacaatgtagcatatgttcttcattagcctcaaaatatttctctttgaaataatgttttatatttttgtggaatcaaggaagttaagcaaagaatttagtttgaaaacaaacatgaatctgtctccctgaaataaaattgaactattctacacttaattagccattgtgtcttcagtattctgtcatcatgtgcttaagatattctactgatccctcacaagactcaaataatgcaccaggtgtcttgagcttccattccaaatgagaaataagaaagaaagtctcaatagaattctattttaatccaattaaggcaagacacactatttcattccacaaccttttttaagagactatgatgtccaaattacctgcttcctacatccagaagaaaaatgtagactgataaaatcaatataaatcgaatcattttccactgtcacctgaatattaatcacttcagtagatagcaccttatttttattagataagtttttattacaaacatttacttaaataaaaaagggtattctctctccaaaattgaagataataatgttttcattttccagtaatgaaagtttatcttcctatgaattactcaattactatttttatttatttatttacttatttttatttttttgagacggagtcttgctctttcgcgcaggctggagtgcagtggcatggtctcagctcactgcatcctctgcctcccgagttcaagcaattctccctgcctcagcctctggagtagctgggattacaggcacctgccaccacacccagctaatttttgtatttttagtaaacacggggtttcaccctgttggccaggctgatcttgaactcctgacctcagctcccacctcggcctcccaaagtgctgagattactggcatgagccactgcatctgacctcagttattattttcaatgaaatgtttcaacctctagcaacatggtgtaacaaaaattccaaccaacatacctgctacactacaacaatatcttggatatttgaagaagcataatataaagaaagaaacgaagcatagaaataaaaaagaaatataaagaaagaaagaaagaaagaaagaaagaaagaaagaaagaaagaaagaaagaaagaacgaacagaaaatttttgagggtcaagatatttataaaagatagtaaacaaaaaaacctgaacaatgagtattaagcaaacaggaaattcagagttgtattgagataaatatccataaatgtactgaagtctacacaataagaggaaccaggcggggtgcagtggctcatgcctgaaatcccagcactttgggaggccaaggcagtaggatcacttgagcccagtagttaaaggcttgcctgggcaacatagggagacctcatctctacaaaaaattaaaaaatagccaagtgtggtggtacatgcctgtagtcccagctacttggaaggctgaggtgggagggctgcttgagcccagcaggtcgaggctgcagtaagcagtgattgtgccactgcactccaggctaggcaatgaagtgagacgctgtctcaaaaacaaacaaagaataagaggagctaaactgaagctccagcattatatctaacaaaagatgtataagaagtttatgaaaaaaatttttaaagtttatcaaatggtataaaatactgctaaataagagatactatttataaatagaaagacaaaatataataaagatatcaattcttctcaatttggtctgaatcaatataatacaaatcaaaatcccagtagacattttcctggataattatatgccaaatctaaaatttagataaaaggtaaaagtttaagaatactcaagattattctgaagaagaatatagtgagggacttagcctatgtatttagtctgttctcacatggccaatgaagacataccccagactggctaatttataaaggaaggaggtttaattgactcacacttccacatggctgggaaggcctcacaatcatgacggaaggcaaaggaggagcaaagtcacattttacacagcgacagcaagagaacatgtgtaagggaattcccctttataaaaccatcagatctcatgagacttactattacgggaacagcatgggaaagacccgcccccatgattcaattacctcccaccacatccctcccacaacacgtgggaattatgggagctacaattcaagatgagatttgggtgaggacacagccaaaccacatcagcctactagatattgagctggacaactggagtttactaggggaaggcaaactaatttataaatgccctagaaaaattccttggaaaaaataatttgaaatgcagactaaaattatatactcatataacttgcacgtggactaaacacataaatgcaaaagacaaagcttagaatcatggagaatgaaataaattatgtgtataacctcaggttagccaaggttttcttaaagaaaacactctacaatactaataattaaaagaaaagttgactttgcaataaaattaagatgtttgcatcatatataactaaaatgaattagcatcaggaatacataacctacaaatcaattttttaaatgtacaaaaaaatttcactgaagaggaaacaagaaaggtaaatgaatatacagcaagatgtctccctcattagtgacaagcagaggtaacatttacacccatttgattgcctataattaagaagtgtaacacttccacatgtcggccagaatatgtatcaatgtgggctcatatataactagtgaaggtctgaattgatacgattattttggaaaacaattgtcattttataaagctgactgcgaataccctacaatctagcaattctactctcctgtattgaccctacagatattcttacacataagtactaggagacttgttcaagaaaattcagcagcactattcataatagtatccatctggaataatccaaataataatttacccacctacagagactaaatgaagaaattgagatacatcctcataaaatatttaactgaataaaatgaattaaatctaagtgcaaacatacatataaatcatacaaacacaatgttgatggagaaaaccaagtagctgaagattacatacagtgcaatatgaatttgataatgctaaaaagtaagcaaactaaagaataacttgtttagcaaagcatttttgtgagggaaaactatttttaaaaagaaaaaaaatggtaacttgaatatctagcattttggccacctctagcagagaggaagggtgatggaataagagactatacaactaaagaggatgataatattctgggttttatgttgtgtaaacatgttcaattattattatgtatcatgatgtacatatggatttaaacatgttcaatttattattatgtatcatgatgtacatgtggatacatatacatataatcaattaaacacagattattaaaatataatagtaatataaaataaacataattagaaatattttggggtttgcatttaaaccatgatatctcattttttatgaacatatcagatgaacacagttactaagaagaagaacgcataccaaaacccctcaatagagcatgaaaattaaataatagataagtaaggaaaataataaaatgagcagatccaatttaaactcaccaccagggctttagatctgttgctcagaagtttctcaatatccctggctgcaatttctaccagctggcgtgcattatttggttccacagtatacaaatcttgatatttctcataaatctgtgtgaaagaaaaaaaaaactagtaagaacaatagttacttatttggcttacaagttcccattggaatgtatttaaaactataaacaactgattagaaacaccaccctgttctttatcttgatctttttggagtttgagtgtgtcaggaaaaaatatgtaaatataaatttgctctaggaccaccagcttgccaaaatataggttatgttaacaggttgtaaaacatcttgtaccacagtggtttgtacatgcaattttgaggcttgatgctgcactctccaatctcgaaactgggtattatctgtcatcagcatcgtaagagaaagggtagccatcctagacaacagaaggcgaaatggagcatgggaggtcaaacctggaggagtgtggaaaacaaaggcaggaggaagggttatgtgctacagaacggagagagagagaatacatataaagcccctgctaatattcatctagataacaagaggagcttaggagacagttcacatatagaagagatgaaggtcattaaggttttggttagaacggtaatggagtattttttttaatcaaagtaaatgttgctgttagtttttaatcactgaattaaagtatactgaatttaagctaggtgccaaaagaaaaatttgactacctttctggctcaccttagtgtctatggaaggatttccccagagtggcataagttgcacctgtcttacacagcctgtacacactcagcaggagaggaagaattaaagaaaggggggttggaggggaagcagtcacagtgtttgtggctggagggctgagatgagaaggaaatccctcatgcatccaacagatggggtgcacatgcatgactaaaccatctttgaaagccaggacctggcaggtttttactgtcttatgagaagtgaatccaggcacatacaggaatcagttcaaccctgcttttttctggcacaactccagcattctgctttactaccaacaggttctacagtatgatcccagctgcgcactgataacactggtgaatactggcttcaaatggacacagatacatactaacatttattgaccacagagcatattagttttacatggacttataattttttatttgaaataaaaattaatttgaaattaaaatttattggaattaaaattaatattttgtaaagatttaaatcaatttttgctcctaaaagtgacttattcacactatgagattttaccatactcatgtgaactttgaacttataagttttcactcaaagtactcaaggcacgttaatttagtgataaaatctccatatttggattcatccaggagtcctgcattttactggattgcttatgctttctgctaagaagcagattattgaattctgttttttaaagacccatatcatccatgaagaacttcatccaatgcaaagctttctctttcatttcagactaagataagatttaggaacattgattaattgatttgaggtacaaacagataaaccacaacatcactttaattgatccaggatatgtagttctttgcagtaaaaccaatagagctaattggtgtgaaatgtagtgtgcattgtaccattaataccttgttcatttctctatgcagtctaacctccttcctgtggtatagggaatacaatatgcttcatagttggtggggattagttcagatgtgcaatctatacttcaggtaatatcatttattaagtctctacatacatgtgccggacatattaattacttggtgctttaaggaataaatagattataaatcagcagaaactatttcaagcatataagtatcttctcaaatatataaatttatattctctcaaattttccttttaggataatttttaaatacttaacaaaaacaagatgtaactcacaaataaatgtgaaataaattaagtcaagaagttaaagtctagaacccctagtgtaaatatctggctgtattattttatatataaaaccacaattgaattgctttctttggtaataaaaataaattaaaattatataactgcccgccaaaaaaactagctcttgcttctggttccaaagactacaatcatctttgttgtcatgacagctattgcaaagctctcctgatatatgtttagtaaataattttcagaatagaaggtttcatatggatttttatgatcacacaatatattttcataatatgtgtatatttctaactctttccatcactaagacatatttctacaatatttcatatattaatatttcaaacatatcttgaggtatcttttcctcttcttcagtttactgttttgtaaataattatctgctttgccattttgtccaatttctttctcgaaggaaaaacagcatggtggaaataatacgagtttttggcaccagacagagttacatttcaatcctgtcaactcttcacatgctgtgcaaaactggccttcgttttttctctactagaaagaatgtagcatatagacagacttaaaaacaggatacttttcctcctgatacactcacatgctttagtttccctaaagttgaagttctcctgctgccaccctgacataagtcttaacaaaaagaatacttgtcacctgtacattctttctttcctacaatcttaaccaactggctttaatgtactttcattgtaacattcaaagaccaagtttctctgtgatgacaacctagattatggtttgtgagatagccaaaaaaaccataatctatgttctaaatatctttgttctaattaacatatgttaattatgctaatcagctatgttaacataatatatgttctaagtcactttgctctaattaagtctacagttccaagataatcatcacaattatacattttaaaataacttcaaatttaatatctaaaaaatgatattactcaatgatataattgcttaacaaaattcctaaagaaacctcttggaaatcataatacagatgccccagaaatatttactcaaaactaaatatgcttccaaacttttagaggacgtaaaaattttttaaattttttatttaaaaaaaaaagttttttagagacagatctcactttattgcccaggctggggtgcaatggctattcacagaggcaatcctagcactcctggtctcaggtgatcctcccatgtcaaccttccaagtagttggaactacaggtgcatgccactgcacccagctagatcattattagcaatcaatgtaggcagctactctatatcactttcaggtgtttcacatacattatattatttattcactttaagaaatctataatatacatttaattaaccattgtattagtgagaacaatgggattcaggcttcagaatatctggagggagtctgaatcacacttcatcataaaagagcaaaccaatgtctagagcagccgaaggtgagtggtaatgtggcatatttaggcaaagtgaatcttcaatgccattctatgtcctaaatcttccttggcttcagcaggacatggaaatttaagaaagccctttgaaatgagcaagaaaggaacaagggtcggtatgtctgctaggagataggctccgtgcaggatcaaagaaattctaatgcagaggctgagagatggaaagtgggaagcagacacccagctgaaggataatggtaaagaaccacctacagctgaggggccctaagcaggttgagaagattggccaagttctaagtagcagtcaagttcactatctatatcaagagaacaaaagcaagcaaatacaccagataccttgtcatataagtttctccctgcgcccaggcatggagaaacaaagtaaagaagattagagaatatagaaaaagagttagaacttactaaatccttagttgaccacaaaaggctgttttgatctgaaagaggctaaccttcaagtgatgagattaatttttccctctcctaggaaagagaatgtcagctcataagcaagttaagttccctaaagagaaacagtcaaatttctgcatattaaatcttaggtatgtaaattttgacaaccccatttcccaatacttgcacctgtactttccttccatggaaattgtcttggacaagcaatcaagatttctgccatatccacagccatctttctgagggacattttccctttgacaatccctgatgaaataggagctcccttacacatggctagaaatattctaatgtatggccttgtctttgacttctaaccaattgtatcaggacttatattagacctgcaagaagttaacttctgagtcaatggcatgtaacgagccaaatataaaagacctgtataaataaagataacgcactgagccaatcagatgctctcaccacaagatgacagttggatgaaatagcatggatcaaaggtttaagtagaagtagaactgaagagactagtgggaggaaaacagtattcagatctactgagcaatagaattggtggttatgatagacagaataatggcttcccaaacatccatatcctaatccccagaacctgttaatatgttgttacatagcaaaagggaattaagtttgcagatggaattaaatttactaatcagctggacttaaaagaagattaccctagatagtcagagttagccaatggaatcacaaaggtccttaaaaatggaagaggaagatgtgactaaggaagagtaaactagggaaatggcagcatgagaagaaatcaggccaacactgctggctttgaagaccaagggaaggagaaatgagccacagaaaggacttctcatctccagaattgtaagataatgaatctgcattgttttaaaccaataagtttttagtcatctgtcaccatagcaatagaagactaacataatgagttagctgtgaagagctcccagcagagtcaacaataatagcttctgaggctgccttgcctctgaactgcccttcctctgaccaaactattttctaaataacttgagttcttgctgaaagccaggctcctcctgagttcgcttaatttggctaagtttgttttttgtttttttttttttttaataggatctcactatgttgttcaggctggtcttgaactctcaggcttaagcaatcctccttcctcagcctcccaaagcgctgggattacaggcgtgagccacagcacccagtctatttttttttttataagtagattgataataaactttctgagtgattcactattcctaataatgaaaaattctaacagaatcccatgtctgaagttgtgattaacattatttatttattataactttgcattttcatttcatttatcattagattctgatgaatatgaaagatgagctccattgtgagcaacatacaatttccattaggcatcaggaaataatgaaattagttcaaggatacccattattaccttcacaattgtgtgaggttctaagaagaaagatgacagaaaagctaaaaatatcgaaatgaacatacatacatacattgtataaaactagacaaactggataaataaatatcatcctacctcaaaataatgagaagtgggattaaaagaaagtgttacattatatttcccaccatcattctaattccactctctattgggtaacaggagtaaattcaatatcttcaatactaatgaaggcaagaaaagggattcattgtcacctctgctgcttcagatacccacaaaatcaatttcacttaattttagttgaattttgcaacgtgggatggtttgtctgtgggttatacatttttttttcctttattaagtattccttgggctttcgaactacttgttccctagcaactaagaatgtcttctttctaaaaggtgtattaacagaaaagaatgatataatgtactttctcggtcactttcaaggatcaaagttcccttaactaaacaaatactaatgtagtatttttctatatcattaagtctcttttttctttatcataagtctcctcatcatctaagctggccatcacacagaaatgttgagaaatgtgaagattccttcacctaaggtaaagagtaactagtgactgtagatctgaattgatgttagaatatactttaacaacaacaaatacaatacaaacaaaacctccttttccccatgaaaattagctgttttaacaaaatgaattttgccataaaaattatttaatcatttctaattagtccctgatctcttcaacctcttccttccctttgattaaaataataaatgatgtaatctactaaataaaaatcaagcttttaaaatgtcttactctttagcatattgtcgattgtgtttagggctgctgggtaaagaactaatgcaaataccaactgctaaaatgtattaattcaacttagtgtgtgcatttatgaaactataggtaatcattttacaagatgcatgacactgtattaatgtcatttttaaaaatcacatttgagcacggtggctcacgcctgtaatcctagcactttgggaggccgaggtgggcggatcacgaggtcaggagatccagaccatcctggctaacacagtgaaaccgcgtctctactaaaaatacaaaaaaaaaaaaattagccaggcgtggtggcaggcacctgtagtcccagctatctgggaggctgaggcaggagaatggcgtgaacctgggaggcggagcttgcagtgagctgagatcgcgccacggtgctccagcctgggctacagcgcgagactccgtctcaaaaaaaaaaaaaaaaaaaaaaaaaaatcacatttgattctctgcatcttcactctaagtaaattatggccttttttttcttttccctataacctagctttttgaattgggacactacctttgaaattttttatgacttgatatttctattttgctacttataagcatgtgcaaacatcaaagatatataatttatatacgtgtgatgtttattgagtattttctattccccttcaccacaaggtaaatctcaagaagacaaagatttttgtctgttttgttcactggtacgtaaccagcgcatagcacagtgcctggcacaatcaataccaattgcatgaattagtgaatggatactgattctctgtcaggctttgctgggaatgtgaataatgatttataacaacttcttccctgtattttaaaatcagtatttattttaaacctaaaaaaatcatggttaagtaagatgctatgcagttacataatagactacaaatacaacaccgatacaataattaaattccaacaatagaataaatacacaaattaaggtaatgatcagtgtgaggaagaatatgagtgttccaatgaagagatatagaaatgtatgctgtcagaattcagaggaaattaagatcacataggatgcaatagtcacataaatgaaactacagccacgttttggaggaaacgtgattcagtaatggatgaaagagatcagaatgggtgtaatacaaggagttatgggaaaataaagagtgaaaggcaaattgagacataattatgaaggatggtaaaaggatccttcatataaaaggatggtttatatcttattctctagtctacccaacatattttagactagtaaactacctagctcagaacttctagtggctatcacagcaattagtacataggaagaatctgaattataaatttgtttactacaaacacaatccaaacatatatatacacacacatgcaattatatacataccacatatacacacatatataaatgcataatttggtcatagcctcaaatttatagtgcataattttccaatgataactatatcaaactagcattctaataccaaactcacgagtctccctagccactctattctttctatttgctgtgatacagcttcttagctaggactatagcatttcaaatggagcatcgtctttagaaggatatttaggaagaatgaagtcacaattggtgagcgttctgcagcacacactgctactcgccctagctcctattaacaagaacacgatggtgatgcttccgagcaatatattaaagacagaagaaagaaaagaacaagtgacaatcgcaaacaggccacttaattttctccatgttatacatagaacaggtgattatatttaaccagaagtgcaggttgtccctagaacagaaaaactaaactataacaaagactaaagaattttttggtttttaggataaacgcatttgacacaaaaagtaaattttaagttcatgtttaagaatacttagattcaaaacaaggaaaacattaacatacacaaataacagaaactctctacctgtttttttgttgttgtcgttgtttaattctggagataatttattaacctagcctctctttttccatatctgaagctatatataaatttgaatacacattttggccagaaaattcatatgcaattagaagtgaaaaagatcatactaaattcattaaaactaaatttaaaaataattaaccataggctgagtgagctgcctgtttaatgtctctaaccccaaacgacctaaatatatttcactgccaataaaacaatttttaaaagcagcccagtttaatttgcccataactgtcatatcttattaacaaatggcttttctaaagcaaaactgatatgtaccaatgctgatacacaattttacaaatttatattcatttaaagaatttcatacactcagattcttcagttcttcttgagcagtttttcaaccttagtacaattgacattttacagataattctctgttgtgaagggatgtctcatgcattgtaggatgtttaaaagcctcattggcctctatgccaacagtatgcacgtagcaaccaccccatggccccagttatgataatcacaagtatttccataccatcccatgccctgagttatgataatcacaagtatttccataccatcccatgccctgagttatgataatcagaagtatttccaaagattgccaaatgtatgccagggcacaaaacagcccctggctgagaaccattgcactaaatatatgtttagagtaacaataaataataacatatccctcaagtactagcataacttcagaaaatgttaattaacggccggaagagaatgggaaggtaaaagaaaaaacgttttaatatctgttgagaaaatattgaaagtcaccctaaaattagaaatcccctgagtttattctgtgtctttgaaaatgaatgtaattaaccactgtttaaacaaaaatagcttcttacttaaaaaactccagtgcagcagggaggcagggggaggatgatggtgaagggaaaccatactctctgcattctttatagtgctatattctgcagtcaaaatagatttctttctacttaggacaaaaagagcaaatccaggagtataagataattttaaattgcctacatcgttatggtgctgatttagttacagcacttaattgttgaggaaagtaaggcaactctgaataaaagcaaaacatatggaattaataataaatagctgtatttgtttatttaaagtgagaaagcacataacttctttaaaattttatattgccttttaccctcaaaacaattgtgtaaagggaattctaatatctgatattctaatatggcttctttcagcactcccggaaatctttcttgttgcctgcgcgtcttgctgattccctagtcaggatcaccaatgattaattgtgctctgtttttgagtatctccctctgtaaatatattaaactctccgccacctagaaaaagaatattctatttacatgagatgacatgaccacaatgtcaaagagtaagcattagtctgaattactaatgaaaagaaattcttcactcagaacgcttatgtaaatactaccttaattgagagtgttgaatgctcaatatttatacacatttcatatttacatctttgagtagcatattgaaatgtaaaggtattggttttgaaactttcacttaataaatcattaacaatgaatcaaaagccaggaagttctatggcaatgccactgtagaatgggcctaccttcaaaaataagcttccaggaaaaatttaatccacacattattctaaacatatttgcagatgctatcctaaaattttagaaattcagacagtttacctttaagaagaaagcttcataacaacaatgtgacatgcaccatttcaaatggcaatggtaaacatttcattaactttaaaacattgtttacaggaatattaagactatttaatttttaaaaatgttatctattcataaatatgtgatgatcagccttgccatttgccagtgcagtagctaaaggagtgtgtgtgtgtgtgtgtgtgtgtgtgtgtgtgtgtttagaaatatatttcaaaatattctataattcagattattaaaaatacatatatatttttctaaatttggggactgttttcctatttttctgtctaaaatgttttaaatgtgtaaatacagcttccatctctgttaatacagctttaatacatttttatatattcagataataatacatacaagtgaagactgctcttgtcctccactattggttctgtccccttccattgtgacagaattttagtggggcacatggctgctcagaaaaaggctccacttctttgacactttttgagttagatgtgactaagttctaaccactggaatgtgagcaaaatgtcttactcttaaatgactggatatcttctctccaaatctctttccctttacatgacagctgggaaagaagagcaactggaagaatcattttgcacccaggcatggaagccccatgctaaggatggcagagtcaccctgccagtcctagatggcttacctctcaactgctatgtggcagaaaaatacatgtttagcttgtatctttgtcatactggcccagcctgtaccccagcttatacaatgtcaccaagtaatatgacaaatgaatgacatttgttgagttctcactatatgtcaataaatattttatacagattgtatcgttaatcccaacaactccatgagattaaataacttggccagatcctaaagctggcaattggcagaaccaaggtataatagccttagggatttttcagagggatatgctataatactccatttaaagtattatgggttttcttcagttagaagaccatgaagaaaaaaatcagtgaaaacttactttctgtaccattgttagcaattatttcaatggaaatacaaacaaaccatttctgtgctatcaacagaaatgggaggttttaaattatgcatgtatattatatgttgacatttccttacactcttttctttttgaaaaaaaaaatcaaatggaaatattcaagagtagatcattgttagtggcagagctttggcttcttctaatttatatcttttataaaaagagcattagcataatctgatatactcaccttgtttatgtggggatttgcttatgttttcaaggtacaaataaggataaaaaatgctattaacatatgttctaaagcatacaagaaggtgtttcaaatttcagagttgcatccaatttaatagttgtgtaacttagaacaaaattttaaccttctctcaattattttacccatcttgtggatgagcatatacaactgatggacatatgtattctccaaatggttcagtaatggaataatccaataagagacatcttaaaagtctaatgcatcagggacaatagtcctaaacaaacctattcactcttgatctttaacagaagacaggcaggtaacctgggaaaaatctcacatttgtaaagttgaagcactgaatgtatttaataatattagcaactttccatgggctactattttaggatacaataaagcaattttcactaaattgcaaaaatatattactattttattttattttatttttgagacagggtctcactctgaagcccaggccgcagtgcagtggcatgatcaccaaaaatatattactttagctgtggtgcctgtgttggttcttggccttcatgtaaaaagctaattgtaccctgtgaatccaataaaaatgaatgtaatttgtaatttgaagaaccttcatttctacaataataaatttctaactggagccctgctaagctcctgtatttattcaacttctggtcctcaccatatatccaacacccccaatctcagctcaaagttcactctaaactctgacatccttcagcaaaaggaatgaggcaatacggaatcatctgtctgtgtaagatgacactctttgtgtgccctagtacttaaattctatttccaataatgaattctgctctaatactcctcccaccaccccagttacctaacacattattcattaatttggaatttttctgtgaccgtaatgaggtatgtatcccataaacagaaaattagagattttctttcatcttttccattctattttgttatgttaattcagtcattgattaattcatcaatatctatactcttcttagtaatctatccttcataaagcataatagaaaccaggtgaaaattctttttggttaatgattcattgcaaaaaagcagattcagaaaaaaaaagtttcacatattaacaccaaaaggaacaatgaggccagccaagcaagttgttttttaaggctggggaagcactcacagagtaagggagatgctcccaagagcagcttatttttaatctccatctgtcgataaagacagtcatataacttctcaccagaacctgtactttcttttttttctcattatgattaaataaaatctttgctctcaatttaaatagtatctaaatgaaaattaacaaagaagatttggtggtacttccataaactccatgactttcatagaggctcacttactacctacacactttcatattctaatatagtttcccacagtgaatcattgcagatcccaagcatcggcacacaataactttcaagtttctttgcactagtaatcgagattttttttttatcaacagagtgtcagttctctgaggagaggaatactgtttctttgtttatccttggcagcctgcacagtgtctgggacatattacgtgctcaacataatacactgactagaattaaatctgatcattgttattcgcagggaacacctttcatttccaaacgtattccttatctcacagacacttaggtttgttcaacactctctacagttgttttataaagagattctggtataattttttgaagtttgtgtgtatttggtttccttaagaatttctattaatacataaagtaaccacacattccagtttctcatatatatttacatgataaaaagtcatgctatatatgaagctgcttttataccactttatctcattgactcatcacatttttggaaaataaaaggcctcattgcatcactaacaacacaaaatgagaatattttcaaatgtattatttacattgaaacgaaagtagtggggcccttaaaaagtgacatttaatttttaataaatcttacagaacctatacatgtaaatgctcttacccatggaaaataatctagttaagatgccatacaaatatttatattgctgtcactcaaaaatcactttagagtgactttcatagctaattcataagtcacaagaaaaatcgtcttttatagagtctccttatcttgcaccagaaccgttattactgatctcagtgactatctctaatctctagacatgcctgtaaacacttttcaaataatttttaccctaatagaatgaatatatgttttcactgaggatattcaaaagaatccatcacaggagttcaagtcaccactgtatgagggattattaaatatattctgaagaatggaaacattataatagtaagtacatgacttccctatttaaatttacggagagtatacataacacgcagactcacttaagtgagacctacgtatcaactgcaaagtgtgctgagaaagtttccttaatttctaaggatggcatttcctgttcacagtaactagcagtaccaatggtttctctcagaatttcaccaccagatccacatgagaaatcatatcccatttgtaatatagagacacagtttcctagaagatagaactgcattcgaattaatgaaaagattaagaaatctctttggtggattttactcacatcaacaagctgattgactccacttgctgtttttgccagtgtgacaaggtcttcttgcatcttatccacccatgatttgatactgcagaaatcagaaaagattatgttctatcagatctctggcaaataaaagtcacatgctgatattttatatccacgctacagataattcattaaaatgcccttaaattattcctctccctcctagcaccgactatgtccacccttccactccagctttaaattgcaaaagcactgaatccttagtgtgcaggctttcaggatgctgaaatgcctccaaatcaaaggagaaaaatgacattgatgtcttgtccaaggagagtaaacaatttgcttattttgaattaaaattccattaaatagctattaaacattctaaactacaaactttatcttttagcttacaagtcttctgaatataatagtaagatcatactaaatgcagaccatttgtaaaatgcaagaataattccaccagccaggtggaacattcaacaatttgatgcattcccttctagtgttttaaaattcattcacatagttgaaagtatgttatataaaatgcatatctcttttagctttataacatatgatacatactttcccatgacgttacattttgtaaacattttatttttaatggccacttaatattccattatctctatattccataatatacttgattatcctcctttttaaagagaaatttaagatatcatcagcttttaaccactacatactacaccaccacaaatatcttagagcctgaagcttaagaatattttatttccgggccagacacggtggctcacacctgtaatcccagcactttgggaggccgaggcaggtggatcacgaggtcaggagattgacaccatcctggctaacacggtgaaaccccgtctctactaaaaatacaaaaaactagccaggcttggtggcggacgcctgtagtcccagctactcaggaggctgagacaggagaatggcgtgaacccaagaggcggagcttgcagtgagctgagatcgcgccactgcactccagctcgggcgacagagtgagactccgtctcaaaaaaacaaaaacaaaacaacaacaacaaaaaaattatttccttagctagactcttagatttggaattactagatccatttatatttggaattactgaatttggaattactagatccaaataattactggaattactggatccaaattttaaagcaatagttttgatcattacaattatgatcgaaggattgatctttttcaggtatgcaatggacatcttaaaatataagctatggatgtcaggatattttagaagaccctaaatccatgttctatctcactttttcctggtatgagagatattaccaaatagaaccacacaaacttccccattcatattaaaatcatttaacttgtattcctccatatatttcacttattcttcctcaggttgtagacctaaagcatgtattcctttttgccaaggcaattgtaaagaaacattagtaagccagtaagaatgctagatgatttatatttgaatttgaacttttctctacatatctatatataatttcaataatggagatttaactgtgtatgtcttctcttccttagggaagaattccagtagtataaatataaattttttaaaatataaatgtaagtagtataaatatatattttttcagataaatttaaatataacaaaatatggaataaaaatataacatggaagagatttaaatgacatgtaagagagcatttaaaagaatgatgagctgataagagaaagaaaaaaatggaaagccagttataaaaaaggatgaaatgccttagaggaaaacacagaggcttgacttacatatgaaacaaactagttactaaatggaatacattaaaactaggaatactttagcacatatgaaaataaggaagaatacttattgaaccacgctgtatgaacaggatagaaaaaggtaaatgaatatcaagaaacaaaaacaaataaaagggaataatgtataaaatagagaaaaattgttataataacattttaactagtgctacttattagctggtgcctatatttgaaaaatattataagtaaatattcttagtaaacatagttgtgccccatttttatattaaatacaaaaaattatagtagggtacaggtaggagcaaaaaccattgatccagtaatttcctaatttagatgagactatctcatttctctaagcaggtgctgaacaagtcctagaacctacaaaaaatgagtcatctcttctcaaatataatttccaacactgacaaataataagacacgttatacatccctttagctcgaaactgagaggcaaagaatatatatgtaaagaagtgaacttaactcatccctgaattctgatttatactaaactgacccaaaacatgtattctaacttgacacaagtgcactgtcacttccagtgttcatttaggtgagcctgttttggctgaaaagcaattcagaacccatccagtcttccctaccccactgacaagctgttaggaacactttataggagcaaggattattttttataaatatgaggtgttaacttggttttctgaaatacttaggcactctgcctttcaacctggaattaaaaggttataaaaaatagaaaataaggaaaggtcccattcatcatgaaagtaaaaaattactcaagggaaaacactcatatgagcaaaaattttttatcaatctttctctttcttggtaaactgtcaagcacaaatatgtaatcgctaagcactgttttattaaatttatccagaagacactataaaatttgggggaaattacagaggatacagctttttcacataataagaaactaacatagcactccattaggaagaattcattgttgttctttgttaatccattcaacaagtactagtaactgctggaaaagacactaaaagatggagatgcaggctgggtttaaaaatgggtctgggaggaagagagaaaacaacaacaagaatatgataggaaatgtttgaggaagcagaagagagccaatgcttagtaagtagtggtatgagacggttgatagaagaggctttctggagtagcagctacttgaagtcatatttgaaagacaagtggaacttgacaaaattgagcagagagggaagtaacaatgaaggcaaagagaatgtaagacatgatgtgttcagtaacttcaagagattcaaatgactgagtccaagcttggttcagcaaaaggtatggaatgagggcaggagtgatagggaagagtgataggccaggccaagggtcttaaatacgattctgaaacatttaggttatattctcaaaataacggagagatattagaaaatgagaagtcagagagtaaaaagatcatgtaaatgtatgtaaacatgattaaataatttccctgacactgaatggatggtagcttaaagggagaacagaaatcacaaagacaaagtctagttaagaggtaagaaatgagatggactcagactaattcagtggtggtgaaagggataaagggaaaagaaggggaggccaagtacaaggaactagctcaacagaaattctgaaggatggacagtaagacttcatgcactgttggatatagaaagtgaaggagaggaagaatatgggatgattagggagtttctcaggtagaggatgatgggaaattgtggtatagaaagtaagtataggagaaataacagtttaaagggacattgacaggttcatttttattggttcgattagaggtgtttgggggaggctcaagtataaatatacactaggcaattgaatggcatgggtttaaagctcttgaaagagaaatctccatagaaattaaagatcaatgtataactcccaaaggagagtgtacagcgaaaggaaggaaataaacagtagtgacaactctggaaaggtacatttaaagaacaaatagaggaacctgagtagtaactagaaaaaggaatccaagaacaatggtatcacaaaagccaaagaagggagaagtttccaaagagaataaagaagtatacagtcatcaaataaggtgagaaatttatccaccttatctttgaggagaatgatacatggagaatgaggaatcagtgctccttttggtttttaatagaagtgagcctatttctatgcaaaaagagaaaggcaagtagagaaggaaatatcaaagattcaggagagaacatgtaatttattgacaatgatggggtacaggaaatgccacccccaaatagggcaccttggcatttaagaaaacagcaaaagcaggaaggtctttctgaccttctcccaccaagcagacaataaagcctaggaagatcactgtctgaccttctccctcccttcttcgctgaagactctcatgtggcgagtgtcctgccctataccaaagggaaggaacatcacacagagagtccaagaagtactgaataaacaagtagatcataccctttcatcttccagtcatacttctgcaatactgtccataaaaacatatagttttccataggtctttgggtcattttctgaaggctcctgtgtcacataaaatttaattcacatgcttttctcttgttatctatcttttattttataggagatctcagctgtgaatcctgcaataggtaagaaatcttttctcccctacaacagtcctttaaaaggctccagatattttttctagtttacccctctattccaacatgagaatgtggaagtgggggatgaattaagaaataagtagaaccaaagagaaatctaatccatggctagaagagaggataattcttctctggaaaatggaaagagaatgcagatttgaggtaaatggaaataactggaataactagaacaaaagttgagacagttttacttactgctctctatttcctttgtaatgaaggaggaccagttatctgttaagggacaagaagtaggtattaaggcagacagttgaaaagaaaaatgggaggcttaaaaagaatagctggaaagtatttaaggacttggcactataccggaggtcatcagtttccaccggtactagtcagtatggctatgtgaaattcttactagtactagtctgaagagagcaagttcagagaaaaaagacattcagatgaatgtggggcagataccagcaggtgaaaaagaaaaacaaggaaaggcaagttgaaagtcctgacaatttcaagatctccacacattctaaattaacaaggactactaaaatatttgctaaaatgttattatactgtattcataaacaaggcttatctctttatatctttttctatggaaccaagaattttatcataatatttataagaaactgtgaaaataccatattaccagatttcaaatttttattttttgcattttttgcctgataacttatgaatatgctgcagagactaaatgaggagggctgagtatacacatcacactttaaatcacctgacacaggcatttttaaaagaacaaaatcctaaaatcattgtgaaatcaaattgctctaagaaagtttaatagtttgaaaatctttctcttagaaataaatatatacaatctttggccagctcaagaaagtgcatggcaactcatgtatatctggttgtacaggtataatagaccttgactaataggtacattgtttccatgagaaaatacacagaatttttcaaatatgcagtggcaagaacacacttaacactgcttgttagaaatgtatattccctgacttcaagtctccaacagtaacagaagtttcagtgttataaagacaggacttaaacatgatagctagtcagaagagtaagaacaatggatggtacttgtgaaagaaaacgatgagaagctccagagtttccgtatgcagtcaaggtacatatgcaacaggactatgtcttatccttttcctaactagtgttcatcactgctccactgccctcttgagacccgtgctcctatggctcctatgaccatattccctggtctctcttcttttatattattatcatctgactccttttcattttcccaaagccaaatatagtcatttctcagcatctgtctttgattttacctgccattctccttccttacttctctttttctactccttctccatatataatctccatatataatctccatatataatctctaaatctgagctccagttctatcttaactaccatttgatcatttcatccagatgtcctaccattcctttcaaatatgtataaaattgaactcaatatcttcccccctccccatactataaaccctctatgtcccttctcgttgttggaaaatcatctccccagtcatcagggtccataccatcttatccctcctccagtcctttgtttaatagtagtatctcagcatttttccaacacagagctaatagccaaatgcattgagaccttattttataccatctctatgctaaagtatttaatatgcattctctcatttagtcatcataaaaactagggttcgtctttcactgatgagaaaaactaagagatgaagaaaatttagaaaaggtaagcaacacagccccgctagctttttcctttcaaagactttttaatccaaccaacctcacacatttccatgcatgttgactgtccttttccacattctgcctttgctctgtatataacctctacctggaattaatctcccacttccatcgcgaatggataaatcacactaatattctaatatcacctttcacaacttcccaaactaaaaatattctcgtctctccactaaacttcaaaagtcctttaattgtgctgtgcgcttatttccttatactttcagaattagataaatatacatttattctcatttatcaatacatttccaaaatttttatgacagtgctttgaatatagcagacacataagtatttattgaatagaaaagtaaattgaaatgaaatgcaattgcactaccatttttttaaaaaaaatagctatctttatttaatgtttgaatgcgtatctctccgtaatccacatcagaaaaaaaaaatgaactgctggacccatgcatctgtaaatagcatccacttttcaacaagtagcagattatcaaaatttagacttgatactttaaagaaatgattaaacctctagagtgcatgccttaaaattccaaatattttgtgtgtattaattgtcatagaaaaaaagtcttataatccttctctgtcccttcaataactcattacagagttgactggcagtacaaggtttctaaatgtttggtgtctacaaattcaataaaatttgaagcagtcactaaaatatctcttaaaattgaggcaaatattttattgaataattgaaaaaaatcttttatatcctctacttcactttattgtacagaaacagcccaaattctaaaaataaacatatagaatatgcagattttcattaagcatgagagaaaaaacttgccattcaattaatattgttcctttcaaggttggatttgtctgtaatgtggctttcaaaagagtagtgcagtgtatagttcagtaaactctttattttcaaaacgaaaaaaatatggtaatccatttcattttgtgtgcatgtgcaaaacaacaaattcagaaaaacacaaattacactttgtgtaatctactgtaaaagtataacagttgagtacaaagtgtccagtgtgcatagttatctatttaattgttttaaatcctaagctaaagagagaatttgcctggttggaacaatgcagccaaaatgatagctaagaattgttataataggtcctatccaagattaaactgtctttccttcctatatttgatgtggataagtcctctggaaaaaataataatgtgtgtaaacagatttgtaagaaaagaatattgaaacagacctttttttccatgcccttcccaatttattccactagcaattgtcacagagacaaagagggaatgggaactataccacagagaaaatggaaaggaagagggcttgttgtggggtggggggtggggggagggatagcattaggagatatacctaacgctaaatgaccagttaatgggtgcagcacaccaacatggcacatgtatacgtatgtaacaaacctgcacattgtgcacatgtaccctaaaacttaaagtataataaaaaaaaaaaaaagagggcttgttacagtaagggatttataggagggatagtgggaaagtgagatgtctgtaccactcggagccctatcctaaggcagttctctgctttttgccactatttttaagaaatcgtttatttttaaccgaagcaaataagagacatagttatgccctgtggagctggggaaaaatttaaatatcaaaagatctaacaaactgaccacttcaattgtgttgatgcataaatagcttatcacaaatctgaagtaataagttcatatatttcaaaagtctagtgttccacttgctataaataccctaccaatgccaaactgttcctatttttgttatataataaaccatccacagtgttcctgtagttgggtaaaaataacacaagtaagccaaagatttagataacctagacatgaaatttcgctaaatatgcttttcttataacatggataagtatacaattaattgttttggtataaagggagtgcttgttatctacattaaatcgtaggattgtttgtgagatgggtgtcatgccagaaatgttagttagttcctgaaattattctcaatttaaaccattttcaataacactgctgctctgtttttagaaagctgtttcaacttgtgaagtgctttagtattccatttttgactagagtaatcctgtaagaaaggcagaaaaggatgtactcatgctaatcagtggaaaggtaaagtacttgagagtaggaaaaaagactatcactaaactctgattcctaagctgttcatgtttctctgccttcattttctgttttttttttctgctcgtgtgtgtgtgcgtgcatctgtgtgagtgtgcagttaatccacattacaaatttcatattcatagatctcaaaggccatgagatctacttttgttcataagatcttcttttcatgagatctaaatttattttcatgagatcttcttttccactatcttggattgatttttgttttatccaagtattttttttcatcttttctttattttcttcctcagctgcagcaatttgcttccagcttccaagacaacaaataaaaattatactttggggttgatagtaacatagttccatggattagctgggggagtgttctcatacatgagatttgttccctgaagccttgagggttttgttttttatccttccacatcacaattagttacaacctctagcatagtcccgggtagcctgatgccagccgaggtgtcccacgtggccacacaatctgctgctggtgtttctatgaaccaaatgagctaaaattctaattgctcattacaaaatctccattcattttattgaagatctttccctttatggtttatctgtgatttttctcagtcattgcaaattgttcgcaaaatttacttcagcctaattcgagcatgtatttaattattatttaattaccatgatattacttaatgtcatggtaaaaatttccttattttctttatttctatgaattattagctgatcattcataatatttccaatactataaaatcctccaatgcttactacttttggattctaacctaaatggtgaatctacttccccatatagatcagtatctccagtccagcgcactgaactgttttacaaatatgtcagctttgtcatgctctttaaatacgttttctttctactaaactgaaatcacctctcgaatcctcttcagctactgaaaatcacccaagtctgggcttcaggtccctcttctggccaattcaagtcctcaaactatcataattttttcttttctctgagtatctaaaatatgtacagcctgtcctacaaaatgttacacatacagacatactgttttatatcagtgttatttctccaacaatatttaatttccttgaatggatgggccatagcttatcatgttctgaaactatctagcacagttctgaacatacagtggctacttaaaaaacaacaggtaatatctattgagcacctatatgtcaggaactgttctaaacatgctttgtgaacatactctttaattctcacaaaaatctattgaggtagataccgttattagtcctactttacagatgaggaaactgaggcatagagcggttaagttacttaccaaaggacacaaaattagtaagtggcagagcagtttgccctgagaagccaagaatgtataactccattaataaatgctaactggtgccatgatctgattcatggtttggttttcattgttaaaccaccagatagtagccctcaactctcctctcatcagaacttggagatacctcttgttttctagtttatagactgtcatagccctaggttcaaagtctgtttcattgatagaaagaaaataacatttgcagaagtctttctttacatggcaagaaaaaaggctgttacagttagaaaatgaagatttaaaaacaagaatacctaagtaggttcttccttaagacatctcagtggaaatacatgcatattaataattacctaaatgctataatttttcctcacgttacatttttaagttttcatcagtattttcaaattaaacaagtaccatttattttacttacaaccagaagttgtactactttcattaacataacaagacatcctcagtgttatgcattaggtccacagcaattgattctgatattatttataacatgcaaacagacttgacatacaatagcaggttaggtggagagacagccctgatatgtttatgaacataaaatattctaaaagcaacattaagtccttcaatatgcatagaaaatatgactatttcagctggccttcattgtttttatgatgcaggttcagatatacaaacaaatgtatgaatataaaaccaggacccaaattgactcatgtggcacttcttttaaatatagcccatagtgtaatttgctgacagctcttctaagacagggtttatttaacaatcaaaaagctgtcaaagcaaatatattaacttgcaaattagaaagacaataactctctttctgaaaaccatcagaaaagaatattgccaagttagtccatcttcaacttttttatttttttaacattaagtaaatgattctagagaaacaggaatgaagccttcaaatatgagatggtaaacatctttctagctcagaaaatatattgcaatttaattgctttcaacctttttgtcctcacagaacacggttctctttgaccctctttgcctgagcagcatatacattgcccttatgttcccctctgctggtctgagcacagtgaacattctaaacagaagattgtttcttagataggaattacagccagctccctttcctaacctgctcaatataaatgaaaacctaaactacgttttttaccaaactgtttttcaccattaatgcagtaaaaataacaatgagaattgtgtttaaaaataatgtttatcaaatggcaaaaaagttacaattttgagcactatccaataacccctttcagaaactgtgaaccattagtgcaaagtttatataaatgtccaagtaatacagaaaaagaagtcatttttaatttcttggtcatgttttcaactattttttaatttgaattgttaaatgtttcaaattatgaaacatttgctaatgtttaaaaaaattatataattgcgatctttaatgtattatatgttgaaaagcaggtcaaaatctaggcaattaaattttttaaaatattaaaatattaggcagaaaaagcactttgtataactaaatccaatagaagcttgcatatcatacgctcagtagattaaaaacatgctttaagacatgactaatgtacgtacagttattggagaaggcttttttaaacatttttctagttaaatatttagtatcatataatttgctaatactaacaaaagagaaaaatcacagttttagctatattctctcttatggggtagcaaatgtcaagatggttactggaatttaaattattaacataaaatgtgaaataaacactttaaaacacaatagttgatctcatgaaaagcctcatttgtgttgatgtttatatctttcatatttcaaataattattccataattagaagcaaagacttgaaaactgaatcatattcaatcatctcagatacaggtaggaagcatttaacaagctccggtgaaaagagaatggtattttagcttgaggtccctgcttaagatggcacgcccatgtaactcaccatctttatgaaatataaaagaatcatgaagcagccagtaacatgaattaaacatcaacattccaaatgaattgttgcagtctcccaatttttttgtcattattagtcattctgttactgttcctagtgctccatttagagcacatcccaacgtagatttcaacaagcagttttaaaatggaccaccctgtattgtaacgttaaagtctaaagatttctgaggctagatctgtgaatcatatgtgattcagcagcctcccacaggcctgacaacccttatattctctctcaaaatgttccttctgtagaagagaggctgaatggactcctttatcaccattcaggaaatacaaaaggacttgagcacatgcaatccattagaattcacactacctgttttaggtcacctgcagtaatggaggaaaaaaggcccttcagtgcatctcctgctgtctgcagaactgtcttttcaactaccctacatgtattttcccaaagctctggtttatcctctcatgtctcttgatcatatcagggaaatagtggcctcatactcatttgtatcaccgttggacatcttgtaagcgaaccttgaactgagattatttctccaattactgcaagtaataaataatattttcaaatacttccagaaactgcagaagaaaacatcatggtcttttagtccagttcttaataaatggaagcctcctttatacattacacatgaaaaattatcatggtaattctctcaaatacttcctgcaatgggcattcattaccctactaaaaacctttttatttaggcacaaactgtcagaaagttctgctaggtgcaaaagaaatgatggtataattgtcgtatgaattgtcaggcaaccccctgaaataagacctattctttacatacacttctacattgcttaatttttcaatgattattatcactttgaaatgcctaagttataaaaatttcagaaaagaaattaagtgtcctcaggcatccaatttctaatgcctaccaaaagaacacataaaatagtctcttataatttatgcagctgacttagttatatatggtcatctgactaccatagttttatttatttgtctctttttttttttttttttttttttttttttgagacggagtctcactctgtcacccagctggagtgcagtggcgccatctctgctcactgcaagctccacctcccaggttcatgctattctcctgcctcagcctccccagtagctgggactacaggcacctgccaccacttccggctaattttttgtagtttttagtagaaatggggtttcaccgtgttagccaggatggtcttgatctcctgacctcttgatccaccagcctcggcctcccaaagtgctgggattataggcgtgagccaccacgccccgcctgtttgtctttatccttagatttaactagaatgaaaggagtgaataaaagtacatgcatgcaaagggcaaggtgagactttttatcttgaccttattaaaagaaaagcaaatcagcaactaagggcgaaataagtagtaatgataataaacatcttacatatgttttggataaatactttctgaccaggtggtgttcaggcagcactagacatactaaattctaggacctaggcttggagttaatggatggactgggtctgattctccagccgggttcttcagactatagatctaaggagaatcaatagccagtgtccaaggacaaagctgaagccaagaaccaaacaagtagcccaaaggaatatgattcaaaaaggttgggtgaaggcagggcccgggggctcacacctgtaatcccagcactttgggaggccgaggtggacagattgcttgaggccaggagttcaagaccagcctggccaacatggcaaaaccctgtctctacgaagaaaaaaaaatagctgggcatggtggcttatgccagctactcaggaggctgagacacaagaatcacttgaacccaggaggcagaggctgcagtgagcagagatcatgtcattgcactccagcctgggtgatagagacctgtgtcaaaaagaaaaaaaaagtttggcagaaagattgcagggttctggctagggcactgcagctggagacaagaacatagcaaatgtcaaagatagagcaaatcaattgagaactatggatctagctcaagaagttcatagcatgattaaggacctatttatagagtccctgcattgttgtccacctgtggatataaaggtaaaagccctgactggttaagagaaatggtcaaaaagttttgtttaaagacctccactctgtatgtagtttcttgccctgggataccaaactgcaccatgctaaatgccactaaaatgagaaattaatctggtttttcttatttctgtaataaaactgctatctaagaagtgcataatatgcttcttttatgttaatgccagggctcgaattagaatcttattcttgaccctcccaatcagattcttcctgctagatttttcaaaagcacatggaaatcaccttggataaattcaagcatagtgtatatactttccatccaaagaaaacttctctgtcaggactgtgcgaaaaggtttctaattgccatcccagctggtcttgttccctgtgttcagttttctgatgggacagaagggaaagtttatggaatgaatgggcagacaataggattaatgcaagagactctgttgtgttcatcgcaatgtctttcctcttcagtagagacattcagggagggcataaagctaggaaacccaggggaaataacacattcctgattgaccaattctccctcaatttataacacagccacctggcactagataagactaaaaaagggaaaataaaacaaggaattgaaagagattcagataacccaaaggaaaacagattgagagaaggcatgagggacaaggacatctggaagttgggagaagtggggaagacagtagaaaaaggagactagaaaggaacgcacattttagaaaaaggatgtggggtttcccttaaaaatgaaaatttacttttgcacattaaaaaaaattggccttccaccaaaaactgtaaacaatgcactatctaatgcactactgttcaaatattcattgcaacttttaaggtatacaattttcagttctctagactaaaatgacataacctttaacacatatatgatgaaacatatgattactttggtttattttacatggaactgtgaagacaattctcttataagactatttttattcagaagaaagtatttttgtttacattcaatttattctcaggaaaataatgttcattgattttcattactcaagaatacatcctttcattgtgagtaagggattcaaataacattgatttttgtggtgtagaccaatgacagatcaatgaatagatggtgttttgtttatagcagtcattgggttggctacatagagaaatgaagttcataattgtgcatctctacatttttagctacgcttttgagcctttccatgaaagacacattaattatttcatttatctaaatactgaagagctatacgttacttctaaatattaggtagtcatctttcacattgtcctgaagtgttataggtggctaattggagagatttgaagacagcctgaacttatattgcacaatttgcatgaccctcctagttattttctcctgaacacagttagatgacagacaagaatattgggtactcaagctactactgggaggaggtctttgttgttctctatcattctgacagggggcctctttactccctactctcttagccagtgaatggagaaacgttagcactgagagcctcaaaagggaaaaggaaccaaatggcaaataataccaaagccaactctcctcctagaccactcgttgctacagcacagatatataggcccatatactcactttcactttggggaacagaatgaaattttggtcttgaacttgtgtcatccgtagtatttgacaccgtcattgaaaagcagttccttttattctaatataatgtcaacttttgttctagatttggggagtatatatgcaggtttgttatatgcgtatattgtgtaatgctgaattcagtctagggtacaaatgatcccatcacccaggtagtgaacataatagccaataggcggtttttcactccttgaccccctctctatcccaactctagtaatctttgtctattatttcaatctttataaccatgtgcacccaatgttcacctcccacttatatcagtgaaaggatgtggtatttggacttctgttcctgcattaattctcttaggatactgacctccagttgcatccatgttgctgcaaaagacaattatgtgttcttttatatggctgtgaagtatttcatggcaggtatcacatttctctatccaatccactgttgatgggcacctaggttgattccatgtctttgctattgtgaatagcactgcaatgaacatacgagtgtatttgtctctttggcagaatgatttattttcctttgggtatatatatccagtaatgggatggctgggttgaatggtagttctgttttaagttctttgagaaatctccaaactgctttccacaggggcaattatggaactaattaccattcccaccaataatgtataagtggcccctttcctccacagccctgccagcatccactggttttgacctttttttttttttttttttttttgacggtgccttgctctgtcaccgaggctggagtgcagtggcatgaaaagggcttactgcagcctcgaccttctgggctcaaacaattctcctgcctcagcctcccaagtagctgggactacagatatgtaccaccatgccaggctatttgttttttaattttttgtagtgacagggcctcaccatgttgcccaggctggtctcaaactcctgggctcaagcaatctttccacctcagcctcccaaaggggtaggattacagcatgagccaccatgcctggctgatttttgactttttaaatatccattctgactgccgtgagatggtatctcattgtggttttgatttgcatttctctgatgattagtgatgtggagggttttttgtatgcttggtggctagaaaagctattcctaacagtgtctgctcttttttctacctaccatgctttctctccatgcctttgtatcttgtctcattcctttaagcaccaggtcaaatgtcaccacctcacagaggaattctcaaccatactacataaattcatcacttttccctgctttctgtccttcacatcaggttcctattgtttcttcagacactcacaaccatgcaattattatatttgtctatttacttgttttcagcctcttttctccagaatgtaaacagcccaagagaaagtgtttttcaccagaagtcaaaagcacttatctttgcactgagataaaatagttgcctagataaatattaaatgaataaaaaaaagatgactctttgaggcaagcaagcagagtagtcaaattggtatattagcaaggcgtgatgaacaaggtttctactggaaaagcatggactttttaatccaataatttctctttttttcttaactagtagaatggagaggatatgggtaaaaataatcttagctgacacagagaccataaagtttcttttaaagttatgtgcaaaaaatttttctatttgcaatatctgaatttgtatataaaatgtccacaaaactgtttcatatggagtcagaaaaaaaaaataaaaggatcactgtttcctcataaaatttcaaaattcaagaagggtgaagccatcgcattagcaacctcaatgtaatcaagagtaatgatctctgggctctgtcccccgacaccagctttgatccagcaacatacttaaaagaggcactgccaccactgccagtttgctcagctacctacatcttcaactgccagcatctgctttggttatgggaatgctcctcgtagcaagcagaaacttcaacccaaaggattgtagaagtatttccctatgaaattcaagtattggcactagaataaatgtttagattcttcagagaaaagcagccaaacaaattgtgtggaaatatgcagagggtactatttaacattatatggctttgccaattgctaaaattacttttaaaagctcattaagttctgtgaagcaggaaaataatgacaccatagctgatctctcattcaaagtcataagtagattcctaaatggaaaggaaaatagagtatctgcatttttagactttaaacaaatccatgtactattttactttactttaaatttttgagactattagttccaagaaatgtattatttcacatcttttatgtatgttttaatctaacctcaatttcccagagttgctaagagactagaattctattattgaacaaaaaataaaagtaaattaaaataaattacagccataggaacttgttatttgtaatacctacagcctaacatattcctcctttttcagaaatttccagatacatcacagtcatagttatttacatttcaactattccataaggagtctccataaactaatcctcctacacttccaatgctttcttctatcaatattttttcttttgctatacataacaatgactcttgtatcattctcattccagaataacctaagttcatcttagatcattctgtataaaatgaagaagtttgaaatatttttaagtagagaatgttactaatcatatactttccatttttccaatttacagacacttcacttcctatttttttctgctgggaatgtctcttccttgaaagctcctttctagaaaatttccagtcatcttttaaggttaaatttaatagtttcttctctgtaaatccctttaggatgctataaaatttacatacaattatcaaaaagagttttgcatttcatagtaattatttatttatcaaactctccattaaactttaagcttcctgcagacagtgacagtgactaatgcttaatacatagtaggaattcattaagtgtttaatgaattaatgttaattctattacctgaataactgtctttgccacccccttctctttacattttacactgccactgcttgtagggactttttcatctagtatatggactactgcagtttccagctaactggtcaatctgatctggcttcctctgcctccagtacttcaacagttcttttttcagagtaaatattaatggatgatagtttgcagtagcatcaacattacttttctgaatgtaaaattaatgtgtatattcattacatcacaagaaattgtaagaagttattctactactaaaacaggccaagaaaaaagacagaaaataagctgatttcacctatgaccataagcaaaatcctatataaaatattgataagtcaaatcagacagacattttcaaaaatagtatatcatgaccaaggaatagttgttttaggaagatatagatatttcaccttagaatagcccagttcctccataaattaagagtgaacatcaacaatttaaataacttctctgagtctgcttttataggtttgagaaactgaaatcaattaaaacaaaaagaaaaccattcagagcaatgcctggaagatactaaataaacaactatgattaatattttattattttcaacttgtaatgtaatcctgtaaattaacagatgatggcaaaagcggcctaatcatttcaataaatgtcccccaaaatctttttattaatattccatttttattcttgctaaaatattagggtgttagaaagttctttaactttcacattatctaccatagagatatgtgaaaaaaatacttaatgttaaaatctttaaaatattccacttaaagacaaaaggaagaatgttcactctcaattagtccaataatgctattacagaactcatagttaatgtactaggacaagaaaataaatacaaggtaaaagctttgggaaagaaaagaacaaaaacttttattatgtagcaatatgactgtctacataacaatctaaataaaactgatgaattactaaattaaaccaaggttaagtatgaaattttggaaaatcaatataagaactgtaaagaaataagtggagcagtatacagagaactagaaattatcaggaaaaaatgattaaaattagtgataagaaactcagcctcattaataaccaattaaataattaaaatacacaaaaatattttattacaaatcagataaacaaaattttttaaatattgacaaaactggaagagataggtaaatggagggatggatggatggatggatggatggatggatagaaatagagatatacagatatagatacagaaatagatataagtagatacacatactctttgaaagcaaatcaggaaatattgttcaaatattttcaaagtgaaaaatacctattctcaatttatctctaggtttctatcacaagaaaatgctcaagagtgttcactgaaacagtatttgtaatagaaaacaaatggaagaaacccaaatattaccatctatgggaactccttaaacagtttatggtacattaattgcatgaaatacgcagtagttcaaatattgaattaaaaataaaggattttaaaataattaatgaaaagatcccaagaactttagtgaaaaagcaagtcataataacagacttatccaaatgtatatgtaaaaaaataaatatctgattctatatgcagtcacacaaggagcactgtaagcagtgaacactactgaaaagacacatgtgaactgttaataataaaacgggtagtgtaagcaggagatgggttataaggggtgtcctctctagtttattttgtatataacttattagctgcttgcatcttttgcaaaataatgcatagtaatgtaatgaaaatagaaatattaaaggctaattcacacctagtcacagaaagagtgtactaattaacatgatttagagtatttctcatttagtaaggttatagcaaagtgatgggtaaagttcatgcgctctgggctagacttgggttttaattctggtgtggctgtttatgagacgatgtgagacagttacatcatcattttaaaaattaggccagtaatggcacgtaattcacaaggtttttgtaaggattaaaaaaaatcttatatagaaaatgtttaaggcaatgtatggtacgtaataaatatttactaagtttctggggttgcactacaaagtctaaaatgctaagagttcgagcttaaggctgacaaataaaagtattgctaatctacagccctaattttattttattttattattattattattttgcaacagagcttctctcttgttgcccaggccagagtgcaatcgcacaatctcggctcactgtaacctcccggactcaagcgattcccctgccttagactcccgagtagctgggactataggcgcacaccaccatccccggctattttttgtgtttttagtagagatgggggtttcaccatgttgacgaggttggtctcgaactcctgacctcaggtgatctgcctgcaaagtgctgggattacagacgtgagccaccatgcccagccagctttaattcttttaagaaccaataattatttccattagaacagctgtgctcttgatataaaactctaccaaaaaatcatttattctagatgagactttaaaaaaacttttcactttaatgaaattctatgaaatgtttaacatgcaatttctttaaaagactataggcctagtatgttgtacaactgtttgtcattttcatgcttttaattcccttcagtattttttctatatttaataaacattctgttattagaaaaagaaaatgaaattaactaaacttcaatttcatatactgaacaaactaatataatttgaagcttaaaaactgtagattattggatttggatattatctttggtatgtatttttgtatgatacaaaaagcatgctcaactacaagcttaattaacttacatataaattctgttccaaggcaacatccccaaaattaaaaatatagcaaacaaaaatattagctcaaaaataagctataaacttcaaaatattgtgtggctttactgtagcgtttccaaaactaccaggtaattttaacataaatattcctccaaaaacctgttcaatcctctggaaataagtatgagattcctcagtgcatttaagatatgaaggaattcgttctctaataagtcacttacaaaactgagtagtacaaagaaagcagaaataaattcaatgaggcaaaatctaatattgtataaaattttgcagtatattgttatgaagcagatttttattttctaatcttacctaagacataaaagagaataattttattcaaatttagaatagggtttgcagagaaaaatcttgataattgcttataaaatcttcaattttcaaaatacatgatatcaccctgttttttgaaggacttgcaaagaatctacagcaatggatgattaagtattactatgtgtagaatcaagagaatggtttacagtttcctctaaatattcttatattttactatcttaaggttaaaatgattaataatatgaataaacacaatatcaggccaggtgtggtggctcatgcctataatcccagcactttgggaagccaaggcaggcggatcactggacgtcaggagttcgagaccagcctggccaacatggtgaaaccccatctctactaaaaatacaaaattacctgggcatggtggcacacgcctgtagtcccagctactcaggaggctgaggcacaagaatcgcttgaacccaggaggcaaaggttgcagtgaaccaagatcatgctactgcactccagccagggtgacagagtgagacactgtctcaaaaaaaaaattgagtattgaacacattttagaattatcaggttctacctagactgcctttatccatttaactcatttagtgttggaaagaatcttctaattgaggttactaaaatcaaaaattctttattgtttttctaataacatagtaatatgtttctcatcctttaagaaaaaccacacggtccacaaaaacactccacacacttatagacttgttgattaaactagctcccgtctgttcctcaagcaagcctcaacctttataattcatttttaagaacttaattttctgtgctgtcaattccccctttttaattgttacaggatctcatacataatgcacaattgtattaaaacacatcgtactgccttgtgacatagcataagttgtcaagtaaaatgtaataatctttgacctccacccacccattgacttcaataaaaaataaaaattatgcctacaatctggctaaaagggcttttagactgtggcaccagtaactccctagctaatgtacagaacactgagctccttagacactctccattctgttacaaatattttcctattgtgttttcaagggttgaatgtataaatagttatttacagaataaatctatgcattagtgtatctccaaataagttcagtgtgatcatacattttaaaacaaaaatatgcaattggtgtttcacttgcttctatctagacaagtgtacgaaaaaagtaaatcatagtttcaaacaatacaatcagggcagtattttctaaagaaaaccatcctgaaaatggaaggctatttaacaaaagttgtgtcacccatgggaaggcttccttctgttgccagctaaaggttgacatgggtcagtccgcacgaaaccagacatgaacaacattcaaggcaaaccagttccaatatagcttacttgccagggaacattacacttcctctccaagacagtgtaaatgttttaaggtcagaagaacacaatgcctgtcaaagtgtttcatgtatgttaaaaagacaggtaatttaggaagagtctctgacatttaaaagggagtcatgctttcaccatctccccctcctccaacttgacacctaattaagcatcaatacaaaacaatataattgaccagatgtactagtcattaacaggaatcacccattctcctatcaaatcagagcgtacagacacggctctatttgtaataggttgacttaattgcctgagaattccccagagaaatgtacaaatggatcaagacatctcacacatccacacgcacacaccccacagacaaacacatgcgctcctcctaagctttgatccatgcttttgtcactgtttcatccatctttgcaaatgagaatttatggtggccacaatcagtactagaagatcaattaaataaatggaaaaataaataaagccgaatgaaaggtaccagcattcagatttagcaacaccttaataataaaagctttttatacagcagtgctttgcacaatgtagttgcttaaattttgttggtaaaaacaaagcacatacctgctttgaaaatttaaaaaaagaacacactaaacaaacaaaaatgccccccaaaaaaagaaaaaagactacaaaagaattctttcccctggcaacacccctcttggatatgtagattgtatctgctgactacgtggctcagttttcccttattaaaacctatctcaataaaatcattttgaaagtagaaaataagggatctctctaaaggattaagtacgtagctggatttagaattcagaaaacagattccagttttctaatccccaacaagctaagggcactaatgcgaaggaatataagagatttactcccaaaaatatcatattggatctgaatttcaaatgaaaaattggcactccctcctggagtcagagagatagaagaaaaaatgagcagaaacaatacagaaacacaactttcaaacagaatgtcccaccctcacatgcccccaccaacatacacacgcatgcacacacactgaaacactgaggtctttcacttttctatctgtcttaccccatcaccctcaggccagtggagaatgcagtcactggtggctgcttgcatttcaggttctagagatgacattgtcatggcttattcctgggctttttccagtgccatagatttcccagccacatcaccaaatccctcctgttagaactgcaggtgccaagatcaaatttccagccaccctgatcacaagagtatgggggtgtagaaatggggagtgtgtgtccagttctaacctcttctcatacaaaatgttcccagttggttaccccagccccatggcgcctcttttctcctattttcttggagtacgtattatctacaccactcattggtccacttaatcaggcactgctttcaacacttcttacaattctgtatttttttattacaaagttaacgagctttctgtgtgtattttctcctccataaagaagtagatttttgagggcaaggcacgacctgtatttctttgtatttagcacagtgcttagtaaatatattcaatgccccccaaatattattgatttcattgtagactgtcttaattgcccacagccccaaacagcatgtctttgaggtctctagggtgaaaatcagttactggtgattgcctcgggctctcctgactccaggaggaagcttaatgactgaaaacacattggctgtccatcagtaaaacaagaccacgtgtcactgtgtttctgtgtcatctaaagctgggggatagaaaataggtgttccaaagggcatcttcagggccttaagccccctacctcttgttaaatatgagaagtctgtgcttcttttctcaaaaacatacacaaaaaaaaatctgcctggtgtccaattcatcagcctgggagatgggtaagaaatgtagttagatcccaaacatggctaaatcctttaaaaacaaatttttaaattactaggagcttttaatggatatttatccgtcttgccatatgactaagcagatgaacaaatacctatcactcacacactagaaatgaaacaagatttaatgcacacagcaccaatcatacatttcactctattgttatcaaaattacaaaacagctgggaacctgacaatgacaacctaacactcatgattttagatattgtccttgctttacttcccaaataggaggctaatattctctttaaagggaaacaaccatgagataaaatataacctttgaatatgaactgtgtatttttctcacagtaagtaaacaatagatattccaaaacagcaggcatcttattaattcagtagggtcagcaatgattaaactcttctcatctgaaaggaacagttgcacacttcttttccgaatatacatctctgtatataacttttaaaaattcatgtgggttagaagcctggatctgtgtatgtatagaatttccatatagtaccaagcttgattaaattttcccttgctactagccttctcagagactagcaaataaaatatttggctgtgaacagcatttcagctcaccgttgatgaaagtgagctgtactgagcaatgtcagctttatacttttaagaaaatcttttaggcgatggaggaaaacagaaacaaaaccaacactactttagaataaaatgctgaacaatgaaatggagggttattaattctctgccacttgaagattgttttccacccttcagcatgctgagataattatatacacatgacactgtataatacatgctgtttgcctacttcaaaactgttctctaatgcaaggattattgatagaagcttcttgtgcatcatgttaaaggcacaaaaaattacctaatttccactagagctaatccattattcaaattttgtcaggaaaatctggatgaattgtgtaaaactgccaggttccattcctaataaaaattgattcatttttattggggtcatacagtcagcttttaaaatctaacatctcttcttttgccaaaaaacctaacattccagttattgattaaagcttcagagttgctttggaaggtattagattttcttttctatttagatcagaattgttatattggatcaatgcaattgtaaccatctgtaggattcaactctccatgctggcatgtcttgtcccctattttattttcagagctagtatagccactataacttttagtaattctaacaagaatgcaggcagaaaaatctaataaaaattatgagaggaattattttggctttttctccctaaattgaaatatttgcctccttctttctgggtcaaggtatactccctcaccttcccctgcataatggaaggatttgatcatcttactccttgacacttgaaatattgattggcccatgaatactaataatcaagagtcactgtgattagaggttaggaaccctttaaaggacagatctttttcttgcactttctgccccttgccacatgatcataaggcctcgactgaaacgttcccaatctctttctcttcctggtccaaagaatttgcatagagaggaaagcccaagtccccttgtgaacctagctttttctttctacggttgatgttaaaaacaaaacaaattcctaaaggtcatctaagtcaaaccttcatccaaaggatgtagtctaaatatactacattttggctttatcttctcacttgggagttcaggtctccagagtcagaactgggattcctatcatgtatggcctgtatgatcctgggcaggatgctttgtctccttaaatttgtattttctttcctgtaaaatatagctacttagcattacctttctcttaggaatgctgtgagaagtaaataaaataatggattaaatgggtttaagaatattaaggctgggtgtggtggcgcatgcttgtaattccagcactttgggaggacaaggcaagaggactgcttgagcccaggaattcaagaccatcctgggcaacattgtgagacctgtctctacaaaaaaatgtttttaattagctgggcgtggtggcatgtgcctgtagtcccagctactaagaaggctgaggcaggaggatcattggagcccaggaagtccagattgcagtgaaccgtgttagtgccactgcacttcagcctgggtggcagagcaagaccctatctctgaaaataaataaataaataaatttaaaaaatatttactatagaagtgctcaatagcagttattgtaactatattcaacattatgagtgattatgagctcagtttcttaaaaattatattttgttattgttttttaacgatagaatttcttttgaaccatactgtctccctataatttttgtgcattacagctatctctacatttctgatgctttcattatatgcctaattttgtcatgaattctccagacttgttaaaaacaccaaattattagttactcttcctagactgtgatttcttaatacattagcatcctagttatctccttaaaaataacctaacttgccaataaatttgttaaatagaatttgactctgagacctgaagccaccattgaagatgtcctctggccagaatgaagttctgtatttgtcaggatggcaatttcatattcatattcaatttcacttcctaggttttaagttatattgttctttctgctgctgctgttgctactgtatgtgtgcaggggttgactcgtgtgtgtgtgtgtgtgtgtgtgtgtgtgtgtgtgtgtgtgtgtgtgtgttatactcgggagctgcatctaagccagttctcctcaactctgtattatagattttaaatttaatgtaaaattatatctgtctctgttaaattgtgttttttaaacaggggtgagagaggggactgggagaagaagtggtgccttttcatgtgtgtggcctatagtagttctttaattcagtttctcaaatgtttccccaaccattagcattatagttcatttgtaagctttaaaaattacagattgtctgatgcaactccatatctactgactgacgaatttcaaagcatagatcacaagaatccatggaaacataattcataatttttttcacctaaagtttttaagcccttctccctagaaaaatgtttcaaagacaatcttgataaatcatagaagcatctaaatattttttaccatttaaaatttgagaaatattttaacaaatacaaacatatttcttcattatcacttgtaacaatttatgaactatttgttttagaaaaaatgattatttttatctaacttaaacttatctgaacttctctgaaaaggacatttaggaaaacgtggtctgtgtgtctatacttgttgtcctgggatgcattcaaagattactgactactcagacaattgtctaaaatttcaaaattaatacatatcttgaaccactcactaactttttaaaaacacaaagttctgttgatatgttttgttttaactatggtaagaactggaaataatttgttttcacctctgtttcttgactctttcactgtaaagagtgccaactcattccttctatgaaatctatgggaattatctcatgtgtactattgtcctctcttcctatatatatccatctttctttctcttacccttcctccaatctttgttataatttatttttaatttttacactattttccattaaaaataagtaacatcttaatattggactatccataggctttaggcaatattttttactccctaagtatgaaaagtaaaataaattagtgccttgccacatcccttcatcatcccataacccaccttctctccactatagcattacttttaaattgtcaagtttattacatttacattctattttcaaactataattgtctcctatcacagtatccatgaagcagaaagttttggcattaaagcatggttcatttcaaatctcaaattttctcacctccaaagaagatgataaaattaaagtaggaaaattagttttgtgatcaactggaaaggtagaaaacatccaaaacatgtacaacaactcaagcctgtgctttcatgtaattcataatatcaactttatgtcaatacttcctttataccagagtctagacatagaggaaaaaatcctatgattgataggtaaaaatatcctatgattaagttttatatgtttggagaattgatcattcaatttttgatgtgagtgattccaaactattatataataaaaagtctgctctaactctagacattctgctagaacatatttttatagagacaggcggcaagtgagagggaagggcctccattcaataagcattttgactaatttcacaaaattatatattttgtgaaatatataattaaaatttatataattaaaatttcacaaaattataaattttcacaaaactttataacctcccaactactcatttactgtgtatgtgtatgtgtgtgtttgttttgagacagagtcttgctctgtcacccacactggtgtgcggtggcatgatctcggctcactgcgacctccgcctgccaggttcaagcgattttcatgcctcagcctaccgagtagctgggaccacaggcgcatgccaccacacccggctaatttttttatttttagtcaagacgaggttacaccatgttggccaggctgatcttgaacttttggtctcaagtgatctgcctgccttggcctcccaaagtgctgggactacaggcatgagccactgcgcccggccacatttattattaatgtgtataaatatgtccttgacggccgggtgtggtggctcacgcctgtaatcccagcactctgggaggccgaggtgggcggatcacgaggtcaggagatcgagaccatcctgcttaacacggtgaaaccccatctctactaaaaatgcaaaaacaattaactggccgtggtggcgggcccctgtagtcccagctacccgggaggctgaggcaggagaatggcgtgaacccggcaggcggagcttgcagtgagctgagatcgcgccattgcactctagcctgggcgaaagagcgagactctgtctcaaaaaaaaaaaaaaaaaaaaaatacgtccttgacagcaacaaagctatctagattccatgatcctatagagaatatattctcaaattatttgtgactacctttatcattagcttggtgaagagcaacgatatttatgaaagacagtttaaaagacattcctctgttgtctaattatatacagaacaaagccatgttcttggaccacaatgtctcaaaaccctgcaaaattacttttactaagtttggctttattattttacccttacctcttatgggaggaagtttacaaaattcaatcctgcagttatgaatcttcaataactcaagtattgaaaatttatggcagggctgtctttctcatcttaagcaccaggaaaaaatacttgagctcccttatgcaattagtacactatttccatatataaattgtacatcagatttattcccttcttactttggctggtagaaaactcaagaataaaattctcaggtcaatttttaatagctatgtaacatccatggtctacatatttgcattcaaacaaccccggcctcttatttgcatttgcctttttccagtctttacttttgtacagattttatttcctatagttttatattcatagaagtgtataaataaatacaaaaatatttatagatactgcatatttcctaatagacctattttacccactgacatatgagactattaagaaaaaaacatatcagggaggacgtgaatcttcgtgacttgaaggaagcatcctcaacaaagatattgtgaatcccaaagtaagagaaataaagttcaaattgaagcagggttacagactgtacagagttccagtgagaaaggattatgataaataactgcgtataggaattcttttcaatttaaggaaatttcctgattttctgatggccagggttttgtcctttacctctaaaatttactagaactaaaatgaaagtgagacagaagcaactagtccttcccaaggcttctcatcctggagttctctgtcaagtgggttattttgactgtaaagcattcttttgttttctttgtctgaagtcattcccagattagtttgtgacttgcttgagcatgtttcccagcagtgatcttgggctgtcccattcacttctgacctgcacctgctcttttcaagtattgcaccaagagtagctgaggcctaaacagaggcgtgctggcccattcacagagactattcagagaactgctaggggaggggagtgggcagtgggcgggatggcagtcctccagagaaaaaaggaaagtgaccccttaaatcagagaatgaccttttatttgttattagttgtctaagtaagtgtaaggggaccacctcctccataatgcgctttgtgaaacggtaaatgttacatggcctaaaatggtgcttctgaaaagattagatgaattattggtatttaaaactaattaagtgacatgttcagatatctagacagggcataaaatctattatataactggtgttcaaaaacatttactgtttgttccacaaacaagaacgtaaatgtatttggagacatttctgcatgaaatatatcatggtaacaagggatttacagaacacttactaagtttctcactaaggtttgacattcagccattcaatacttctgttgaaatggtattgtgatttcttctaaatcttcagctccacagttgtaaaagaaggactcacacttatattttatctagtaacctaaaagtcagcagaaattttaaaataaacccactaggtatatttacacatttgccgtttagaacacagccttgaacaagaaaaacagatcataagtcatgttaggtatctgtctgcactagacaagtttacagaaattgttcttcagtttcttttattgagatttttgggccactaatctgttccaaaagagaaaaaaactggccctgaggctcaacttttccatcccaaggatgcttgtaggcaagactgccagcggtaccactgccactctgaactaaaaactgcttgccattcaattattcatattcagcccttctaggggagagaaagcactaaagagaaatagagcagcaaaaatgtagacatagaaagtaggaagaagatttgtaatagttacatgggaaaagggaatcacagaagaatgatgttatttaaaataggtgatagaacagactcaggaattccaataaaaatggacagtacccttggtcttcatacatacaaaatgaaatagtggcaaatatgctcaaaaaggtacacagttccgtgaaatgctgaattacctgatcctctcagagtaggaacaagcccagtatttttaatgcttttggtttatcacctgagctgtgccaggcacccacctccacaggaacttttatcactttgcctacattctcctattatgagttaagtatatttgataccaatgtttatttactaatatacacatgctaggtgactattttgttcaaagttctttccatataaattaagatttccaatactgacagtagcaaacatttataaagtacctcttcacactgacacatgtagattatcaaaattttacacatttgaaaaaaacaaataattatttagaacaaacaagccaaagcagctgctgcaaaaatatgtgagtctatatgaggtacatttccaccatgtaaagtcaagaggctgttgaaaataagaaattgtgagagatacagaaaaactacctccttttcggttatagtatatactgaaacctctcatttatcacatttcatctgactaaaaccaagagaattaaggtgacaattgaagacgtcaccaggggtattttggttttggtttgaatgctgtagactgaattgtctcccccaaaaaatgtgtatgttgaaaccctaaactccagtgtgtccgtatttggagaaggggcctttgcaaggcaattagggttagatgagatcatgagtatgaggccctcataatgcatttagcagctttataagaagagagagagaaagactgttctttctccagcatgtgaagacacagcatgcaggtagttacatgcaagccacaaagagagctctcaccaaaacttgaatgagtcggcaccttattcttggacttccagcctccagaactgtgaaaaataaatgtctttcatttaagccacccagtctatggtttttcttatagcagcctcagcagagttgtaaaatattttgaaattaaaaaaaaaatcactggtaaaggagaagtgaagaagaagaagagggaggaaaagtgaagtgaagaagagggaggaaaaaagaaaaaacttttgtctggaaagaacttgttttataatgtgaaataaacattttgttaaatgctaaggataaaagaaatgtaaagcttgtttgtcttgtatataaatgacaaaaatggcacttttcatgtaatttgagatcagtagacgttaggacagaaatcaacaaaaaatatatctcactgccaaaaacagcagagatggagttcttttttactgaatgttgatgcaagacacaagagaaaactttggggcatgatgtaagaatcaattaatgcacataaatggagcataaatcacattaatgtattgcaatgctcttgcacactttagcccctactgaaacacaggcctaatataaaagctttctcctctgtaggcattaatgactccctccccttccttgtcccaacatcttttatgaaacttcaccactgcacaagacaatgaacctaaactccagccttccctctggattgcaagctactggaggagcacgattgtatgttgctcagcttatgctgtgctcgtctgtccctttctgtccctgctactggccatccaaagaggccggaatcttcactcccactgctggaataagaaagttcagaatgtcaaattgaaatggatcataacttactacagaaggaattattagttatttagagaaaaagactttctcatacatactttttctcccacatctccacctccatcctctttccctgatgcttacaaatgtcttccactgatgctcatgacgataaatgaacacaaaagtctggtgataaaatatagttgaaatagtccattgtaaccctatgtggtacaatatgggttaaattagctctacaaactggtgtgggaacctgttgttttaatgctaacatattgtctgttttccaaaacatttttgcaaatgtatttttggaacactacagccagataccacttacactagtacagtttcagacattatatttaaggggttttttggttgttttgttttgttttgttttgttttgtttttttgagacagaatctctctctgtcgcccaggctggagtatagtggtgcaatctcggctcactgcgacatccatctcccaggttcaaacaactctcctgcctcagcctcccgaataactgggattacaggaacctgccaccatgcccaactaatttttgtatttttagtagagacggggtttcaccatgttggccaggctggtctccaactcctgacctcaagtgatccacctgcctcggcctcccaaattgataggattacaggcgtgaaccaccatgcccagtctatttttattatataatatgagctacattctagcattaatatttaggtttagagttgtaaacgcattagaaatgactgaactagaatttttttcaggtaatttcaaaatatttttggttcttggaatgactatgcattcttggaatccgcaaagtgccctggagaccaccagctaccattaagtaagcagcaattctgcctgttgaaatgacaatacccactgcaataactgcattcagcaaggggaaaaaaatactatagtactgcatattcttcccttttaatcaggcagattctcaactcttactttgagctgcattctcctatggacacttttacataaaatacaaccaaacatcattacaaaggtcaaaatatactttggaatacatttgcacatgagattgaggggaaaaattagtttttgtttcaaaattacattttaatatacttatcatagccttctagagccaaagaagtgcctattaagaactaacactggccaagcactgtggctcatgcctttaatcccagcactttgggagatcaccagaggtcgggagttcgagaccagcctgaccaacatggagaaaccccgtctctactaaaaatacaaaaattagccaggcgtgatggcgcatgcctgcagtcccagctactcgcaaggctgaggcaggagaatcacttgaactcgagaggcggaggttgtggtgagccgagattgagccattgcactccagcctgggcaataagagcaaaactctgtctcaaaaataaataaataaataaataaataaataaataaataaataaataaaataactaatacttagcaaaaacacacagtgcaaatataaatagtgaaataaaatactgccctacatccatttaaagactctatatgcaaaagtatcaaattcctttttattgtaaaaatatactataataatttagcttttaacaatcaagtaaatataattacatctaagcaacaagattagcaccctctacacacattcttaatgtatatagtataaagtggtggcaaatgaaatatattatctataacatggttaaagagttgttgactgtttaattattaattattatacttaagacagttctttgagaacaattaggtcatttcaaatggtcatatgtcttttataaatcattaaatgccctcactatgatggctggtaaattaatacatattgctagtcctttcccaagcattttaaaaaaataagtaaccatagaaaatagtactaacaaaggcagaaatatgttgtgatgtatctcttggaaataagtaagtgtggctctcttattcttcaaaatttaaagcattcttagttgttattccaattcctccccctttaaaaaaagaaaggcattttcttgaatactgttctttatgtgaaagttaagattaatactggatcagagaagatcacatatgagtcaaaaacaaaaacatacatgtttagcaatattgttagctgcttttgcactgccaaatttaacgtgtctttaaattcacaaatgtttaatcatgctgggaagtgccaagggtgataaattttatttatgaagttataatatattgatatgatgttctaacaatgaacagtaccatgaaaacacccgattttatgattcatttagaattgtacttctgagacacacaaaatgaccaagagcacaatagtaatagttgcttattttcttagctaaatgcaagtaaaagtggcaaaggaaattaaagtacattagaatagcttaagtgttcaggttcacagtgaagttgtgcctgttcaaatttaaatctgaaggccgggtgcactggctcatgcttgtaatcccagcactttgggaggcagaggtaggcacatttcttgagcttaggagttctagaccagcctaggcaaacatggtgaaaccccatctctacaaaaaattaaaaaattagctggtcatggtggcatgggcctgtagtcccagctacttgggggcgctgagaagggaagatcacttaagcccacgaggttcaagctattgcactccagcctgggtgacaaagtgagaccctgtctccaaaaaaaaaaaaaaacaaaaacaaaaacaaacaacaaaaaaaacaaactacatctgacctaatctcttcaactccagatcttcctgctggcagggttggcttcttcttatataaaaacaggaaagaagtactgactttctatttacaaattcacttgaatgctacaaattagtaaatattctagaaattttattatatttcacaatcaaaggagatcatggtttatttttatttggtttggttattttactagcagctaaatggacatgtgacaaactacagaacagatggataagaagataaaatccagatgttttgaccacgaatgctcttttctgagagcaaaactcacaaaattgtgaaaataaattcaggttgatttttcgtttttcacattattgtccacttcagataagatccaggaaggtcatagtatctctgctgttagcagctttaggggacatgagagtggcaggagaatataatcaagggggcaaagggcaagccaggtgctacaaggagcaccaaacttgcggttccagttgcttccccagagtgggattttgatttcatgtgaggggaaaaaaagtttgcttaaagtttatatgaggtcctgtacagtgtgcaccttctgcagacgagaaaagaatgcttaagtttactgtaacagcagtatgtttaagatctctccttaagattttatcctctaaacttttatttccagaacaaaatgaaaagaaaccctgcaattaaaacacatatattaaggtaggccgggcacggtggctcacgcctgtaatcccagcactttaggaggccgaggctggcggatgactggaggcagggagtttgggaccagcctagccaacatagcaaaaccctgtctctactaaaaatacaaaaattagctgggcatggtggcacacacctgtaatcccagctactcgggagactgagacaggagaatcactttaacctgggaggtggaggttgcagtgagccgagatgccgccactgcactccagcctgggcaacagagcgagactccatctcaaaataataataattagtatatatatatatatttatatatatatatatatacacacacacacattatgtgtatatatgtaaaggtatatgtatgtaaaggtaaacaagaaaacaaggatgggagttttttttagtcccttttgtttcttagaagtttcttaatagccagttttttttatagaaagttattattttgactgttatctctgccaccctgcaaacctcttaatgcatgctcaagattaacgaactttgaatgttcatgttgatagtatttaacaaacactttgatcccaatattcatttacgtattacgcatgctctgattttcataaagatgtcctgagttcttcacttccattcttaaatatatattctgttaacaacacagcatttagaagtacagaatgctaaatggtatgaggtgttatctctactgaactgaactcctagtctccctgccccctgacatttctaatcaggaagctggcccacttagctgatgtacagattcgatgcctcattcttacttgatgtatgaccatagaaattccccatctctattagaaacccccagtctctgtttccccatctttaaaacacagttaactgtatttaatttcctgggttatggggagaataatatgaactaaggtatatatccttaataaacttaaaataactgagcagagtgccttatacacaataaacattcccataaatagatgtaattgttttgaagttaaaattctgacgtgtttgtttaaagtctccataagttaaaatttattgataagttaaatatatctcacgtgttctttgtgttgttacttgagtttttaaaattgcatatgcaacatgagctcaggggagaagacacttccagtctgcggaagtttctctgaggtcttcagggaataggacagaagaagcaaaataaagatgagctcatattccagaaatctgcaaaggtttacagaaagggcaatgtaggtgtggctcatttgaatgacaatcagtagaacactctactcaaagtcagtgaaattagctgtaggaataagattggagacagcaattcctttctaaggtcttaaccttcctctaacagaaagtggagtcaataacgtatctgtgttcaaacctttgtatttctttggagtaaaaagaaaaacctctgacgtgatcattatacactgtgtacatgtatcaaaatatcacatgtacccaagcaatatgtataattatgatatgtctatttaaaaatttaaaaaaagagagaaaagtctcttgggaaagttggtattctccctgctctcaggtaattgagcaaacctggagttgaaatagggttgaagcttgagaagctctttagggatttcttaaggcaaatcttaagaactaaaacatcaacaagaaaagtcaattatcgaagaagctaatgcaaaatgactagcaagagtgtaaaatgctacttctagaaaagtggtttatggagccattactgtggatgtgtatggttccagagatcctaggaagcccagcccccataccacctattcaaacgactcatgtgatatattttttccttgcagtgtttaccattggttatggaacagcaccaccctcacacacataaaaatgtacaaagctctgtatccaatatagaaaacatgaattactgaagagactaacagggttataaaaatgaaaaaaatttttttaatcttttcaaagaaattatattatttttagagaaatttttctttcatgatatagtagctccatttactaagggtagttttatttaaggctcatgctatcttgacattcacctcctttttttccccatgaaaaacataaaagagatttgggttttttcctccttctaaggtagacagtgtggaaaggcagaaaaaaaggccaaaactctgccaaaaagctgtacatctaagcaagacaactggcccattaacaaatgtctccatcaatatcttaccatctgctgtttgtactgtacttgtcaatattgagcatcactcacagttcatgtgaccatataaaatctcagaaagcacagagtaccaaggtgggaaaaaaaagcaaattcaaagatggttttagaatctgacaacacattcaccacacaagtatataattagatggaaacaagttatgtactttgcatgctttatgtgtcaaaggaaattcctcataatttctaacagtagattgattatgactggcaaaccatgcagtgcagtctccacttctccctctgattcacctgactttttgcccactcatctaaatcagaagctcagattaccagattaagctgcttaaattcagatcagtgaattttaattattcatgttataaaaggatactgatgttgtggcacacttagataggatatagcccaaaaatgttacactggttttattaataaataccttaaatgttttccaacaatacaatttttttgtcttttatgttttgtttctttgcacagattcaaaggaagcagaaagcaggagttgtttgcagaggtacaattgatagtcccatgtgacggaatttaaaggggactggaaaggggattccttaagggagatcttaagaactaaaacatcaaccagaaaagtcaattagcaaggaagctaatgcaaaattagtagcaagaatgcaaaatgcttcttctagaaaagttgtttattgaaccattactgtggatgtgtatggttccaagatccttcccaacttttgtctttctgagtttgacataaactttcctatttcattaaatattccttcatttgaaaatattgctgtgaagagtgacactgatagtggcaagaagcagactaatccctaggcagacaggggcaggtccctggtgaaaccagaccttcaagccaaagacactttaaaacctaaaagccaagctacaagttaaatccatggactggattaaaaccctctcttcccatgtggcacactttcctctgattgatccttacccttcacttagtttacataaacctacccttccctaattggtttttcatgctgtcctgccaacctttgaatgatgcctttgttttagcctcttgcatactcacaaaccaatcagcacgtgctcccccattatgagctcataaaaggcccagacccagccacactgagagagacagaccacccaacttcaggtggggggccaccctcatgtcccctttctgctgatagctgttctgttgctcagtaaaattcttctctgccacactcagccttcagttgtcggagtaacctcatttttctcagacgcgggacaagaactcgagaaccatcaaacatgggtacaagccgtaatgcaggggggctgggacacactctgcccagccatgggctgagctggtatgcaagccaggcaaggcccagtgggctgagtgagtgtaacacctcctgtggcaggcctggggccaagcaaggcctaggtgggggcattgctggccacagaagtccctgactggcaaagtggccacgaaaaatcctgcatcaacatgttcaatcattaacagtttagaatgaatgaatgtattaacatgattggagaatagatagtatatgaacactaggtaccttggggaaaagaaaatcattgggtcttttcccatatcaatacaacaattccaattagaaatatgttgctttggatttaaatgcttgagtgcctctataaggcattgggaaaaaaacagacaataaataaatttattagccctaaccctgaaagatacagttatccctttcctacctaatattctaaatttaattttgcacacaggttataggtaattggtcttctaactcagtcctaaaaaattcaaatacaataataaagagacagagagagaggaaggaaggaaggaaggaaggaaggaaggaaggaaggaaggaaggaaggaaggcaggcaggcaggcaggcaggcaggcagggagggagggagggaggcaggcaggaagggagggaggcaggcagggagggaggccgggagggaggggcaataacactttaattgccttgaaacagcacttgcatataaaaattgtagctatatacaaacatgtaggagtttaatgaagtaacagaaatgaatttcatcttgcaatagggaaacattgacctcttatacaaagaacagcagtaagcatgctcttgaacgtaatgaatatatgatccatgctggaggcaacagaggtctgtgcaagttatgcaacagctcaaataccactactgtatccatgttaacaaaaatataaacaaaaataaaagctaataagatatatattgaaattagaaaatgggattaaaaataaaatttaagcccttggctgttttatttcaatgtaatagcagatataaaagatgcagtttctctgcattcttatattttaatataacaaacactgagaattgaaaatatgcttccaacaattaaaatccacctatacaaatatctgtccctaccagtgactaagctctcgggtgtggctactaaatgctgcactgtatttatactaaagctttcatttgcatctttatgatataaacaagacaggataaaactcttaaaacattgtaaaaaaattattcctaatattcgaaaatttaaaatcatcaaacaaatgtgtaaaataataacatttgagttactgatatatataatttgcatacattgttttatttacagataaacagacacctcatagacttctagtgtagcatcagtgagaaactagcagcaacaaccctttgttgaaatgagaattagggagcaacagaaaggtggagtgagaagaggcaaagaaaaatttgcccaaggtcaagttgagaaataaacaaaactttattgagactgtgctgagaatatgcaatgcaaataaataaagcatattaagttcgccaatagaggcaagtaaaaggtagaatgggactcaaaggagggttttattaactctaggttgaaaatggagggggaggggtcaaggagggctccaaaagacacatttcttgatacgtctacctgcattttaaatcacaatcgagtgatttttatcttattcctcattcttctttataaatcttatagagcttagaagaaaaatgacaaaaaggaaaaagaagaaagagaaatctagatgaagggagggaagaagggaaagtgggagaaagaaaagacgaaacaaaggaaaaataggaagaaaagaaacaagggagaaaggaaggaaaaataaaaaccaaattttctctgtattaaatgaaatctatcatcatagatgataggtagctagacagacagatggagatggatagatacagccaggttatcaacagccaagagcagtacaagtttgcttcaaagacattttttgagagttgtaccttgtatttgagacacagaaaaatgaatcattcctgaagcggcaataagcaggtggtttatttcgggtaagtttttaggggcttttttggttttgtttgcttgtgtgttttcccagaatcttgtttcataaagatttatcaaattcaggatgaactccaccattagaagtaaaagaaccaactgattttctgtgagacaaagagaagtgaaggagaacagaagaaacagaggttcaaggcaacttcaaacttttattagtgagaatgtacataaagccatagctctcccctctgggtttgactaaagtgaaccaactcttagatacaaatgtgctgccccagatggagggcctttctctaaaacaccagcttcattatttttttatacttcttttaccatcagccataataataaaacctaatgacaatttcaatagtaaaaattagcatttcccatatttgttagttgctactatctcctatatttgctaagaattctggtaaacagtatacttttgaagcatcctatgggcagataatatagtcattccactttgcagatcttttcaaaaaaatgtatcaaatgcctgttatatgttgagtactattctagacactaaaaacacaacatcaaattaaaaaaaaaacacaaaaaaactccaactctgatggaatgtatgatatgatggagtaaactgagctagagagaagtaaaagatattttcctggtattgcacaccaagtaagtgacaaggtcagtgtcaagcagtctgattccaggacagcttcccttacaccatgtggtttgctgccatggaagctaatgcatacttgccaggggttatccacggcattctgcttttcagattttaattttaacgctttgtattatattagtagtaattcaacgtaatgtagttacatatttaaaaaccctctaagcgcatgtctcatataagcatgtaaggcacttcaattactataattatttcatttaaattcattgataaaatgtgtattctaaaagtgactgaggaactgaattgaatattatgctgttcatggatatgaacaatagctgagcacaattaatagtctatttgggtacaattaatagtctgaaggaagttggactaacaggcatgcctacctgcatttataatacaacacttcagaccatggtcaatgtttagtattatagtaagtatgtattttctcagcctatatgctagaaatattttctagcataaagaacacaataattggaatcaagcagactgctcatttaactactttgagtcccaatcattggcataaaaaaaataaaatgggcataaaacacattcccaacatttgtttgataggcttaagggagatgatatatgtgaaaatcctatgcagactacagaatgcagcatcctttataattttctcttttcagcattacagaattgtttggactttctaatatattttattacttttagtaattaccagttaaaatgttcctatgcataactcaagataaaaataattcgcccttaaaccaacctcaaggtttagtagccacttttttctgagttgaaattaccttttcagctttcatagaggccttttattctctcagctttctctttccaggctgggtgcagtagttcacacctgtaatcccagcactttgggaggctgaggcaggaggatcgcctgagcccaggagtttgagactagcctgggcaacacagcgagaccccatctctataagaaataaaaaattaaaaaatacataaataagatttctctttccaaatccaggttttgtgtaatttcaagcaatgtggaattccagatataatcatatagttccataatctggctctttaaaaatgaaggagaatatttggatagtcttaaatcacctaaggtttcttaatactagtatctgtcaaggttaattcaccactctgtggctacacaatatatgtctgccctagggactccttgtactagctacttctttacgtctaaatagctattgctcaatttgtaatactgcccctcacttctattcactgtctgtacccttttacatgaagctcattattatcttgaagcttgactttcctggcagtagtccttctacttcttatatccaaataatgaaggaaatctaactataatgaaaccaaggcctaaattactactcaaaatattaaagtgtctggacccacattggcaacataataagcatggaagaaatcaagtatatgtagacacaaaagtttgctacctcctcattgaaaagaactaaggttcctttccattcatattccttaactgaaaacaaaagtctaacagaattccaaactagagattaaagtccagtcacatctttccaaccaatttctgacactgtgaattgaaatgcgtttctttttgaacttatgcattgatttcttcatgtctttcacctgtttctaggtttttcataaaagttgcatggtcctccccaccccacctccattccacaccgagtaccaaccaaaatcatttggtcttggaaccaaaatccaggaggctttcatcactaactcgctttccccaaaaggattctggcttttgtttatcatcagtacttggtctttctccaactaacaagctccctgccctcacatgtataacctgtatcattgtatttgtacttataacctgtatcattgtatttgtacttaaaataaaaaaattgaatattcttatatgaatctaaaaatatatttttattttaatatacctatacttggtatatttcagtcttctcttagctctttattcttctgacattcttttggtccttcgttttttttctttgaatatacttatctaacatatatttgtgtttatgaaagtatttttatattgcaagtgattattcttaacaatattcattttgcctagaattgagcatttaaaaatacagaagtctatgctgacagagtacacaaaacagtgaagaaatacaaaggcaaatcagtgattaaaatataatgcaataaggattttcatgaggtatctgcacaaggagcaatatcagtatagaaagtagcaactgattccttctgacagccaaatgtattgagcatatattgccatattaacgaatgtgctaagcacatatgacccatttaatcatcgttaccatgctctgtgataggcgctgttataatcatgagacacagagaggccaaaaaacagagctaacaccgtagcagagtcaacattcacactgcttattagataaaacttactagataaaactctgaaagactaaatggctcttattagacaataaaaggggaaaagagcaaactgggtgctggaacagaatggccaacacccaacagtcatgagtatattaagaacctggtgagagataccagtgggataggattagatagatgaagagagtggctaagaatgaggcttcatagacaggctatgtccaactactctttcgtctgaatatctaaagatgaagtcactccttaaacatttagactgtatgatgctaagattaaactacaactattaaagaaggaagggctcaatagccttagagccccagtcctaacatttaggggagagactaaaaaagtaaggaagaaagaacacagctggaagagaaagatctcaatttcttcatgatttttattgcagcaaatcaacaactttactactccctataatttaacagtctttgccacagtgaagacaaacatcattccattcaggaatgtgtagcaacagaattctcaaatcagaaaaaagaatgagttttatctttgaaattcttaattatgtggtgagtaaatacatatgtgtgtatgtgtatactcacactaacatatccacagaattgaaatgctgttgttacacacaacaaaaaataagtatcagtttacagatgctttgttcatttctgagcgaggtctcactacactaccacttcagtttcttttctttctcctttttttttttttcagatagggtcttgctcagttgtccaggctgaagtgcaatggcataatcatagctcactgcagcctcaaacccctttgctaaaggggccctcccacttcagcctcccgagtagctgggactacaggcgtgcaccaccatgctggctattttttaaaattttttgtagagatggtggtctcaacatgttgcctaggctggtgtcaaattcctgacctcaagagattctcctgcctcaccctcctaaagtgctaggattacaggcatgagccaccacacccggccccattctcccctttttttttccttccttctacccttctttccttccttccatccttctttccttttgatattccttttactctttcattctttcttttaattataagctgaggtgatttttataagggaacagagaaccttctacatttgaatcaccaattcaaagtagatcaacacactcaccaaaatctggctggtttgtgattagtatgagatgaagtttaaagtctcataaaaatcagagtcagcactaaaaggaactcttgtttccactcaattctatttctgtattgtaacttagcaaaaactctgttttattgggaggccaaggtgggcgcatcgcctgaggtcaagagctcaagaccagcctggtccacatgacaaaaccctgtctctacaaaaaatacgaaaattagccaggcgtggtgggggatgactgtaatcccagctactcgagaggctcaggcaggagaatcacttgaacccaggaggcggaggctgcagtgagccgagatcgctccactgcactccagcctggacaacagagcaagactccatctcaaaaaaaaaaacaaaaaaactctgttttaaatagctatgtagaaattcaactattttcacaagatagtaaaacaatttagaaaaaaagttcttaacaatgataaaacaatgatgaaacatcgtttacatttcccatttataaacaagcagacagggagactggcgaatcttgtatttacagttttaaatcacttcctttttataaacagataaaaactaattagaagattccatctccctcccactccccacccccccagcccccacccccaccccatacacacaccttcgttctttcaattttataccttccatcccagaaaaaaaactaaacagttcaaaatggggcacttgggagacatcactgcaactgacccctaccttcactacattaaaggtgcctaaactataataggaaatcttctacatttaagtcgctaattcaaattcttccagatttccaggtttgtagcatcacacattcatttattcagccaaatttgtttagcacctaccacaggcaagctactccattaggcattagaaataaaaagataagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagcaaggcattggtagcttgatggggatggcattgaatctgtaaattaccttgggcagtatggccattttcacgatattgattcttcctacccatgagcatggaatgttcttccatttgtttgtatcctcttttatttccttgagcagtgatttgtagttctccttgaagaggtccttcacatcccttgtaagttggattaaaaacaagcaatggggaaacgattccctatttaataaatggtgctgggaaaactggctagccatatgtagaaagctaaaactggatcccttccttacaccttatacaaaaatcaattcaagatggattaaagacttaaacgttagacctaaaaccataaaaaccctagaagaaaacctaggcaataccattcaggacacaggcatgggcaaggacttcatgcctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgaagccaaaaaacacatgaaaaaatgctcatcatcactggccgtcagagaaatgcaaatcaaaaccacaatgagataccatctcacaccagttagaatggcaatcgttaaaaagtcaggaaacaacaggtgctggagaggatgtggagaaatagtaacacttttacactgttggtgggactgtaaactagttcaaccattgtggaagtcagtgtggcgattcctcagggatctagaactagaaataccatttgacgaagccatcccattactgggtatatacccaaaggactataaatcatgctgctataaagacacatgtacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggagactgttgtggggtgaggggaggggggagggatagcattaggagatatacctaatgctagatgacgagttagtgggtgcagcgcaccagcgtggcacatgtatacatatgtaactaacctgcacaatgtgcatatgtaccctaaaacttgaagtataataataaaagaaaaaaaaagaaatgaaaagataaataagacattcatttattccctcaaaatgctgacttctagagactggaactacatcagtgaataaaaaggcaaaagtttccatcctagtaaaacacacattttaatggggaagacagaaaatgtgacaaataggtaaaccatatagtgtttagtatttacatgcataagaaaaaaaataaaattgggaaatgggatagaaagcgcgaaagcagagttgtaattttagagaggtagacagggtttagtttcttttttcacagaactcagtaaagaaaggctatcttttcctaaaaactatggcaatacgatgtgataaatgctactaactgattgacaaaatgtgaagattacatgatagagctattgattgctggagaaatcacagagggaagaaatcatctgaattctgaaagagaagatgacattcacaaggaggctgggaaagaataggcaaaggaacagcatatgcaaagtcagagaggcagcatttggcaaataattgctatttatcagcagatagtagcaattaccataaaattcagaacgtaccatgttccagatactttcacacatcatctttattaaccctcacaataaatctgtgggcttattaatattattcctatttttaaaataagagcaagaccagaatgaagatagaaggagagacttgaaaaaatctgttgaagtgggccaggtgcagtggcccatgcctgtaatcccagcactttgggaggctgaggcaggtggatcacaagatcaggagatcgagaccatcctggctaacatggtgaaaccccatctctactaaaaatacaaaaattagccagacgtgatggcgggtgcctgtagtcccagctattcgggaggctgaggcaggagaatcgcttgaacccaggaggcggaggttgcagtgagcccagatcactgcacttcagccagggcaatacagcaagactctgtctcaaaaaaaaaaaaaaaaaaaaaaaaaaagaagaagaagtaaaataggttgaggttaaagagtttgaatattatcctttaaacaagtcaactgaatgttttaaaataaagaggggacatgatcagaagttacgggtttttttaaattgtagactgtagtgtggagaacagatcattggggttgggaggcagaatgataatagattattatttataataacgaaaggctataatttagttaaaatgtggcaaaggcttgaccttagccagtaacagtggaaaaattaaaagtaggataagaaaaacctggtagccaactaaatttgggtggaaggggaatggaagggcataaaaaggggagtattcagcgaattctaaatgttctaacttagaatatctagagggtgacactattagcaaagaaaagaaaggtaaggggagaagactgggagaagagaggacggagataaaaaggggtctaagtttgaacttcttaaatacatcttggtgatactgaagtcaagaaacccagtgggcctgaaatgatgaccagactgattagagaaagattttggaggtaatacatttgagaattgttagcaagtatatctttgtattagttagaatttttttggtagcaaaagacaaaaaactcaaattgcttatacaagtaatgtaaactctttttggtcggttgtaaagtctctaaaagtaaggtggactttcaagtgtagtttagttaggactccagttctctttctctccaattgttctcaacttgtcttcttccttgtatcatgtcatcatggtttcacttagggtagcaaaatcatgtagcaatccccaattttatatctgcatcccacaaaacccagaaaagaaatattctctttgctacttactgaacaatagtgctaggcatctttctagaagcacttgggtgtcacacccaccactgtcaaggttgaagagatttcactgattaacatggaatcagcacccctaccccaaactatatggatactacatcatgggggaagaccggaattaatgctggggaagcaatcccagtgtcctcctcaatctccttccaaggctgacagtggctaattgttccactacgtagcaggatgaagtttttatgaagtcacatctgaaagacaaaagtatttttctacaatggacaaactttttaggattgagcttccaatatcatccaaatccaactacacttccttaccagaggtaatgacaaagtaaatattcaggctatatgagaaactatatttaaaatgtaagtagtgaatagttttcataaatgtgaacgaagaaaatctagcagtgttaactaagaattcactttcctcttcctctatctgcctctcaccccaatctctacagcaactcagtagccaaaggacgacaccaaggaacacagaccaaagagtcaaaatcttggatgggagttctaaataagttctggaaactctggagccaaaagaaagacagggaaagagccgataaagccctatcacctgcaggaaacttctggttgcaatgaggacacagagtgacatgtgcatccaagagggcacggcaggaacatggagagcgagggatctgtagtagggacaaaggtcagaacagattggcttcatttcaaaggatgctagatgaaccctttctttccgaagcctggaactgtttaggccttccccagatcttaattgacacccctggttcaaataagttagggaagaatccttaaatgagtttaggtgaattgttaactagcttaagttttcttctgagatggttaagaaggggtcaaggttgaaatgaagctcaactgtgggggaataaatttagttacatttcttgcacacttgtttttgtaatgcattaaagaattttgtttaaagcaaaactctaattccacacttggcaccatttggtaactttttaaaactaactcattatttcagaccccagtcaatactattaattttacaactgcagaaaagaaaatcataaaactgtaccctgtgtctcatgcagtgtcactctgtagtcaacaaaaaagatatttgctggatcagtgagtcgagagagagaagtgatttgccaaatatggcccattagagtactaagaatttagggttaggtttcagcatttgttgctgtcattcaagtactaaatttatatttacttgggacagtgcgtagagtttgaatagcagaatctaaagcatgtaagacactttcctgatttagctcattttgagagttattctcattgagctagaatgtttcaaaaatggttaaatacaacttttttggtactatgataacttttgttgaggtaaaatgagttagcaaataatactgatattctctttatcatttttaaaattatctaattactcatttagaagtcactgttcttgggatttctggacacaaaacatgctcagtaatggaggacaataaatgctctcaatttacaagtgaagatgtatgcctaattagacaatagtagtaacataaaaaaatagatggttaacacactttctttttaaatgtatgtatcaaatctgttaatagccttagaatggtcttttactaataaaaggacataaaattaaggtttaaaaatgtagatatctaactaaattaaggcattcaaatgagctaaatttataccaatgggatcacacttacaaatctgggagaaattactttacttctaagtaaagacattgcaacatccctgggaaaaattaacactgatcttacaggaggctactgagtaggaaaatgaatgacaaagtctaggaaatcatactgtggctgaatgattaacagaaatgcatctgtgaaagttagaaggagattccgaggaatgacaagtatacataatatatgtacttacatattaaaaaaatgcaaattatcatgactgtacaattggaactacttttcaagtgtggggattatagtttgagtggtgtctggtggaatacattctccaacccatcatcaaagtgtgtcacatcctcactctttccactttgggtttatagtttagatgcctgtgctacatacaaaaagaaaagaatgtatttttgaggagccctggctcagaaatcatagctttggtgttcattttactgcttttgggggacaaatctttttttatatatatactttaagttctagggtacctgcgcacaacgtgcaggtttgttacatatgtatccacgtgccatgttggtgtgctgcacccattaactcgtcatttaacattaggtgtatctcctaatgctatccctccccctcccccaaccctacgacaggccccggtgtgtggtattccccaccctgtgtccaagtgttctcactgttcaactcccacctatgagtgagaacatgcggtgtttggttttctgtccttgcaatagtttgctcagaatgatggtttccagcttcatccatgtccctacaaagtaggacatgaactcatcattttttatggctgcatagtattccatggtgtatatgtgccacattttcttaatccagtctatcactgatggacatttgggttggttccaagactttgctattgtgaatagtgccacaataaacatacatgtgcatgtgtctttatagcagcatgatttataatcctttgggtatatacccagtaatgggatggctgggtcaaatggcatttctagttctagatccctgaggaatcgccacactgtcttccacaatggttgaactagtttacagtcccaccaacagtgcaaaagtgttcctatttctccacatcctctccagtacctgttgtttgctgactttttaatgattgccattctaactggtgtgagatggtatctcattgtggttttgatttgcatttctttaatggccagtgatgatgagcattttttcatgtgtctgttggctgcataaatgtcttcttttgagaagtgtctgttcatatccttcacccactttttgatcgggttgattttttcttgtcagtttttcttgtttaagttctttgtagattctggatattagttttggggacaagtctttatctgtttcaatcttagaatttttttgtctcattaatttgttaattttatgctttccactttcttttcaactttatccagataattcctcccaaaaaataaatattcaataactataatgaatcaatgtatgttttagtaatttcatatgataggtccacatatataaacactatcataacaattaattaccctacttactacccctctataaatatgataaagaggccttactggcagatctgttaatgacagttttctgtcccaccaaagaatgtgattgatatagacaaagagttgcagcacggctcaaattaacaactgcctgacaggtgtcttcaactctgctcaagtgaattctgtgacatctgcttaccagagagcacacatataaggtgtgtgagctcactttgctagactatgaaaatgcatttgaaatccaaagaggaagtagaaaatgaatttgacaaccatatttgaatatctttccttgggttagagcttctcatatcactaaataagcaaagtaagatatgagtacaccaaatgactcataatatttctttacttctataaaatgtaatcctctatctctcaaatattgaaagactactactgttatttattaattgatttttttcttgatggtctgcacattggtcacaaaaatgtctagtaagagcaatgcttgctaaaatttttgaatgaagattccttttaacaatgataccaatttatgctattataaattcatgaagatttccaaatacaatttattagtaacaacagcattgacatacagttggaaaattgcaaaaattattatttttagacaatttaggtgggagaaagataaataagacacagcatctgcactttacatactatagtgtattaaataagagttctctggataagtgttaattaatgcaactctattcctggggactagacactgtagaacatagtatttgttcaataaatcatttttgaacaaataatcatttctattgaactgatatagcccatctatccctgatagattagggattctatgcctaatagatatagcccatctatccctgatagattatcttctaaaatacctagaagatattcctccttcaataatcttcaatggctcccaacttccatcagaataaaatatattctttgcattaaaaggactacacaacccggcttgtactttcttttttttttttttttgagactgagtctcactttgttgcccaggctggagtgcagtggcatgatcttggctcactgcaacctccgcctcccaggttcaagcaattcttgtgcctcagccttctgagtagctgggattacaggcacccaccaccatgcccagctaatttttttttatttttagtagaggcggggtttcaccatattcgccaggttggtctcgaactcctgacctcaagtggtctgccatctcggcctcccaaactgctgggattacaggtatgtgactcagtgcctggcctttccttttactttctttttatctcctctcatatccctttacacaaggcagcacagcagagtgagaagaacaatgcttttgagaccagaatggctgctgggacagtacacgaaacctgacttactaatgtatgatactttgtatgacatctgaatatatgaaactctttgaacctctctttttactaaataaaggtaattaatacctgggggaagttgtaaacataataataaagatacacttagcacatacggcacagaacagatcctggacatgtactctgatactgttgagataactttctctcttttttcaatcaagttgtatactttctacttttgtttagtgttttcttccttctaaccttggactggaaaatccaccctattgtacttgggcctaaatcctattccattctgtaagtcaaattgaaagctaccattttacataagcaccgtattcaggtaccaggcagttgtaaacacagcgtagtcaactaattacagatggtcccaagaaattttatgtacacagagaagacaatttaaggcaattttaagctaccaacaaagcttcaaagatactaaagctttaagagaaaagacgtgatggggaggatggcaaaccaacaacacggttaacttcataaatgtcatagcttctgtgaaggctctgtgacctcatgagcccagagttgtcactctttttttttttgcattcattattgaactattgtacctagctgtgaggcacacacagctttgaaatattaattatttctttggctatatctataagttccccagcttgtaattacttgagaacaaataaaaggccaaaatccatagtctttccagtgccttctatatagtaggtattcaaccaacatttgagtgactattacttgtagattatcagatactgaaagtcttgtgactttttttcaattatgttagtacattttaaaatgttttttctgcaagtcatgcaagccaaatatatgtggatgtaaataattctgaatgcaccttacagagttccccaattttttaaaggtctatttcttctggtagcctcttaatacaggaaactgaaatatgaagaaataaagtgtggtacccaacatgatgcaagtattggcaaaagcagaaactagttactgttaggttctcctattcagtgattctcaactttggctacacactaaaatcatctgggtaaattcttaaaaataccaatgccaggccaattatcctcatctctagggtagggccaaggcgctggtaacttttttaaattccccaggcgattcaaatgtgtatctgtggtataaagccactgtacctctcgtaattccaatgtacaatgtgattgctgagagttcctgagaaaatcattgcctaaggtctctttcgcacactatcgttttctgggttttaaatacagtcatgcaacacttaatgatagggatacattctgagatatgcattgttaggcgattttgtcattgtgcaaatatcatagagtgtacttatacaaacctagatagcatagcctactacacatctaagttgtatggtatagcctactgctcctaggctacaaacaacacgctacggtactgaatactgtaggcaactgtaacataatgataagtgtctgtatatttaaacatatgtcaacatagaaagctacagaaaaataaagtattataatctcatgggaccactgccatatatggggcccatcattgaataaaatgtcattatttggtgcatgtatttgaaaccgtgcatcttaaactattacacttacttttctcctgagtagcatgctttagataaacctctaagtaatagttcctctagtttcttcagaaacataaacacacatgcagaattttagtagaaaaaaagatgctctactttattacaagaaaaggtatgtttgtgtgatttgagacttttacaatatctgcttaggttgtgtaggggaggccctaaaatataccttttcatcctttccttatgaatcaatccatcatagcggtttacctaatccatttttattaaatattgtttatcacttctgtactgctatctatccaacatctttcattctgattggcttagccttaagaaaaaactaacgcatgttaacaggcagtagaaaaattacctctttcatgagctcagtggtctgaaggtgcacgctacatcaggggtggctgatgccaggtggctggcttgcgacacttaggaagtccctcacacctgtcaagggaggcagactgcaagagagaaggcgagtctgactgagcaggcgcgtaagggcaaatcctgctcccaactgctgctagcagagctctaaaaataaagcgacaaaagcacggggaaggcagaatgaattcttaacacttgtactcttctatttctgtctgttacgaagcaggtgatctcagtaccaagcgatgagtcttttaactttctatatccctcactttcagaaatgatcctcatgactgcattcattccagctgtttcaaattcataatcataaaaggaatcttttttaatctttcgagactgccctctctctcataggattacattctaaaataagcttctttgatattcatttgcctatttcactttgaagatattttttcacatgtattattctggaaaacaaaatgtttattcctttaatactttatatattctttgagagaagcaagagttttaaaagccattcctttatctagagagtgtcttccaggtaacaatcactagcctagagaaagtgaaagtatgaacttgttagcaacatcttttaatggccctccaagtaaggccatatttattataaatgttattttaaataatctggtgcctgagcagctctgcgtgagaggggaatgcaatgtagtggttgagagaaagtttgaaatcagatagacctgagttatagccctgccccactattactgtctatatagtccagaacaggtgatttattaactgctcaatacttcagtgtcttcatttataaaaacgaaaataacatatttccctgttttatagaattgagaccagaattaaataatataagcaaaacactaccatactgcttggtatctagtactcaatagatgacaccaattattattattgctaacaacaaattgttaaccaaataaacagctgatgattcaaaagataaagaagtaatattatttaaaatatattgctgacattttaaaataagcacctatatgtacatccaagaatctaaaacctcaaagcctattctccatacaggtatgcggacaccttgcctcttcccattctttctggtatatggagcagaagaactagaagtagaaaatatcttggggaatttttcctgagtagcagtcttcactggagacacttctgcattttaaggcatttctcgcaataggcatgcacaggacatgtctaaatttgctgagaagtaaaaaaaaaattcacagcaattcagagtacctcaggatgttaaactccttacctcaagccaaacgaaaactaaatctcacacacacacacacacacacacacacacactccccattatctggatttgcaaatccccaaaaaaccctctttcatagttaatcattaccactttacctaaatctcaaatggtgctgctgagctgccatccacataggtgtcaccaaacacatgacaagtcatttttaaatataaactttgatcaagacaccaggcctgtatatatacttcaaaacatcaggtacataataaatatatacaatgttatctgtgcattaaaaacacaaaaaacaggccatatctcacatgtatttgtatctagacactttgatcagtcttccaaaaactgttcagggcttcacttacatatttgtaactgtgttcaaagctatcagtgcttgtaacttttttttttttttttttttgagacacagccttgctttgtcacccaggctggagtgcaaagacacaacctcagctcactgcaacctttgcctccagggttcaagcgattctcctccttcagactcccgagtagctgagattacaggcacgggccactagcccatctaattttttgtatgtttagtagagatgcggtttcagcatgctggtcaggctggtctcgaactcctgacctcaagtaatctgcccgcctcagcctcccaaagttctgggattacaggcgtgagccactgtgcccggcctagtgcttgtaactatttaaaccatttcctctgatttggttctcaaagaatgtggaaatcatttgttagtctcttggtaactgctcagtttatttctgaaagatataccaagaattgatgattttctaatcagaaaatatcacgatctgatcagaaaatcatcaattcttggtctaagtggtgaaaattatgcagaaatctatgttaaaaagtacttgatattcaaaaagtctatttagagtgaacattatacatctcccttgaaattatcaaaacattttgttaaattcagaattaattcagaattaataacagaaacatttcccgttatttttctcaaatgacaaaaggagaaagctctaaagtgtttataagccattcaaataagcattaacagtttgttaaaagtatttagtttgctaaattctcttaactgtaataatttaatcttaaaaattagagaagtactattatttgaattagtcccatatctatatattatttctatgttttcatgtcgaacagattttgataagactacctcagtatttctcatataacatctccaagtagttcgtaattgaacatttcttagtcaatcgcttttaatcttttatattttgtctgaggaacaatttttatatctgtgcaaaagaaacttcatattaatttattaatttttcatctctaatatttaacatttacccaaggaaaatgggttatcagcaagtttatttctactcatgccctggtttctctgccaaagaattgttgtgtctgcattttcaggccagggctgtgaagtgcctcttcagagtcttcccacctctgcctggctgcagagcttcactctcatgacccacatctccctggggagccccaggacaatggctgacattgggtttggctctcaagccccatcattccttaggaaaataaatggacttgttctattattcatacttggcagaaaaacatttgttgagatattaccattctttcccaaacagctccattataaacaatgagtcttaattgcagtcaaatcctttgtaaagacaaagtaatttaggaaaaatataaagcttttaaggtggtagatgtaaatacttaatgtgttaattattgttaaaatgagcctataagtgatctaagaaacaatcttgttctattggctttgtttcttcagagactaaatactgcttgaactatgatgggaaatgcttattaaattatttgattaatatatacacacatatatactcactaatacagaatgtaatatatatataaaatgaaaatataccatgaattattttattaatgatatactatcctgaataaaagtttaactaatgaagtactagaataataatctgagatgtaataataatacagtcaaaattttatttagttggtcaacaaataaacctggaggctatttatgtagcaaaatcatagcatgcaattactggtgtctgcacttcatcacttctaatgatgtccaaacttcatttcaattacaagatgagctcagaaaaagcagtcctcaagcagcccattcaccaacctaaaggcaagattaatggtataaattccaagatgatggcttactgaaaaagatgaatagcctgatatcacatgtaaacattgtgctctacagtcttcaaagtattcacatatacattgcctcatttgaaagtcacaacaacacatggtgctagagaagagagtgaatttgaatgcattttactgatgaggaatagagactcagagatgtttattgctgtacccaaggacccctggctagtatgaaatgccacaatcacatctgaccccacacacatattacagaagtggttaaggaaacatgaaacaaacgtggcgaaagaaataaatagtgggaagacctactaaacctaactatggacaataatctattgcatactaatttgtgggaagcaagagcagcagtgagtattaaaagcatgtatagagcattccatccagggaggccagggtaaacatagtgtcaagtcctgaaagagaaggcacaccacattgattcaggctacaagtgattctgatccattcgaaggaggtgtatgtgtccagaatgtttattgtaaaaatatcttcttcaagaagttgaacttaacactcaacagccagcactaacagctcaaagtgagcctggactttgattctacatgtccatacaccctagaagtggacacctccgtaaaattgactgtttagtgcactggttatagctactcattcatacttataatcacatcattatcattctgacaatgcacatattaacaaattcatattatcttaacttaaaatgtcccaaaatagaaggaactattctcacattaccttatttaggggaagaagaaaaacaactttctaaattagctcccttttttattaaacaagtctttaaaagcctaacgtttctctttatttcttgggaaatctgtctgacaagaattatcctattcacccattacacattttccaaacctggagcagatcccctgtggttgcaccacagaagagtacaggaagacacatcagatacaaatctctttgtccaagaatgctagaaaaaatccctaggcatgaagtctgcaagttgcataaaaatacctgaaaatggcctggcatggtggctcacatctgtaatcccagcactttgggaggccgagatgggcggatcacctgaggtcaggagttccagaccagcctggccaacatgatgaaaccccgtctctactaaaaacacaaaaattagctgggcatggtggtgggtgcctgtggtccctgctacttgggaggctggggcaggagaatcacttgaacccaggaggcattgcaatgagctgagatcacgccactgcactctagcctgggcgacaagagtgaaactccatctaaaaaaaaacaaaaaaaaaccctgaaattttggtctgtaggacctaataaacaggcaacattgcatgtattctcgctctggtcaggtaggttatgtatgactcttacccagtcataggctgtgtgccacataagactttgaattttgtctttagcttaatgcactgcatcttttttttttctttaatcaggcttactgctttagatttagattaatcttaatttaattaatgtatattttcttataagagaaaaaaatgcccagaagaaaagcaagatggatgaatcagtgtgtgtagatcagtatgtgtacacatagccagtaaaagatcatattttggaatccaaacacaggaaagattgaatactaaataaaggaattattttagaattcctttagaattacaggtgtgaggtggctcacacctgtaatcccagctctttgggaggccaagacgggtggattgcttgaggtcaagaattcaagaccagtctgaccaacatggtgaaacctcatctctactaaaaatacaaaaattagctggtcgtgatggcgggcacctgtaatcccagctactcgggagggtgaagtaggagaatcacttcaacctgggaggcagaggttgcagttagctgagatcgtgccactgcactccaacatgggtaacagcgcgagactctgtctcaaaaaataataataataataataataaagaatttaaaaatctcatttaaaatgtaatcattgtaataattgtggtatatgacagtatgctccaccagtccttaaatgactgaatagtgatgtcatgagcatcccaacagagcagcaaaaagaaggtaatgatgtctggattcgtttgctcaggctaccataacaaactattgtcaaccaggtggcttaaaacaacataaatgtattgtctcagggttcaggacactagaagtctgaaattaaggtgtcggcagggtcatactccctctgagagctctcagggaagatctgttcaagttctctccccttgctactagtaattctttggtgtatggcagcataactccagccttcacatgcactctctatttatagcaatgatcctgtgtacatgtctgtgtccaaattcttcctttttataaggacatgcatcatattgaattaagggcccaccctactctaatatgatctgatcctaactagttacatctgcaaagacccaatttcaaaataaggtcacattctgaagtactgggggttagaaattcaacacaggaattttgggggagcacaagtcaacccatgtgggtactcgacagcagtctcatatgtaatgcctaaattaggattgttcttgatattaacggtttgcataacttggctacttacagctgtttaaaactcttaaactgctattgtggaatataatacatagtaattatcccatttcttaatgcacgtaaaggaaagagtgatccagcatatgaagaggcaagaagtgtttctcagtcattgtggtttattcaagttaatacatctacaatctacatatatgtatagaagttgataaatatatagtttcactacatgttacatatacacattagtaatatataatccaaatttcctaaagatcacaccatatggcagatgtattagtgagatagcctcagcatagggccaccacaaaatctgttgtctgacctgaacagttttgagagtgaaagggcactattaacaattaggctagactacaggcaaaaaccagaggattcacagatctccaggaacaagggaaatttacccctggacatttgactgtacattacataattacacttcctgctttaccaagcactaaatttaacagcttaatttagaaaataatttgaactacccaatttacctgttttaatagcatactcgttatcaggaattaatgaataaaactcactgatgtgacaaaactttagcaaaatgcaaacaccacatcaggattatgagaatcagccagaattggacaccactggccacggaaacatgtatcatgggtcaatttactatgcagattcaactagatatctgcattaaagtaaaaccttagatcagtggttttcaacccagggtgattttgcccctcacatccaacatgacagtaaacaaaggggaagagccgaattcaaataaaatgatagtaggtatagaatacacgtttaccaaatttgtctgtagtaggaaaggtaaaggcaaagatccttctgcccatttataaatattgagtacctataaaaagggggagatcagtgtgtgaaaaatgcattagattttgcatatagtgagaatgtaacatatttacgttttgtaaataaaatgacatacaaaaaaagtattatggagaggacaatattaaaaggagacactaaccacatcaacatgagtctttctagtctttcctaagacaatgtattagactgttctcaagctgctataaagaactgcccaggactgggtaatttataaaggaaagaggtttaattaactcacagttccacagggccaggaggcctcagaaaacttacaatcatggtggaaatggaatcaaacacatccttcttcacatggcagcaggagagagaaatgagtgcccagcaaaggaggaagttccttataaaaccatcaaatctcatgagaacgaactgagtatcattagaataggatgggagaaaccagccccctgattcaattatctccacctggtcccccctaccacaacacatggggattatgggaactacaattcaagatgagatttgggtggggacacagccaaaccatattagacaataagagtagaatgcatctgaaatatttaagagcctcattaatgccaatcaactaaagaagttaaatattgtattatttcttctttgtagaaagaagaaaaagaagcagagatactactttttgatagaataaagcaaaagatattactttttgatagaataaagcaaaaataaataaataaataaagtaacagagattctgggcttccattttccctcatgtaatagcattccctcctcaccaatgtagacagtgaccactgggatttctgtttctataatacaccactttgtggtgtcattcttgtaagtgcactgtcctataagacaacaagcattatccatttacagaaaaagtagaccaacagaaacacctggtattcttttcatactcaccaagatgtttttggtgtatcagagttcaggccagccctataaaatttcagagccacatataagactaaacattaggctgggcacggtggctcacgcctgtaatcccagcactttgggaggccgaggcaggcggatcacgaggtcaggagatcgagatcacggtgaaaccccgtctctactaaaaatacaaaaaaaaaattagctgggcgcggtggcgggcacctgtagtcccagctacttgggaggctgaggcaggagaatggcgtgaacccgagaggcggagcttgcagtgagccgagctcgcgccactgcactccaaccagggtgacagagcaagactccatctcaaaaaaaaaaaaaaagactaaacattacatgcctaaaagtaaagcgtcacactgtcatgagcctgtccccaaagtaattttactgttttggggtctctgtaattgtacctctctgaaaaaagccaagcactttcagccaagaaaaaaaaatcttcattagtttactatgcagctttcccaggtgaaacaaatacccttagcaagagtgtgtgtccatgttaattacagcttgcccacaggccaccctggcaactgtccagccttcctgatatctacaaagcattttatgcactatgcacatgggcaggatagatagcctaatttccgctccagacccagcaggaaagaacagacactagtacctttctgctaaagacatgtttcactgcaaaattttccttcaggaaattcacagatctccaggaacaagggaaatttacccctggacatttgactgtacattacataattacacttcctgctttaccaagcactaaatttaacagcttaatttagaaaataatttgaactacccaatttacctgttttaatagcatattcgttattgggaattaatgaataaaactcactgatgtgacaaaactttagcaaaatgcaaacaccacatcaggattatgagaatcagccagaattggacaccactggccacggaaacatgtatcatgggtcaatttactatgcagattcaactagatatctgcattaaagtaaaaccttagatcagtggttttcaaccccgggtgattttgcccctcaggagacatctgatgatatctggtgacattttttattgtcatgacttgaggagggattgcttactggcatttactatgtagagagaggccaaggacgctgctaaaatcctacattgcacaggacagcgccccccgcccttccacttcaaagaactgtctgatccaaaatgtcaatagtcctgaggttgagaaattctgccttaggttatgtgagaaaaattagtggttttgcattaattgtgtgttaatactatgttccatagatgcattttaatagacattaatagttatgttcagtcaagtttctctgatacgattctcctaccttgtcaaaattatgaattgtcaccaaatactacacaatgaagtacaaacaagttctataaaattaaaataaaatagtctaacattcatcatgctgtgtctgaatttaggagagatgaaggactggtcagaaatataaatgaccagcattcctgatattttcctggcatctacaaaatgcaaaactaaattacatgtaatgttaattgaggattccaaagatcttttaatttccagttttcatgcattaccaactcatgattttttttccacccttaaatatgaaacttgcactgcttttaacctaccacattaccaaggtcagaaacagaaccactctcattgtcagataaaagcatgagaaaagtattcacaaatgtacttaactagacataaggtggaaatccagttctgtctcttataaaatgctaaaaatcttctctatgatacactttaaaaggaataattgctttaaatgttttgaagtccttgccgcattatttataaacaacaactttgcagagtacttgcctgtgataaatttgtattatgttttacgtggatcaaatttttgaccttcaattcagaatgacaaaaaatagaaaaatcatagcgagcaggaaaaaaaaaaaaataaggccacacctttctctaacattggttgttattatttagtcctttatggataacacataaccatcttttacacttcttcaagtccatatccttcaaaacatctttattcttcttatcctaatgttccatccctcaatctaacacacgggtattcaggtatctacaattttattaaaaagcccttgtgctttattattacaaaatacaacatacagggcagttttttcctgaccatgctcagcttatcagaactactttattatgcaccactgatctctatttaaaatgatgactttgttttataacagaatctaatgttctaaggagacagtttctgatgttagaaaggggaaaacctcaggaagcattctttcaaaacctgctccatgactttatgccaagacattggtaagcaaactttcagaagcagatatcccagaagctcctcttctgaaacagtgtttgacagtagcaatcacaagtcagaacagaactacgaaataattaccttttaaaaaatacagtctgcatttaaatggtctacacagcagagatttatctgtgctaataaactctctttaaaatgacatcactaggaagattctgcttatccaatggtttgagacagaagggttcctttgaattttagaggggagagggctcaaatcatgggtgatacataaaaacaagaatttgaatttgatcaatcaaggaagagcgtttgggcactgatactccaaaaaagaataaacatcatgggagaagggcagggaaagagaggcagatgaatacaaagccacatttcatcacagttgatgattgcctcctgcactatgaagaatgcttatatccctttcaaggtgcttacctccatacagggcttgctcagaactcatcagaccacagatgcgccttaattcaccatctcattgcaaatgaggatggtcagggaagataaagagaaacacacagaatcttatttcaggactatctgaagtctacagaatgatcttacagataatttggaatcaacaattctggtctccaaaaatttcccatgatgcaataaatgttttggtggtttcatccatttatattccttaaacatacttcgtcttttattccatggatccttgagaaaaggcctaaccatcccctaagtgaagctgttcacaaagaagagaatacttaatttttaaatgtgaggtttatgaggcaacatctggctttaaatgcccatcccatatttttacccaaatggcaaataaagtaattaaaatattcatgtttaagggtcatcttgccaagatacattaaatgatgtgcacataaaatgtaataataattaatatcttactgcaataattaactataatggtcaccaaggtgttggacaatttctattggtaagatttcagcagctatctcttagaatcatggcctctgaattctctttcttgaagattttcatccttgatgaataacctccatgatgttatttataaggaaatttatcaataacgtatttgttgtgagctttatccagaaaatcacttaaaagggaaaagctactctaggaagtttagcaagagtatgtctagcactatttatattggtattcttcttgacctgacattgtaactattatctgggagatgcagcatctttgtaaaaagatctagttcaattcaattcgttttaagtgacctactggaaagcagaataaggacccctcaagagagtcttgaaacacataactctgattttctaggaaactagtttatctcaacagtctggaaaaactccatagaagttcttgagacagctgttccggaagaagtgtatagtgacagatataatgtagtaaggactgcatggaaaggcatttaaaaaaatagataaccttgtactagtcttttgatataatttatgccttggtttcattaggtaaaatcctacgtgcaacacagaacatcattggcaacaggctgtcagaaaaatctccaatagaacagaaaataagcaaaagatgctttgtcaagaaaaaaaaaaaatttccatgcattttaattccagtgtgcacagatgcctggaaagaaactaaggtccacaaaatgaaaaagctctgcaattctcactatttgctaactgaacatctgaaccaaacttaaatgacacactccattccttgaaaacttttaattgccttttgcaagaatatattgtttaattctggatgtgtttcaatacagggagaattatttatacttttgtactttcgcagacactctgagatctgagttatcaatggagacttttatatagcctcagccccataggccaaatatattttaaacagatatatatatatacatatatatacactttctttaacgtagagagaactcaacctgccccaggcatgcattaatgtttttatcttcattcttggaaataaaatctttgtggattaacaattttacatacatctgcttcttgactatatacaaataatctcagaagccatcaaaagggaatagctaccttcagattagctgatttactgaaactatgaacaaagagtatgcagtcctccttttcactgcagtatcaaaatagttggtttgctgaaagcaagtgtttgaattcatggcaaatagtaaatgttctaaagagaacacattaaaagccaaatttgcttatgagcaacaaaattctggcaaggaactacagagcttgtagttcctcgtcaaatagcaggcttccttcaaaccaaagcattacgattactttgaggaaaaggccattgcgatccatagctaaaatagaaagtaagtgttaaagtagagcctatcactttcatgtaaaatcatttaatgtgaaaatcttctattgtagtttttgtaacgccattttcaaactgaaaacggtaatttagttatgtcctaaatactcaaagtaaactagagctattcagattatgctactctgaggctgctaatctgggaactgtgtctaccagtccacaagaaaagtgcacaaactgggagtgtttacacacttttaaaacagtttggaaagagtaattttatggctgtggaatttaagtaaaagaaggtttataatatgtatatctttttaaatttcatttttctattaattgattttcattccatttcacaaaaatatacctttgcaatggatataaaatttacaaaataaataaatcagccctacccctttagcacagttagtgtgaaaagcactaaattagacacttactctgaccagtgttccctggtgctagcaaattaattattgctagacttataacaagaaaaatcctgaacaaatcagacaaccagcagcactctgaaaataaaatgacttaggacatgcacaggctgagcagggaagcacctgtatggagtatatgaaggacctactttttaaaggaaatttactgagcacccagtacataagcagtattaaaaagcacgtcatcgttatttttttctttgaaaaacagaactcatagctattcacctaaatctactcactgaaatgaagaaatcattaatactttataactggggcgttagaggacattaccattacatactgattcaaatgaaaaatcagatgttgtttaggactgtagagtattggctagtttatgcaggcaaataaatggatatttttcaggaaagacccaagtataaaccttaatttggaaggatcataatcctttacatttcaaaagaattgttttataatttttctacatatttattgacaataatggtataaattggcttaaaccatagcaaagagaattcttctttgcagaaagtgaaaagttcagctaactaatgatgacagcacccttaatgactagttaatgagctactggagtttactttccttataggatggatcagaactaatgtgacccaacacagtttgcctgaaggcaaaagagtgatgggtcatctgatgcttcacagcatttcccaaatctgtgagcacgtaaagtaggaaagaaatgagcattcacatcttttagtttttggtgtatttgtgattgctgtctaatataacacttgtggtaggcaggattctgagatgattctcataattcccactcctgcagaacccattctccttgagtgtgagtggggaccatgatatgaagggatgtcactcccttaattatgtgacgttatgtggtaaaggtaacacgattctgcagatggaattccgatctcacatcacttgattttcaatgaatcaaaaaagggagtataatgaatgatctaacttaatcagctgaatgcccttcaaaggggtattgagccccctttctgaatgaagagagtttccctctagtctacaagaaataaactgccatgttgtaagaggacctttaatagggcctcaacaaccacacgattttgaaagaggagcaggaagtagccccatacgggaatgcagtccaggcaacaccttactgcagccttgtgagactgaacaaggggccaccacgactcctcagcattgaaactgttagataataaatgtatattgttttaaaccattcagtttgtggcagtatgctacacagaatagaaaataccaaaccaaaataaataaataaataaatttacattaccaaattttaaacatgagattcaatttttttttttttttttaagagacagagtcttgctctgttgccgaggctggagtgcggctgctggatcatagctcactgcagccccaacgttcaggctcaagtgatcctctcacccgcatagctgggactaataggtgcatgccagcacacccagacaattatttaattttcagtaaagggaggtctcaaactcatcctcccgcctcagcctcccaaattgctgggattacaagtgtgagccaccgcgcccaacccaggattcattttatctttgcataaaatgcctttatgaaaattctgtttggggctgggcgtggtggctcactcctgtaatccctgcaatttgggaggctgaggcaggtggatcacctgaggtcgggagttcaaaaccagcctagccaagatggcgaaaccccgtctcttactaaaaatacaaaaattagccgagcatggtggcacatgcctgtaatcccagctagtagggaggctgaggcacgagaatccactcaaacctgggaggcggaggctgcaatgagccaagattgcaccactgcactccagcctgggtgacagagcgagactctgcttcaaaaatatataaataaataaataaataaataaataaataaataaataaatacataaattctatttggtttgtttagattcactgaaccttaaattagtcatcagtctttgatttcctctgtataatctgattcacatcttttttgtatccacgttgaggatctaacatgtatttctaactcttctcatttattcatgcctctacactaggaggaaaactcatcaactggcacaataaacggccgcacataaaagactgcacacacccctcttctatactttaaaatgccttatgagctcagatacaaattcttgaaaaattagaattgatactttaaacagcataatgtaattgatttttacttttctgaaaatatttcataatatacatttattactcaaggtaaaccatgatgatatgtgtgttgctcatcttagcaggaaaaaaaagtgccattctatattacaagtagtatggtaattattgcttatgtatctttaacgttacaattttccgtttgcaaagattactagaactaatattgtcaagggagaacacctagggcctctttcacagaactaaaatcatcagggacaatgggccactaaaattatttttctgcacacaaggccaatttttctgaaaggtcaatgacttcattatatactacaatatacccccctacccttattcaaggttttgctctctctctttctggggtttcagttacccgcagtcgaccaaagtccaaaagtgctacagaattagagagggagagagaccacctccacacaacttttattacagtgtattgttataactgttccattttattagttgttttaatcacctttctgtgcctaatttataaactgtatcataggtaatgtatacataggcaaaaacatagtatatatttttaatcagtaatatacgcagtttcaggcatccactggggggtctggaaatgtgtccctagtggataagggggaacttatctgtacttgataagtccttcaatcagatacaaaaagaagcttggtgccatactatgccttagcacaatttggatggtagcaaaatgtttaaaagagaggaaaacatcaaacttcatgatttttgctttcagaaaggagaaacttaaaacagtgggaaaataaacttttcaggagcataaccacaagcatgggagtgctcaagtaccaagaaagatctaatttatggtcaatagatacatgaatgacaattctgtaacaactaaaaccaagtttttaagaaataggaggtgagcaattatgtgttggatagtgctaaagccagaaattcttccttacaagatgttacgaaggtaggtcttacatctagttaatggtggaagcaaacaggaacccatgtcacctgattagactgttatcctgcttctaatcagagtatatttgttcagtgctttctacatgcagtgttttacatgaatatttttaatccttacaagaaccctatgaagttttatcaatgggaaggttgacttgttcaagttacccagctagttgtagagctgagctttgaatctgcacttttaaccaaccatgcaagttccatgaaataattaaactctgatgttcaaaagcatcaattttttaatgcaatgacttctcttctatgccattaatatggtactagttatgaaccattttgaggagaattaaaaagtcactcaaatgaatatctgtcctctgtttcagatgaggaaacctgattagaaaggcagcaacccaaggccagatgcaatggctcacgcctgtattcccagcactttgggaggctgaagcaggaggatcacctgaggtcaggagtttgagacgagcctggccaacatagtgagataccaagactccgtctctccaaaatatttttttaaaactagctaggcatggacaacagagcaagatcttgtctttaaaaaaataaaaaataaataaaaaaaaaacaaacaaaaaacagaaaggctgcaaccacaccatatatgatcactttttagaattgtaattacttgatagtcacatacaagaatgaagctttaatgatattcagcatagatccaacatctaaatccatttaaattataggagacctgtgtaacttgacaggaatctgtactgatttagtgaacagaaaggatatggagcaaacagccatcttcagcttcagacaaaagccatgacacaagcataaaaaatcttaaacataacctcaggacgataagcaaggaaccatctgttgcattttatttatttattttatgacttggacctccctttcccactcccattccagagattttcccctagtgttctaatcagataaatgtgaaaagcataagagaaaacagtagtctttactaatctccatagatgcctccaggagtagattagaaaatcaagaaaaatgtctagttctcatggctccacattagaatcagaaaagatgaaagaactaacacttttcaccctttgctcaataaattcagtggaatatacatagacaagtacttgatggcctctcatttaagccttaccatttcccctaaaaggtccggtatgtgatactcttttacagaatatgaaatgaaactgaaagaaaattaactttccaagatcacacaggctataccagaagcagggttcaaccttgggattctctgactcaaaatcctgaatattcccaccataccagattgcctaccttgagtcctctgaactaccatagcatagactcatatggttctggctttacttaagtatctatcaacttagcaatttttgggagttagtagagcaatacagaaccactgtgggtttgaagatgtgaaagagtaggatcacaggattccgactggacaaaaaagtaaaataatcagcagttatatatcacatccactttgatgtttcagttactcctaataaatttacaatcttttccatggatgatggcatttctggatactacaaagcattttcaggttttataatgttttctaaatgtatatattctatgtacatgtagcatatctgaatctgcatgtatattttcttcatatcttataactttcacttgatataaatcattataatatatatttgatgtttattgtgtaatgtgtattatatgtatgcacacatcatataaatatgtacatatctgtgtatgtgactgatgtatgtgtttctctgcaattagggtagatatatagaggcaacagaaggaagaaggaaaaaaaaatcgattctgagtagcctgctgaccccaggttttggctccctgtgcatattacaagaatagagtccaggagccaatttacttcacatgtggaaaaacccaaaagcggtaggaccaaatccaagacttgcaaccttcaaatggctcctctgtcacagtcatgtacagccgggactcagctggcctttagatgccacacagacaggttgtgtcacatctgataagttaaggagatgaatgacctcatataattatcacgcatgatttggtctgtgatgagttaccattcccctatgtttattcattaccatcgagcaaaaatataaattttaaacaattactcaccaatagaccttgacacccatgtatcaatcctctgggaactaagctacccattcacaataaaattttgcctcataaaaattaatgccaatttctacacttatatcgacaggaaaatcaggtgtttggactgacagccaagcagctaatatgtttaatttagagcagtctgcacagcctccattgtgcccatcttcctgaggcttcatatggcccatttgtttaagtcccccaacatttttgcagatgtaaatttaagtcaattctaataaaatgtcatgacaaagacagggtggtatttttaaagtgacaaacttcataaaaattttacacattcttttctatggcaaatgtcaaaatgactgctataaaaaggccatgttggctgggcgcagtggctcacacctgtagtaatcctaacactttgggaagccgaggcaggcagatcacctgaggtcaggagcccgagaccagcctggccaatatggtgaaccccgtctctactcagaatataaaaaaattagccaggcatggtggttggcacctgtaatcccagctactcaggaggctgaggcaggagaattgcttgaacccaggaggcggaggttgcagtgagctaagatcaggcagttgcactccagcctgggtgatagagacagactccatctcaaaaaaaaaaaaaaaccagattcctggcattgaaagcttgctgcttcaatggttatcatcaagttgtaatcattaatcattagtcatggtattaatgtattggttaatctaaaacatcttttatccataaatcaactccaaatttgcaccagaaattttatttcagtgtttgatttctaccaacaagagaacagtgtttatgagaggctcaactccatttatattgcaaagtgaagggctggagttagatgagtgtaactaaccatcagctggatgagtcaagtaaacgctggcctttttcagtacgctcttggcagatttttgccaacttctgtattggttgcgaaaaacgcaactggtcttgattttactatcctgcacttgctcaatttgtagggtagtctggaatcatttctataaacatcctggatagattgcattattaactttcagatattctgttttggggctaaaaactcacatctttgacaatgagaggatattggtggtaaagctatgacttttaaaaatagattcactctctgtggcacagttctcctacaacaggtgctgactgaaatgtcacaacaaagcacatcaaatgctttgtggttctgctttcttcacggtctcttttaggacactggttttgtccttaacctagggatggaacagttcacccaccctattccacttacactccaccgcatctctttccctttcccttttatgatgaaagactgcacaggttttaggaggagacatttttaagacctgctaagcatccctttttccattcattttaagtttttctcatggcccaaatggttatatattagcacaataatctagctcactaatccatagtcatcaattcgtgatctcttaaaggcagaaaaaccacataaggcacacataatgaagcctggctattaaacagtccttcaaagttccccacgcattctttcatttaatcctcacgataacattggatgcaggaagcaaaaatactatctttgttctacagatggagaaatcaaggctgagagttagttatgttctactttacatgactcctctctctcaatcttattgctggaatatgcagccaggcgagataatagatgctaagacctcaaagcttctgcaaagggcagcaaagttcagcaggtaagtgtaggaatctagaattgagctgcttgagatcaaatctgaactcctaaggaaattcaaaaaagttcttcataccctaaacttgttcccgcatttacaaaacaaagataataataatacttatctccgaggattgccttgaaggttagatggattaaaaaacatgaggccaggcgcagtggctcacgcctgtaaccccagcactttggaggttgaggtgggtggattactgaggtcaggtgttggagaccagcctggccaacatggtgaaaccctatctctactaaaaatacaaaaattagccgggcatggtggcacgcacctgtaatcccagctactagggaggctgaggcaggagaatcacttgaacccaggaggtggaggttgcagtgagccgagatcacgccactccactccagcctgggcaacagaacaagactctgtcttaaaaaaaaaaaaaaaaaaaaattggagagtactaattaatagtgcctggcatacagaaggagctcaaaaatgtcagaaaacaatattattgtaattgaagaatgattgttagtaattattactgttcagacactgcaggtggagacaccaaaattagttcaaactgtgaatatctatgggagagaaaaaagagcaaagtcacaaaagggaaataaatagcccaccctaactcttcttatctcttgccacaaaccgcaagcatggtttttccacactgcaatggtaccaatgagatgaagactgattcttagatccactggcatttgcaatcctaaccattcattcattcatcttggaaactcaggaactgccgtgatggcaagtgccagtaatttccagaccttcaagagacctgggatgcctcagtgaggtttaaccaaggatatgctttgcagggatattctgtcagttttttgtttgtttatttgtttagagatgagcctatgttgcccaggcaagatttgaactcctgggctcaagcgatcttcctgcctcagcctccccaacagctgagcctacaagcgagccctcgcccaaattccagtggttttttaatcttctagagtttactgttttcttttcttgacaaggatctgtttcgaccaaaacttctcccttctactgggggcaggaagcaccaatagagtggggcagtaaaccactactatctgcttaaaattaatgaataagtaatgctcaattgccaaaggaaagaactatttgttcttttatctgtttctttttcaatgatattactggaagatctttctaccacaagcaccacacacttaaaatctaatgacatcggctgggtgtcgcggctcacgcctgtaatcctagcactttgggaggccaaggcaggtggattgcttgaggtcaggagttcgagaccagcctgaccaatatggtgaagccccatctctactaaatatacaaaaaagttagccgggtgtggtggcgtgcgcctgtagtcccagctactcaggaggctgagacaaaaaaatcacttgaagccggaaggcagagattgcagtgagctgagatcacaccactgcactccagcctgagtgacacagtgagactccatctcaaaaaaaaaaaaaaattctaacgacatgttataaaactacatgaatctttaagatgataatctctcctaggaaagaagtaaatgaaaaataaagacaagtgagaaccaaatgttgctgtgtccaaaggtaatatagtggcaaactggagtcttgttactaccactgaaagaaaaactctagtccattcctctcaaaatttgaatattactaatgtgtatgtattacatttctgaattatgtcattccttcttgagaatggaatatgtaatttaaatcattcctctaaaaacatctccagtaaattaaaattatatctatcctgtattccaaccatctgctttaattctcaaggctgtttcatatttcaaaagttactttgtaagacattgtgtttagtcttgatcccttcctcacctgcctctatcagaacattcatccatcaatcatggcatctcattgctttcatctctctgacatttggtcttctccctctgagatactggaatctcccttctggtaacactatttagttgtctgtacagccttccacaccttccccacccttctcaccagagcctttttctgagaatcggctcttcccctatccagggtaatagcaactggccttttaccatgtaatacctcctaagaagactggaccagatatggtgaactaacccaagctcaggcaaccagagtctcttttccaaatcccatctcctggtcacaattaaatggactgtaagtggccatctggcccacattcagactgtcaacacatcttctttgggaggttatctttaggactagaattctacactcaagctggttcaaggcttcaaaggagaaagcataatccctcgcaaccattcaacaccatgagcactggaggcagataatgccaatttatagagaaagagaagaaagaagtgacacaaagaaaagcagaaaatgacttgagagattatcatgatagcagtctcacctttttctgcagttgttggaacatccttgacctgaactcccatgatggatcatccagctccactaccatttaaaaatatttctctttttggtttaagatagtcctatggttttgtacaatctacaatcccaaacggcctaatattaacttactatttattgttttttcttaacttttatttttaagttgaggggtaaaagtggaggtatgtaacataggtaaacttgtgtcataggggtttgttgtacagatgatttcatcagccaggcattaagtctacttaattagttattaattaagtacttaattaagtactcattagttattttttctgatcctctcactcctcccactctccaccctctgaaaggtcccagtgtgtgttgatcccctctatgtgtccacgtgttctcattatgttgttccactttataagtgagaacatgcagtatttggttttctgttcctgtgttagtttgctaaggataatgtcttcctctgaatttactctattatctctcactttcctcatgtcaccgaattcctggaagaaacaatctgcacttgtctccatattctcaacttgaccaactcctcaagccactgaaaccatgcttctgtccctgacacgctacttagacttctttctttcatcagtggcctgatgacttcctttaaggggtcatctagtttgacctctccacaaaatgaaactgtaaatcaaggcccttcttttgaaactcagtgtctatcttagtagattatagataaatatgagttaaataaatgaaaaaaatccttcttctgccttcaaaagtattgctctctgaatttgtctccaaactctcttcagatactttttttttttttttttttttttgagacggagtctcactctgtcacccaggctggaatgcagtggcacaatcttggctcactgcaacatccgcctcccgggttcaagtgattcccctgcctcagcctcctcagcagctgggactacaggcgcatgccatcacacccggctaattttttgtatttttagtagagatggggtttcaccgtgttagccaggattgtctcgatctctcctgacctcatgatctgcccacctcggcctcccaaagtgctgggattacaggtgtgagccaccatgcccggcccagatacatatttctaagggcctaacagacatctaaaagacactgcaaactccaaatgtccaacgatcaacctactcccactctcacaacatcaacctgcattcctcctgtgttctctagcctacaaaatttaatgacacatgatctacatgttagagatctaaaagtcatctccaattcttcttcctttcctgattccccaaatctcacaaccaccaagtcctgaaattgtacttctacttcatacctgcttcaccttctcactgccactaatctttttgaaacctcgggcatcatctctggttcagtgaatgctgcaatggtatactaactagtctcattgcctctgcctaatatactggcccgccttaatccatcttctacatattatgattcaaacctattactttttttttttaatttaaaaatctcaacagcaacacaggatagaagaccaaatttgtgttggtacaccaaacagggctattgcaaatgtcgatgtaatatgagcactgctcatcccctccttgggtcaggatgcaagaaatttataaccagacttaagccaatagctaccaacatcacttccaattgacaagtccaatgcctaacaaagaacagaccacgtttctttagaccatgccccttcagtatgcaatgtactttttccttggtcatgctctgatgtatcccagtgttccatagtcagcttggagttgctaatgttttccttagggactctcttccctcagtttgtattctcaacatgtagctcagcgcagtacgtaatttgcactgaataataatcatcatcacgttaattgttgaattaaattatatttggtgttaaaaaatatttgaaacaagaaatatttaaaaaggcaatataaattaaaacaacttcaaaaataaaatgtactatttatttagaagcctagttttaagtatactacctagaaggctgcttacctgcaagttatttctttcttgtaatctaatgaaaaaaattttctaacagaatttctttcttgttgattagcacttaagctcttaattaaatgttatactagtgtttcttatccaataaaccatttcccagaatttcataaaaactaagaatttttaagtacttatgttctgagatctagataattttattgtctttggtctctaaggtgaatttccaaatgtgaatatttaagtctctaaaaatgattattatgtttaggaagcagcatttccaatataaccaagctcatatgggaaatgaagaaaacagaagcattaagaaaaataaccaactgctacctttagtatctttaatgtaattttgcacctcataaatctgagggctcttctctctgccccacttacacatccatcactcctcagagtattttcaccacaatgcctgttgctcactttttaaaaacaagagatttttgcagtctgcctgagcccatttatttcattgcaccatccctcttgtaactctcaaaatatggcattattaatatttaaccatcccttcacatagtttgacagtatgcaccttagaaaaattttattagctctttcccctcttttccctaattatccctaaggtattgggcaaatatcaaaagaaacaattctctagacttgcttgacaactttggtatgtgttgattacatattacaggtttatctgtatatcaaaatccctcaacaatttctcttagagagaaatgtctggtgataacaggaaatctgaaacagggagcacagattgaagtgaaaaggacctgaaattgaggtctgatcatgggtaacttaagagaaacacattttaaaatttttcatttgatttgatgttatatacaaataataatgttatggttaatagtaattatatgcatgtgtatgaaagagagagaaaccagaatttattatttgaataaaataacattggaattgctttccatcatttgccagaagaccaccatagcgtatttttaattacacagaaaaaaagagcttcaaatagacagtaagattatccccaaatctgaagcatttaaaatggccagcaccattattttctactgccaccagttcaagtttttcttccatttatgatacagaattttaaatgtatcctaattttttaaatccacagagcatatggttaaaaaaaatcagcagaagcaaatgttaaaataacatttagccagaaatatcccacattcatattcaaagagaacttcaaatattgctttatatataacagcctaattctgaattattgaaattaactataaaaagtgtgccggtttgttgaggccacaaagtcaatcttttcctcgttcataacctgtacaaacaagtggcaaaatataaaggagcaatgaccgctttctttactcatttttaaaaactgctaagagtagctgattctatgtactgaattactacaaaagatgtaaagcctacaaagaagggatatttaagagcttatattttacaaataaaaattttaaacctgtgcacatttgccttcattcctaaaatatcacaccaccaaatatgtttaattctaaatttcaaagtatatcttatctaaatgaaagaaataaaactgcttagtatgtaaagaacttttaataggtgccaacatttcaaatggtatagtttctttctcacacttgtttaaaagacagcaaaactgtctttagaatcacttttttaattacttgtcaattatgttagtaacccgtctctataggacttgagcattttcaggctgcttgtgtatgcaatatctcatttaattgtcttggcaaatcattcttaaatgctggtgttattaagttagatttaatccctgaaaacagttgtggactgacagaagacctaaggtatgcacacttgttaataaacttaccttactgaggtttttctactctgtcaatccacttaaagttttaaaaatatgtatggacatacacacgtatatatgtgtatttgcatatacataaaatactatctattaaatagaatactatatagtgacacaaactaggaaagttatctaattatacgatgttaatattttggactctcaaggaaaaggtagtaacatagtattttttcacaaagtgctgccacttttacttaattgacattgaggtcaattgcctttttctttcaactctgtaaacaacactacgcaatcgtttacatgtttcagtgcacatacaaaaaaatgaatcctgtgtaagctacatggttggccatcacagcccattcctagtttactggaaagcaactgtatgaaagccttgggaacagtcgtggtactgctcacagatagttcatgaaaagaaagactggttgacacagttagtgacacagtgcttgatgcacactgtaagccttaagtaaatgtggaggcgatataatagaacaaagtttgttccccatggaaagcagctgacctgctttttgaaacactaccacagacagctcttttaatagaaataatggaccgttgtcattttaataacaataaaatgttacttttttgaaatactgaaattctgatttttttcccaaaatgttatgtatacttacgttagaaatgcttatgtccatacatataagacattaaatgagatcaacaaattgcatgatttgcctaagatatgtttcattttacccatttaaatctccaatttaaagttataaatagcttgaagacatgtgctaggaaattcttggaaacttgcatctatattgagaaatagggaaatcaagagaaaccttaagaggtgctttatataatgatactccagagaatatgtaaattatatagtttgttatgagcactattgtaaaaattatttgtaaaatttctcaatgcattattgtttatgaatatatactcctatatatactaaattttagcacaataataatttccatatgttatgtttttgtaaaaatttactatgtgtaaaccctagaaagaagagtattttattgttagttttatcaatgttggagaaataacagaaagatgtctacacagtcagtttgttgtgaagaaaacaactgtaaagctcttatctattgtcaaaatgaaccacctactttatattcaaattttatgtatatttattaaattaaattaatgaaagccatgggagggggagataataaaggcacatttcatttccctttaataaaccataatatgcttagattcttgtattttcttacatttttttcaaaaattatatccatttcagtctgcttaattttcattcaaatgccaatccaaatagctacacatatagctatgtgtaacattaataaatttaacataatattactacttacgtggaaaaatatatctattgttgcatattttaaaacatacatctgtggaatagtaaatgttatatggttaagccgatgagaacaaaattaaagacttgagaaaagtttattaatgttcactgtttcaggttttattttacatttaatattttatctcataattgatcatatggcacatttccttgtgtatgtaaaatgtaaacagaaactgctgacttcaagtgagaataattatgtcacttataatgcatggaacagatatccattacaatatcctgacatacaaaatttctcctttatagccttaaatacaaatttctctaataacaggaaaaaaaaatatcctaagtaattaaagccaaaagtactatacttctatgagaatttatgcttatttcctgtggatatccacaattcttagttttatatttataccattgtacactttatattaaaatccctgtataccaataggctctcagccaattattgtagactgactggcattttgatgtgactgagataaaagtttgatattaacagttataactatatattttttaattgcatttgtaaatagattctaaaattaaggacaaatttaaattaccattataatactggctatcacacatgtaattctaaatattaaaatagaagtcttttaacatgtgacaagaaattatttctagaaaaacggacaactaccctttttgaaagctacattttaaaaataccaatacgacatgtgcatactatagcataaaaatgatatattttccatttatatatcaaccaatacacattatgtggctgctaccatatcatgtatttatgtttcacaccttagggagacaaacatttccaaaagaaacacctaacccagagaaataatcatatcaaaatttccttgtctgaaaaacatctattttagtgttaactcttagaacaggttaactactactttaatccaaaagaaaatttatattagaatgtatgttaaacaggagagcaaaaaatgaaagaagatacttaactgacacatcatttgttttaccataatagaatttaagcccttcacacaaatgtaaacactctatatttttaaaaaaaaactttgaactactaattctaattgaagtccaactccaattagtgcataattaattttatagtgtgtgatggcatgctcttcctcttcagctgataaaaacttcttacattactttttctgtgaaaaatgaaactggcaaaaaaaaaaacccaaaaatatttactaatgattccgagagaaatttacatacagaagcataataatttgcctttattgacactacagtctttgcactcagtttttataaatttgaaattttcccccaaagatttgagatttgtcctgattaaacagtgcatatgaattcttttctcgaaagaaaagcaaatggcacatctttatgaaaaatattgcattttttaatttcataaagtttattcagaaatctaacatgaagtacaaatgtcaaccatcagttctttcctcagaagacagtgttactaacttttcaaatgaaaaactgaagatgcagaaggcttccaaaaatattgttaagattacctacaggagattgacttcgctccacaaaaccttttattaagtatttcattcattaaataatcaatgtcttatataatttgaaaatatcttgaattttcatcgttaaaaaaaatttcagatccttccaaagaaaagaaattgtgatgtcctacttcccattttaacccactatatatactctttcttgtgtctagtaaatttctgaccatgaaaattgatttacttataattttaggaaagcattattgcagatgttcttcttaacaataaggatttttacattaatattttaccacagtatgttgaggaataaaaggttgtattttgttgtagttttccccaatggtatgatgatgtatcccctcccatgataaaaatattgataaattgtcagttaaaaacaacactgtaaaaatgagtaatcggaacacatttaggaagtgattgttttttaaagagccacttatttatttgacacagaatgcaagcgactcatttgagttctcactttacaggccaagcaacaaacagacttaaaaaattaaatggaagtgtgatgccttaataagagtaaataattctgaagcatccttagggtgattcttactctttttatgtttaaaaatatctgactggaacatcctgccaattaaacgaagatctccagatggcatttacccttttgcttcataacaaaaaggatctgcaatcagttttatggaagattatctaaagaggaacattactgtaactcaatgacaacaaaaattagacactccccttctccgggatagaatgtgcatcctccagattcttgcactgacacctaaggtaataaatacttaaaactgaatcttaaataatagccgcaggatttcaaccgctaaagattcactgttactttccaccaaaaactcctgtattcagcactcagccaacaaaggacagcaagtaattcccagcagcataaataccgggaaagctaccttgggctttgtttttgttatgtaaaatgcattaaagtgactcatccacttaagattacctacctttagaagctttaaagaagctccaagaaccaaaataaatgctttcccagaatgccggataggctattcggtgcattaaaaaatatgtatatatttatatgtgccattgagtttgattctattttgctaagaaaggagagaattattatttttcattcccttcctgtggtgtgactatagctacctataagccctctatttccagaacagcagcgaggtttttaaaagttattttagaaatggtaaaaataaaagaaaatttgtaggagactggaaatagtccctccttcaaagaataggctctattcatttgaagaacagggaccgcgtgtctgccgacacttagatgtttcaaataatgggttggggaggttggatcgcgtggtcccagtacctgcgagccccctgcgtggacagcacgctcggccgcggggagccagcacgcgtctaatcggaaggctgtcaagtgcatccagtaacgtgggataaaacgagtttgggcactacagcaattaaagagcatctccgaggccaagtgcgggggaagtccacgctacctcggcaagcctgaaattacctgtttgtaaattacccaaccaaaacataactttttattgaactgggttgaatcagagcgggtgagctggctggaaacttttttccccagtacggctgcactctgaagtctagagaatcccgttagagacgggctgagacgccgcgagtcgtcggcgggcgcttcccgggacagtcggcccccagtgcccggccccgtggaggcgcccgagacgccggttcgggacgcattccagcggcgagcggcgcgcaccgcctgcccggcgtctccgcatccgagcctggctccccggccgctcgctccccacccccacgggcggaaaagccccgcgactcgggaaccgacccccacccccaactcccgcggcgcccctcggccggcgctccctgcccggcccgccgacttacgtgacggccgaagggaacggctcctccgacgaggggccgatgagcaaagattggaaaagtgtcagagtcaaggccagcaggcagccagcagccatcttcgcgatcgaagatcaatgccccctccctgcccaagcgggggaaggagcggcgctggaaaccgcgggcggaggaagagcagcacacgccgccgggaccgcgggcgtctggagggctggctgcgcccggggcccgaggcgcggagccgcgcgggggacggcaagggcgggagcggacgccgaggaaggggcggtggcgggcggacccactagcgtgcgtcggctgctccgcgccgcggccgccttgcctccgccg

SEQ ID NO: 2435 - DNA, 246837 bp, Homo sapiens
ggcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggccatatcctgccgggcggggccgggcggggccgggcggggaccggggtgggggccggggccggggccatcttcccggtggccgggagggcgcgacctggggaggcgtcgggagacgggcgaggggggtacggagcgccccagggcccctcggagcggcgggtgcgggagcatttccgtgagtgcggcgggcgcggggcggagcccctctgctccggactcgtccctccgcacgccgggtcctggggatcctggtcggtgcacagtgcgcggctagcctggagggcaccgagggcgaagccgcgtccgtgcaggtgcgagcgctgtggggacgcggccgtgcgcgcgcctggctgcaggtgcctgcgtgtgcgggctgagctggagcctggcgctgcgcgtgcgtgcgctcgcgatgcgggctacatgcatgttcacgtgcctgtgtaggtacatgtggctgcgtgtctggagggagcagcgtgcgcctgcgcggggtctccctccagcctcgcctgggggcgctcggccccctcccctcggggccctggagtcgggcggagccgggccggaggcgctgtccgcggtgctgacggccgcccgggtgtgccgaggggctggcggcccagactgcggaggccccgcctcgcggccgcccctagggatgggggcagggagtgagggagaccaggccgcttccgccaggagaggggctccggacccagttgtctcagcccctccggagacggcctagcggtggctgctgcactgggctctgctggcgtcggcctcgtgtttccctccgtgcggcgtctgccggccagtccttaactcacgcactccattcgagtatatgatcctggccaccatcatcgccaactgcatcgtgctggccctggagcagcacctccctgatggggacaaaacgcccatgtccgagcggctggtgagtgcccggctgggcctgagggcagggtggtggggaggccgcgactccactttcctttatggtctgtgcctgagaacagcttcctcgggcagggtcgtctgggcagtgcccctcgcgtctgaaggaaaaggtaggcctggcagataacaccttcctcgagggccagggcagctggggtcaccggcttagccctgggcgtggccacgttagccctgggccagtctgccctgtgccacgagctactcctgcacctcaatggctgtcctggctttcggcgctagactttgatccagaaaaccatgttctaaacttggggtggggaaggggcattcatgtcttcgggaaggtcagctctgaatgccatgtgtgccctgctgggctgagatgggctttggcctggatgtgggaaccctgagcctcatcctccaagttgtcttgtgcgggcctgcttggaacctcttctccagtgggcctcaccatcctgtgggaagcattccttctcaaacattctgaatcatttttacctgtccccagattccagccaagaggcccccgtggtagcccccattggagcatagagtctgtgtgagtcagggtgccagggcaaggtctccgtggctcaacaggaggcaaggtggaaggccagccctgtggggtctctggaggggctgggtcagaggaagggcagcattttggaggtgagcagtttctgaggtcagagcatgtcccccagcccccactcttccctgatgcctggccccatgtctgggttccgagtgtgcctaaagactggagcctccaggtgagcagaaggcagagcaagtgggggcccagggggtgcggggccagaggcgtccaggagacggcctctctggggtgtcaggagctgctccctcttcccttaagcctggcttccgcccccactagcatcctgagacaagagctattcagactttagccctgaaactgaactccctttgaacctgggccaccgcaggcccaggagtgcagaaggggagacagggagcctgtcctggaggtgaggcaccaggaggtgagttatgggtggccgaggtgaggaggtcttaatggagcacagtctggaatgcccagtggtctgggttacggccgggtgaggaggaggagcatggacagcccagccacaccatgaggcaggcgtgagtcatggtccctgtgggggacttgggcaggaccctggtggggcccattgctttctggaggctggagaagagggtgagcttgagaggaaacaggcagagagccttgaatgccaagtcacaggaaggagggcagggccagggtcagagggacgcaggcccaggagccaggccggggcgggggcagggaggatcaagctgtcttgccctgccaggcagtgggtgtccagccttgcaagttcctgcctcgcaggtgtgggagggtttactttgtggtcataggttggggaggacacttctaggagtggcgagctaacctgttgggaaaactgcagaacatgcccgccctgagccagcctagaggtctggggagctcttgaccagtcccagtcccatgtgcaggcccagccattgatgtcccctgggatggaggggaggctgtgctgctgcccacagagcaggccgaggctgggtggtgcaggggcagcccctcagttgtctcccagcctggccctgggcgaggcctccctggttccctgcctctcggggctgtttcccacctccccgtcgactctggagctacctcgagccaggccccagcttgcagtgcaacaccaagctgcctgcacacccatccctcccacctaagccagccttcagccatgggctgggcagggcagagctgtgaggagagggctcgggctgggggctccttcccagctgagggtgctggctggtccttcctaggcgtcgggcctgttctctttttcaccaggaagtttcctgtgaagatctctgtctgctgcggccccactgttcccctggggcagatggtcagcaaccccaccccttgggaaaaggggtccctcctaaacaaatcagaccagaaggctcgaggccaggaagagcatgggcgagtcagcacgggtcatgatggacccttgggtgctggtagcttctaccaggtactgccagccaagccttgggccagctccaccacaggacaggaggagcccaggctgagtaaggtgggagtcagatgcggagagccctcgagagcctggcttcctggggaggaaggcacaggctgtggaactggtggcactcacctcacctggcagctctgtggcagcccagcagctgcttcttcctgtgacttccacagtcctgaagacgaaccctcaggggaggcccttgaagctggtctcctctccccaccccttcacctgcttcctaaggcagcagccctggagtgcaggtgtccgacacccccatgccaaccctgcacatgcagctccctcagcccagcttcccgggcttgccttgcacagggcctttccctgccagccccacgcgtgtgctcacgaggagtctttggggtctccctaagctccacacagccccatctccaccctgtttgctgcttccagctcggcactggtagggcctggctctgctctctcatgtccagtaactgttggctggagctcagcctggggtgcaggaaagggatctttttaggatcagctgtcttcattcctttggctgctctgttccctccacctggatccctttctcaaaatcgagctgtggaagccttgcctgcaggcgccacgccctctgggaggctccctgcggtctgagcccagggtggctcccagcttcaggctcagactgtggctggctgcctccagggtcctcacagatgtggcggtcgtcgctcagcacactcagggctgaggttgtgcttctcatttctgttgttttctgccgagatgtgcatgttctggttacccgggtgcatgttgaatgcataaacggggcctggactgagttcaagaaagcctgagctgtatccaggcaaccttgtgcaggttcccacccagaggctgctgtggcctctgcctggctcctgggcatctctgtgcctctgtctcccacatgttagaatggggatgacctcatggggtattaaagggccaccctagttgataaaggaaaaactacctgataagcacccacaactagtactgttacatcactgtcttccccgaagcaaggcccactgcatggtgctagcagggagattggggccccactgtgacgtgggcagaagctgagatgccagggtgggaggcacgaggggcctgcaggcatgactgggatgttgctgctgtaaacagtggtgtccccattaggggacatgtgcagacagcaagcaggctcagtgatgggaatggctccttggagaatctgcagggtgttgggggcaaggtgaggagggtcagaccctcacgatagctgtggcctgcacatggtggggtggggtcctcaccaaccgtctctgcccgctactacaccgggtaggggccaggggtgaccactgttctgcgcttctcctaggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggtaggcaagctgaggccaggaggcccagcgtgtgaggcccgggcgtgtgctctctgaagctcagttgcgccgtggagctggggcagctgcagtcccctcactggggtcccctcacagccctgctggagatgaacgaatgtgagacagtctgtttgccaccctgtgtgctatgggggtgcttctcccaggggtgccagtgctgtatttctcgctgacggatcacagtgacctgtccccaggaggcgctggcttgcagagcgcacaggccaggggccaccagcttccatggctggcctgagccagcatggtgcctgttggaggtggctttgctgcccaggtgaggggcttcctagcgaggaggagggctggacttctggcctcacccaagcctgtggtctgggaggggcacttggcggtttgaattctgtgcctgcctgagacgctcacctgtggtgtccacctcgctcagagcccttgtgctgcctgggatgaggctgtgtgtgtcgagtgctttcacagttcctagtgccaggaaggtgcttcggcagtttctcctcaaccacttaccctaacaacagcttgtgattgccaaagtaaccagcacatctagaagatggacccaaggggcctggatgggagctcaggtccagtgctctgcaccccaccctccagggtgttaactccccaacctgtgcagtgggcactgtgaggtcccctttcctgcttccctgactggcaggcggaaggctgggctgggctgctgtggctctggtgtggagagtggtggctggggagtgagtgcttggggagttgcccccacagagcctgttagcacttcagtgtcagaggccctgtgctgggccagggaccactgtctgctctttcctgagccttatggttccgaggctcagagcccagatggaagaggagggagcaggccccacagcaggcgagagctctccttccagagccccatcctcacccagtgactgccccaagatgcctggtgcacaggagggtatatggaggggtgtttgggctggtggcagaggaggaaggagatggctgtggagtcctcgagtctggggctcatgccttcaaggttctgtgtgtgtgaggaagaagcagtcggctacatggcctctggtctcttgggtgaggccctcagagggagcctcgcattgcctgcctggatcccggggtgctgcccccatctgctctgcctgctcctgagcctggggctggcccctgctgggtgagagcagcatgtacagaactgggcttgggggtgtcgcatggaaggctcagcccccagagctgtctgggcttgggagtgtcacacagaaggctcagcccccagagctgtctgtgatgtgctgggcacagcagcattgaggtggattctgtgcctttctgcagcacggccctggggtagaatttatggaaggccctgtgggggtctgtggctccacggccctggggtagaatttatggaaggccctgtgggggtctgtggttccgctagcaatgcccgttgggggctggggtgggaggtggctggtggagagtgtggcctctcagaggactgggcgctcccacatccagtgggcactcccagaagcagcccaggagtcatggtagctgtttacccctctctctccctgtggacccaagtccctgaggacaacggtgccttatttttttcaggaggtccctagagcctcacttggagtgggcacccaggaggggcagtgtgcctctgctgaagtaatgaattgttggggtgtaagcagtgctggggggtgcgggccagcgggcagctgggtagaggtggcagcacccggcctcatggggcgctgtccatggtgctgagtgtgtcggcccttgagggccaggagaggaggcaggaggagttgcaccaagccatgggcaggacccctggatctcccagcacacatagactgggtccagggctgctcctccttcccctccccttcttccccctccccctcctcttcccgcctccctcttctgtttctcttcatctctctccctctccctcctctcccctcttccccccccccctcctcccactttgcctgtctagccctttgtctcctctccacgctctctgtctctggccctcttggtgtcttggtgtctctctgcctctccctcttttcttctgcccctctttcccttggcttgggcacgtctctgctcgcctgtgtctgcagcagggcctgggcgttgctggggtggctcccaggttcctctgcctccacacgtcttccctccaggcagcctgggttgtgcagggaaccccgggttggaggtgatctgtgtcccacggggccacatgctggctccaagtcacgggagggagccgctttgctgctctcgtgtggggcacctggggacacgtgaacccctgtgtgcgtatctgtgtgtggagggggctgggtctgctgtgcggcgagtgctggtccatggggagcccagggaggaaccctcacctcacccctgtgagccaagggcctgtgggtagtgggcggtatttctcattagtttgttgtttttaattagagttgatttaattggtgctcagagggttggagggagaggcagacaccctggcctgttgcttggcaaagccttgagcaccctcagaggccagctggggccgctctgctcctgaggctggtgtggagctatggaggaggccctgggtccatgcctcctgctgcctggagaggctctgagcctccgtgttctcacctgggagggaaggcgggcgctctgtccccttgtctccgctttgcttctctcccaggactttggggcaccctttgttagcctgcgtgagtgcgtctgggctgtgggggggctgtagtcggctgtaatgctgccgagctcctgctgccctggggagcagctgtggggcctgggctggggtactgtgaggatcatcagagtgtgcttctgagaaaccctaggcctgtgagggctgctggcagcttcctgctcttgtgtgtgcccagggcctccaggccctcagttcccagccatgctcttgactgggtcagcccatgtgtggccacctggaactcctctgactcgcttgggccggggtgaggtcacagtggctgggtccctgccacaggactctgcctcctttccaggagggctcctggcgcctggccgtctcctgtggtcgtctgagtggatcatttgccaagagagattctgggcccaggagtgaggcttcccttccccggcttccaataacaccgtgctaccagggtggggtcggggctgagccggctccccacacagagtgggcctggggtgaggacaggggtccggttgtgtctgacatgggggcctccagcagttcactccagcaagagccccactgagtgctagggcgcagctcttaaggacctcaggccacggggaggaggtgggaggaggcgggaaggccaccacttccctgccttcgtctgccttcccgtccatgccccatccaccatcctgccctctgctcagctctctggccctgtgtctgtccagccaggtgggcagccctgctgccagccctccctccacctgttcatcattcattcattcagtgttcatggagcctctgccaggtgctgaggactcaggagtgaaggaagacagctgaacctctgcccggtggcccatgttctggggacaagacacctcccgggcctggtctctttgcagcctggtgtggtgcacagcggcataggcgtgccccagagagcagtcggcgggtggacggatgaccagagagcagtcggcgggtggacggatgagtggatggtgatgagttgcggcatgggcgtgccccagagagcagtcggcaggtggacggatgagtggatggtgatgagtggcgggctttttttccccacatatgaaatgagataaagcatgcagggtgcaggcctggaggtgccactttgcatagggtcatcagaggaaggactggagagcgtgaggggtgagccatctagcagcctgggaagaggtatggctggaggtggtgattcgagggacatgggtgtcccagtcatcttcagagcttgagaccacccaggatccccagggaatgggaagtgtggaggaagagctgccctgtgatggagaccagggcacctggacttacaagtggcagctggcggtgaggttggcggagcagcggaggtgtgcctggcgtagacggtgttctaggaaggaagagcatgcagaggcctctgcagaggccacgagaggacccaaggctgtgcactgcgccccgtgggtctgaggcaggagctggtccagccatgtggtgggggtgagggcttgctgggaatgggaggagaggggttgtggtgggcacctgtaggcaatgcttgtcttttagagagttttgcagcaaagtgaggcagagtgacaggggcaggggcaggagggagatggaggccaggagagttttatgaagttgggggtttgcagcccgtccatgccacgtgcatagtccaggagggaaggacaagtggacagtgtggacagaaaggggacagccctggagccgtgagggaagcagagtccaggacctccgggagtgcgggcctgtgcatctgcatagaccagcagatgcaggaagggtggcgtggaagtcctctaactgtgtccaagtttccactgaatttggaagcacgtccatcagccaaggtggggtgcgaagtgagacagagggagagggagcgagtgagtgagtgcgtggactagaagcccctccatccgctgccccagcctctcactccccctgccccaccctccatccaccccttctttgtccccttgtcatccattcactcattccttaggaaggggctcgtcgagcgcagctactacctcctcgtccctgttccagttgctggggacacagtagtgcacaacacaggccgttcctgccctctcagaggctgcgtcctcctgggcgaggcaggcagtgagtgttgcagggcagtcggggtgtagtgtgtccttccactggggtggggtggcccctggggagcagctccagcaggggagaggctgggagggtggcgggggcaggggggccttggctcgggcgttggagggctctgagcacaggtgtggcccaattgactcgtgatgggtgctgggggcacagtgtagacggtagggaaggagagtgggagccggaagcagtgatccaggtgggagtggtgagggtttgtaccagggagtggcgctggagaacggggcaggtgggctctgacacccagaaaaggtagagcccacgggaagccccgtggtgcctccggagtctgtcacccatcggcgcaggtgcctttccccttccgtgccccagccagtctcacgtgcatccacgctcccagtcctgtccccacgtcactgcctctgccctcccgggcccctcaggaagcccctgtcaagcctctggccctgtggggctggttgcacctgggggtcagggacatgggcagggcccccagaaccccaaagccctgcgcgtccccacccctgttgtggctccagcctggtgctaccctccatggcccttggggacatcagagaaacacatcctggctcaggcaggtggctctccgggggagctttccaaccacggcttcttgttttagtctaaattaaactgggatttctttccaggacatgtaattagagcccagctttctccctggacccggcctcctgtgggttgaagagagggtgtgtgggtgtgtggccgctgcaccaggagggagtctggtcagcggagctcaggggccgaggcactgctgaccctgagcttcctgggcaaccactgtggcctcctgttcttttgggctttgtggacgcaggccgattcagatggtggcaggcacttctcagggagaagccaggcccagctcagggccccacagagggtccccatgggcaaggagggtccacccaggggagcagcagcccatgtgcaagtgtgcggctcagggatgacctgacgctgtgtctgaaaacaggtgacagcccagagacgctgccttcccgcaaggcgacctgacgctgtgtctgaacacaggtgacagcccagagacgctgccttcccgcaaggcgacctgacgctgtgtctgaacacaggtgacagcccagagacgctgccttcccacaaggcgacctgacactgtgtctgaacacaggtgacaagagacactgtgcccgaggggccaggacacgttggagcatggaccgagctgggtgtgtccgtgctgtgacggaactcttctgccacaggctctgcttcagcctggggtccttggactgcagccctgcgggaggtgcagcaccccgacctccagtgccgggtcgggctggggtttgccagacattctctccctttccctaccagagtctggaaatggcctttgtaggccctgaccctccctccctcacccctagtgtggctggaaccggtggagcgggggctgagttctgacaagtccctggaaagcagggagagcccccgtgttctggggctggggctgggatcactccaggcattgcctgactgggggctccacagcccccctcgtgtcagtgagaacccaccaactccaccccacaatgcagggccctggcccacgtgcagtccatgtggtgtggctgtgaggaccaggtggggcggtggcgggtggctgctgatctaggaccctgtgaccaagctctggtgccccttcctgacagtggcctcccatcgggcctccatgtccgtggggacaggcctggcagccatgctggggatgtaacagcctgagaaggtgctgctctgatagggtgggatcctggccccctcttcagcacacgcccctggctgggtccttatggagggcctggcccatgcccccgctctctttctctgtgtctcccccctccctctctgcctccttcctgcatttcagggttcttaacactctcctggactggggggcagaactgggcccactgagagcccccagggtcccctgattctgtgcggggtgagggtccacactgcccgggcatgagacctggggcttggctgtgctgtgcttgggaggctgaccctggccttgggctccagtcctgtggggtcttctctggggtctccgcgtctccatgtgtgctctgctgcctgaggagcccaaatccagagactccctggatagaagcagcgcggggctggctcactggatgggcatcgggccagcgttgcagacgtctggggcctctcatatgcccgcctggcatagccgacccaagggagggttggcctctctgcggatctttcaccatggggactggagagctgaaggagcccagggctgcccttggataccgcagactttcccagggggacgggggacatgggtgggagataaggaagggaggtttcagctcaacccagagaaggactttcatcattcatgggggtctgggctgctgtcctcaggcaagtggggactggaccaggtggtctgtcctttactcatatgtccctgatatgggccaggtacttgctgggcacgatggagccagggcccttccccccagggtgcgtgttctgccaacggcaaagtccccatgccacaggatccactctgtgctccaggcctctcctctcgacggtgactgcaggccgggctccagggatgggcggttctgcaggtgtgcagagtcccccttacgcaggtgtgcacagagtcccccttacacgcctttctcttcaggggtcccaccaggagggtcagtcggaggcttgatttcctgccccagcagctggaggggtgggggtccagggagagtgtggtggggacagtgagcggcagagctggaggccgtgaggctggggtgagctgtgtgagaagccttgaaggtcacagtttggggagtctcagcccaggacccagctctgaggggacagttcgggagggatggggcaggtgggcagggcggcctgggggcctgggactggccatgctcgtctctctccgtggtgctgatctttccagctctgcctgtgggtgggggatggaagggagggacacagctgtgtggtgtcgggggcacacgcccactcctgggaccatggctggcctgtgcgtggccaggcaggttgggctctcagggcgcatggctactttaaattttgggtctgtggctgttgggctgatggagcacagccagggatctgagatgggctctaaacttgctgtcagtatttaagaaggaactttcacgcaaaaacctgtgttttcatcttgcttgggagaagtccctggagcccccactctctctggagcagctgcctctggatctgggaggctgggcgggcagtgccgggctggctgtagaagagccgcccctcctgggggctggcctgttcgaagccgtccgtggcctccggtccaggctcgggctccaggtgctcactggggctgctgtgttccagtgccctggggggtcccaggcctgtggcggctcgcgaggatggctaggctggtgtggtgcggtggctgggggacaggggacctgcattctgtgcagatgcacccacagaggtcacaggggttcaagttcataccccgggagggtgggagccttgctcctgtgggcacgtggtggtggacaccccttcctgctctccttctcctccttcacactggagcggcagagttgcagattcacactgaggtgaggatggttgctaatggcttctcgggccctggactagaagaggtgagaaggcaggtgctggctgtggggctgtagagtggaggggcctccaccctgcgtgcctgtgtgcagccccacacgtgctgaagcatctctactccagccagacggacgctaacgcagattcattcctagcaggtcacatggtagcaccccccacccagtccctgccctcttcacgaccctgctgtgagctcctttctccagggctgggcaggcccttctagccaatgccaccctccctgtctcccctgagagcacaggagcctggtgaaaagggccttgcgccttggtcctcctcactcagtgtgcggcctctgtgtcttctccactcccaccccttcttccccaccaggctggcctctctttgccctcctccctccccgagaagtttccctgctggctcaccacaaagcccagcctctactgacaggctcattcccttgaacgactggacactggtctgctggggaggctggagcaaagcagcacagccgggcgctgcaacagcagacatttccttctcagtcctggaggctggaggtccaagatcagggtgttggcaggattggtttctggcgaggcctctcctcctggctggcagatgactgccttcttgtggtgggcggtgctgatccgatggaccccagaccctggggcaggcgggatgcagggccaggcctgcggggtccactgtggccatgtggctgttgctggtgcatcattgcatcgtgaaatggttagatggtttgatgtctgcagaatccgccatagttctccccctttcctctgactgtgggtcctttctcacgcttctctgtcatcagcctctgggcctgacaacacagctgcactggagccacaggcaccccgaaggggccaagggtgggaccaggtgaggaggaggggcactgtgagactgcaggcaggagggacgtcccccagcacagggcagcctcccgtccaagggtgggggctcctgagcaccacctcctgctctgcctgccggtcccaccccagcacctgctgtcttaaagccttgctctgggagtacagcgtgtggggagggaatggtgtccctgttcccatcacgggcctactcagcactgggtggaattcgacactgcaggcagacaggcagagactagagaccaggagcagcaggtggggtggccgccgtgtttccattggcatgcatcagaggtgcgtgggctcccagagcccgacaggcctgaaacgcccagacacacagatacagggacacacgggaggggggccgccatggcactccgtgtctcgcctggtgctgggctctgtgccatctccagtgaggggctctctccaggagggcaaaggccccccaccctcccaggaggtgcctttactccacggacttgccaggatccacagcctgggaccgtgggcatgtgggtgaaggcccggtgcacagctgctagaagtgagcagcacagctcctgagacatgaaaaggtaaaagaaaaaataaaagctggcccttttttttttttttttttaaagctgactcttttgtgaggtttattatgtgctggctgctgttttaataacaataattttataaatccaagaactagacgctgatattaacaactcccccctttaaaaaaaaaaaaaacactgggtgcggtggctcatgcctgtaatcccagcactttgggaggctgaggtgggcagatcacgaggtcaggagttcgagaccagcctgaccaacatggtgaaaccccatctctactaaaaatacaaaagaatgagccgggcaaggtggcacgcgcctgtaatcccacttactcagggggctgaggcaggaggatcgcttgaacccaggaggcgaagcttgcagtgagctgagatcgcgccattgcactccagcctgggcgacagagtgagactctgtctcaaaaaaaaaaaaatgaaacaaaataaaataaaataaaataaaggttttattttgagctaattatagattcataataggcagttgtaataaatggtatagagagagcagtgtactctttacccagttcccccaaaggaaacctcttaggaaactgtaatagcagggccacggtctcatgactaggtgctgagattgacacagggcccagaacagcccgtcccgggagggcccctcatgctgcccttctatggctgcacccaccttcctcctacttacctcacccaccttccctttactcgctggcaaccactcatctgtgcatttgtataattttgtcatttcgatgatcttagataaatgaagtcatacctttggatttgcctttttcacccatttgcttcatgaaatactatgaacaaagctgtatacacattcatgtacaggtttttgtgtaaatataagttctcacttctctgggataaatgaccaagagtacaaagagtacaatcattaggccatgctgtagtcacatttttagttttttaagaaactgccaaactctcagccagagtggatgtcccgtttcacatttccagcagcacaggagccgtcccttctccacagcctcgccggcacgggggttgtctctgtattttttttttttttttttttttgattctgatagatatgtcgtgatcgttgtggctttgatctgcatttccatgatattggacgtcttttcatgtggttctctgccatctgcatatccttttattttttttcagatggagtctcgctctgtcatccaggctggagtgcagtggctctatctcaggtcactgcaagcccctgggttcacgccattctcctgcctcagcctcccgagtagctgggactgcaggcgcccgccaccacgcccggctcattttttgtatttttagtagagacggggtttcaccgtgtgagccaggatgatctcgatctcctgacctcgtgatccgcccacctcggcctcccaaagtgctgggattacaggcatgagccaccgtgcctggccctacatatccttttagttgaaatgtgtcttcatatattttgctcatattccagttggattgtttgatattagtctattgcttgatatgtggtttttcagatattttttcctactctgtagcttttttctcccattttcgtaacagagactttgcgcagcaaaacttttaaattttgatgaagtccaatttgtccgtttttccttttgtggataaggcttgtggtgcgaactctttgccagccctagagcgtgaagatttttcccgtgattctctttttctaaaagttttgttattttacattttacacatatcagctgtgaggtttaggttgaggagtttgttttgttttttgcctgtgggtgtccagtggcaccagcaccatttgttgaaagggctgcatttcttccattgaattgcttttgtgctttatcaaaaaccaactgggcgtgcttgtctggacctatttctgggttctttattccgttccattgatctgtgtgtgtccctcgtaccacacagtcctgatcacggtagttatgtaataaggcttgaaactgggtagtacttactcctcccaatttattctttttctttcaaattattttagctattctaggtactttgcctttcatatacattttagaataatcttgtcaatatatacaaaaaatcttgatatataaaaaaaatcagtttcaagccagaattatataaaacctgtatgttagtttatgaacatttttactatgttaagtcttccaatctaggaacatggtatatttctccatttatgtagatctttgattgctttcatcggcattttgcagttttagggatacaagtcctgtacatgttttgttacatttacatctaagtatttcttttattttgtgtgattatagatggtattgcattttaaattttggtatctgtatgtccattgctagtatatagaaaaaccatagatttctatatgtttatcatgctaaactaacttagtagtagttctaggacaatttctttggagattctctggaatttcctatgttgacaaacacgtcatctgcaaagaggaacagctttgtttcttctcttaaaacctgaatgccttttcttttcttaccttattgcatttactagaacttctagtactgtgttgaagagtggtgtggcgagagaggcattgttactttgttccaaatttcaggaggaaaacattctgactttaaccattaagaataatgttagtggctgggcgtagtggctcacgcctgtaatcccagcactttgggaggccaagacaggcagatcacgaggtcaggagatcgagaccatcctggctaacacggtgaaaccctgtctctactaaaaatacaaaaagttagccgggtgtggtggcaggcgcctgtagtcccacctactcgggaggctgaggcaggagaatggcgtgaacctgggtggcggagcttgcagtgagccgagattgcaccactgcagtccagcctgggggacagagcgagactctgtctcaaaaaaaaaaaaaaaaaaaaaagttagctgtagggttttgtagttgctctttattaagttgaggcagtttccctctgttccagttttccaggcactattatagtaaatgactgttagattttatcaaatgctttttttgcattggtatgatcatgtgatgtttcttctttaggatgttaatacagtggattacagtggttgattttttgagtcttgaactagggatacatccctggaatagacatggttgtggtatataattcttttgatattgctgaagtctatttgccaatatcttgttaaggatttttacatatgtattcatgaaggctattggtctgtagtgttttttggtaccgtctttgtcttgttttgatgtcagtgtgatacaagcttcataaaatgaatttagaaatgctctccctcttctattttctaaaagccgttgtgtgaaaacggaattagttctttaatgtttgttagaaaaatctacagtgaatccaactggccctggagatttcctttttgggagctttcaagttacgcattcactttccttacgagttatgtggatgttcaaatgatctgtgtcatgttgggtccgtcgtgtgagtttgcattttctgaggaagtggtccatttagtccaactcgttgaatttatgtgtgtagagttgttcacagtgttccctcattgtccttttgatgtctgtagggtttgtaatagctcgtttcatttcttatattagtaatttttgtcttctctttttgttcctgtgtgtgtggggctttttctttccggtcagtcttgctggaaatttgtcaattatgtcagttttttttcccagagagccagctctctgtttgtatggttgattttctcttttttgcttactatttcatttatttctgcccttattttattacttccttcattctgtttgatttgagtttattttactcttcattttctctgttcttgtggcaagagcttagactagtgattgcagtttttgtttttttctaacatatacatataatactataaatttgcttcttaggttgggtgcggtggctcatggttgtaatcccagcactttgggaggccaaggcaggtggatcacctgaggtcaggagttcaagaccagcctggctaacatggtgaaaccccatctctactaaaaatacaaaaattagccaggcgtggtgacgggcgcctgtactcccagctactcaggaggctgaggcaggagaatcacttgaacccggaaggtagaggttgcgatgagccgagatcgtgccactgcacttcaacctgggcaacagagcaagactccgtctcaaaaaataaaaggaaaaacaaaaagtttgcttcttagcactactttaactgtatactacacattttaatatgttgtattttcgatttaattcaattccgtgtattttattttgtgtttttatcattttaatcattattattattattattatatttttgcagcgatctcagctcactgcaacctctgcctcctgggttcacaccattctcctgcctcagcctcccgagtagctgggactataggcacccaccaccatggccagctaatttttgtatttttagtagagatggggtttcaaatgaaattttatttacccacatttttactctttccatttttctatcttcctaatggccaacaattaaaataaaaataatattctttctgtttagataaatttctttaattattctttcaggataggtctgctggtgacaaattctcttaatatttattcacctgagaatgacctgatttcccctccattccccaaagatattttgctggatatagacatctgggttgacaattcttttctttcagcatgtgaaaatactgtgcaactgccttctgaccttcatggtttatgatgagaaatcttctgtcagctgagttgtttttccaaatagaaaaggtattatgtttctctgatgctttcaataatttttgtttttagtttttggaaatttgactgtgatgcatcttgttttgattatctttgagttgatcctgtttggggtcccctcagcttcttgaatctgtaggtttatttctcttaccaaatttggcaagttctcagccattatatctttgagtactttttcagtcctgccttcattctcctttttttctggaactctgatgatactaatattatggttccatagttccttgaggctctgttgttcttcttcttcttgttttttctttctttttattttttgagacagggtcttaatctgttgctcaggctggagtgcagtagcatgatcatggcttgctgcagcctccaccttccaggctaaagcaatcctcccacctcagcctcccgagtagctgggactacaggcacatgccaccaagcctgaatacttaaaaaaaatttttttttttttttttgagatggagtctccctctgtcacccaggctggagtgcagtggcacgatctcagctcactacaagctccacctcctgggttcacgccattctcctgcctcagtctcccaagtagctgggactataggcacccgtccccatgcccacttaattttttgtatttttagtagagacggggtttcaccatgttagccaggatgtctcgatctcctgacctcatgatccgcctgcctcagcctccctaaaaatttttttgttgagatggagtctaactatgttgcccaggctggtttaaaactcctggactcaagcagtcctcccgcctcagctttccaaagtgctgggattgtaggtgtgagccaccctgcctggccttcttttttctctctttctttcttttttttttgtcagttggagtctctctctgttgcccagggtggagtgcagtgctgcaatctcagctcactgcaacctccgcctcctaggttcaagcaattgtcctgccttagcttcttgggtagcgggattacaggcgcgctccaccatgccaggctaatttttgtatttttttttttagtagaggtggggtttcaccatgttggccaggctggtctcgaactcctgatctcagatgatccacctgtcttggcctcccaaagcgctgggattgggatatgctttcttaacctcagtttccttctcttacaaagaactgtgtagtctgccaactcctgagggtgtcatgagagtccctggcttgtagtaatggctcaccgctgtcgtgtgtgtgcttggggttggggttccccgcatgccatgcctagctcttcttctcccctgtccttgctttggagcaggctaggtggctcccacttcttggcctgttagagcagggactggggtggggaggccgaggggatgctgtggcgtctttggccgagaactgccggctctctccatggcaactgcaagcaggcttctgggtgagaaccagtgcctggaaggtcagtgacaaagcagatcctggagatggtgcctcccctgccagcttggctcccatgtagaaccagcctgagagtagtaagcagtctccctggactgggcctgactggcacctgacccacctgccccggcccagggacccccgcacctgtgcaggatttgtggtctcccctggctcagcgcagaccctctgaggggctggtccaggttgatggggcgtgggtagggctctgtgccacagggacggggtacaggggctggccagcgtgggccagatgcatggggacaagggagcatccatagtttctcatagaacataacagctctgagtccccagtcacctctgccagctcttggcattttcagaactggggggtcctgtggggtatggctgggctgtgaagtgtggaggtggctagaccaggcctgactggggtgtgccccagaagctcctcacagacggctgtggaaaggcagggtgcccccctggcccacgcggagggtgtgtgaggtgcccccctggtccaggtggagggcgtgtggctgggacctagagtctgggggatgtgaggtgagttttgggttagggttagggggcccagaagaagcctgcagcagtgtggttccagccttcctcccctctgtggggctgggagcactccccgaccttgggtgccagagtgagggcgggtctttacatgtgtgactgctgttgtgtctctgctgtgtgtgtctgcgccgtgtgtctctgtgtctgtgtatgtgtgtctctgtgtccgtgtctgtactgtgtgtctctgtgtctgtgtctgtgtgtctctgtgtccgtgtgtccatgtctgtgctgtgtgtctctgtgtctgtctatgtgtgtctctgtgtccgtgtgtccatgtctgtgccgtgtgtctctgtgtctgtgtatgtgtgtctctgtgtctgtgtgtctgtgctgtgtgtccctgtgtttgtgtatgtgtgtctctgtgttcgtgtctgtgctgtgtgtccctgtgtctgtgccgtgtgtctctgtgtctgtgctgtgtgtctctctgtccctgtgtctgtgtgtccctgtgtccttgtgtctgtgtgtgtaccgtgtgtccctgtgtctgtgtgtccttgtgtctgtgctgtgtgtccctgtgtctgtgtctgtgtgtccttgtgtccgtgtgtctgtgtgtgtaccgtgtgtccgtgtgtctgtgtctgtgccatggtgtgtctctgtctgtgccttgtgtctgtgtgtctgtgctgtgtgtctctgtgtctgtgtccctgtgtccgtgtctgtgctgtgtgtctctgtgtccgtgtgtccgtgtctgtgctgtgtgtccgtgtgtctgtgctgtgtgtctctctgtccctgtgtctgtgtctgtgtgtccttgtgtctgtgtgtctgtgtctgtgctgtgtgtctctgtgtccctgtgactgtgtttgtgtctgtgtgtctctgtgtccctgtgtcagtgtctgtactgtgtgtctctgtgtctgtgtccctgtgtctgtgtctgttctgtgtgtctctgtgttcctgtgtctgtgtctctgtgtctgtgtgtccgtgtctgtgccatgtgtcccatccctatgtctgtgccgtgtgtctctgtgttcctgtgtccgtgtgtctgtgtctatgcctgcgtgtctgtgtgtccctgtgtccatgtctgcaacctccaccgccctcccgggttcaagtgattttcctgcctcagcctcctaagtagctgggattacaggcgcataccaccaagcccagctgatttttgtatttttagtagcgatggggttattattattttgcattattttggtgatacagattgtcagagtggactgggtacaagtgtttaaacatttcatggctcctgagacattttgccaatttgttttccaaatgggatatataagtttgtattccaccagttctgtgtacatcattagggtttttttgtgatttttttttttttttttttttgagactgagtctagatctgttgcccaggctagagtgcagtggtgcgatctcagctcactgcaacctcaacctccagggttcacatgattctcctgcctcagcctcttgagtagctgggactacaggcacccacgactacacctgggtgattttttgtatttttaatagagacggggtttcaccatgttggtcaggctggcgtggaactcttgacctcaagtgatccacccgcctcgacctcccaaagtgctgggattacaggcgtgagccactgcatctggcctaaatcattagttttaatgtcagctttgccaccactggatatattttcttgttatatccagtgttttatatccagctcttgttaatttattcaatataaatctgtaccttgttgtccttttccattactgatgagtttgagcatgttcacacattactaaatggtgtttacttttgtgagttgtctctggggttctttgccatttcattttggaaatttctccattaacgtttattgagtgcacactgcctaccaggtactgtgcctggcctggagctaagaaggaaaacactgcttcctcctggagaaggagaaactaggggtggagtgagaggtcccactggctcctagcccctccccaacacccctcctctccaaggcagctgttgcctccttgcttttcagtaggatttttctagagcctaaggcttcagggcgtagaaagtacccaatacttgtgttggtatttaatacttgttaagttcgcatgtgtgtgttgtaatttccttttttctattgttgttaatataacatctttaatttaaatacctcaaagttgttttatttagtatttgtttacatgtcagcagaggataaacatttttcttttctgtttacaaaaagtaactgattttcttactttatgacacacactgccaccatcctgtgatatccactgttaatattttgagctatttccttccttccaagctttttcggtgtgtaggtttttaaatacacaattgatatcaccctccagggctactgcgggcacccccctcctgtcgtgggcaggccacctggtgcagctgtgccggctggtacaagatgcagggtgagggccccacgagtgctcactgcacacagatgtctcagcatctgatgtcccggcaacccccactgccgagtgtcctctgaggagacgattctgccttgtgggcagaactctgtcagattcctcttgtcaagcatttgggttatttcctattttgcttttgtagataaaccaaaacgcatacctatatctttagacatctctgattatttccttgggacaaatgcctaaaagttggatgagctttgtttttcctgtaaattatactattaaaaaactcttcaccggtggctcacgcctgtaattccagcactttgggaggctgaggcgggcggatcacggggtcaagagatcgagaccattatggtcaacacggtgaaaccccgtctctactaaaaatacaaaaaaaaattagccaggcatggtggtgcgcgcctgtagtcccagctactcgggagcctgaggcaggagaatcacttgaacccaggaggtggaggttgcagtgagccgagattgagccactgcactccagcctggcgagagagcgagactccatctcaaacaaacaaaaacccttcaccttctcatcacttggtcgtgctctgcttcgactcatacgcatcagtggtctctctctgtccgtgcctgtggtctcgttgtgtagctcagaggaggggtttaatgtctcatgaagccagtcccgttctccttgcttttcttctttgaatcattttttaacgttttgcctacttagttttccagatagattttgagatcattttgttgtagtcccaataaccccgctgggattttgatttatcagaatctataaattgatttcaggggaatcaagtttagaaataaatatatattctgtctgtccatccaggaatgtagtatgtatgaaaatttattcagctctccttttttttttgtaaatagattttgtagtttctttataaaagtcacctgcactgttaaagctattcctaagtggtttgtattgattggcggcatttcgattgaggcatttattttgttgcatttcctggctgtccctgtctggtgtcactgctggcttctggtgtttgtccatccatcaggctgctggttctgggtgccagtgcacaccccttctgggtagagctgggcagcgctttgtttgctgatgggcttggaccgaagttttggttgtgattacggtacctggaggttgcttttcctgccagttttttcctttctctcattggtttgatctcatcatcctgtgcttttgggttttgtgctgctttctgtcttttttggaagtcgggaggggcacacaaaccagaaggaagcttttcaagctgatgctctggaccactggggctcacaacttgggtgaacatcagaatcatcctgtaaggcatgtaaaacccagagtgctgggccctgccctctgatttctgagttctttctgggaaagaattagcatttctttctttcaaaatatgtatatatattttactatttctctctctctctctcttttttttttttttttttttttgagaggcagggtcttgctctatcactctgttgcccaggctggagtgcagtggtgtgatcatggctcactgcagcctcaacctcctgggctcaagccatcctcccaccttagcctcctgagggtggaactacaggtgtgtgccaccatgcctggctaattaaaaaaattttttttttgtagagatgggtctcatatgttgtccaggctaatctttaactcctgggctcaggcgatcctcccacctctgcctctcaaagggctacgattacaggtgtgagccactgcactgcctccgcctcccccctcctcctgctgtcccctcaagaatttgctaatggtctgccaggtgatgctgaggctgctgggagatcctgggttggttcttaaccaagttcctgggagttttatcactgtctgccatcggtgatcattttatctatttttttccttatttcctattcatgtcctactatgttggtgagaactcttaaaacaacattaaatgagaattatggtgatacttcttattttgttatctgacttgaagaaaatccttcatgataaatgtgggtttgttagtactcttgagaatggattttgtgcgtagaaaatatttttcagaaactagtttctaaatgtcaacattcaatttttaaagttagaaatccaaaaacgttgggtttttaaaagcttttaggggccaggcgtggtggcttatacctgtaatcccagcactttgggaggccgaggcgggtggatcacgaggtcaggagtttgaaaccagcctaaccagcatggtgaaaccccgtctctactaaaaatacaaaaattagccaggtgtggtggcacgtgcctgtagtcccagctacttgggaggctgaagcaggagaatcgcttgaacccaggaggcggagcttgcagtgagccgagattgtgccactgcactccagcctgggtgacagagtgagactctgtctcaaaaaaaaaaaaaaaacttttagattcaacttatgaaaaattatatttgtaaatttagcaatttttaacattcattttcaagaagattttaagtaatgttttatcctattttataaacttaagttagacatttaaaattttgtttataaatttactgtaactagaccttcctaagtacttaagtattgtatgttgaataaattaaagtgtaaatatggtgagtcataaatttgcttcaatggttcaatactttctataaatttattaggttttcaacttaaaattacaagtctcaatcagttccattgtatattttaaattcaaatcacagggccaatgtaatgctaaatacagcttcatatggtctgataaattcttcatcataactcaaaaaatattaattcggaaaatctgatttccacaaacattgctacatttaattctcagccttcctggggttaaatatgctggttcgctgaagacactgtcacctcccgacaagtgaatggaggtgtcctgcccttgtcctaagacactgtcacctcggacctgcccttgtgccctctgggctgcctcatcacatttgctggctggaatggctggaatgtagaccagattttttcctgaaaaatactagtggactatggcaagggcctctccactcaaatgctggaggcctcagaggcccagtgggctgcagttaggttgtaatttattccagaggctgcttacaccactggagcggattttgtgtttttatggctctcaagattatagaaatgtccagcctgggtctacacaactttgaattcttcgtcaaaaaagaagagatgttttccggccccagaggattatagcaactcctccttgttaaaatgcgtttctgtctttcatgtctttggcttgccagggtgactcctaaggccgctttgctgacatttcaggatttgtcagagagcgtcctggtgcctgggagacagaaaagctataaggtgaagggagggagaaacttttcctcctatgtaatttgtcttacttgggaatggaattggagctttgcaggagctgttcactgtctgggtcatctgtgtttccagtctcggtcttgctgactccatgcccgtgtgttgtgttattgaacatacgtgttcccctgcatgtccatgtgttgtcttatttaacatacgtctttctctgcatccccgtgtgatgccttatttaacatatgtgtgtctctgcatccctgtgtgatgtcttaacatacatgttcccctgtatgcccatgtgatgtcttatttaacatacgtgttcccctgcatgcccatgtgatgtcttatttaacatatgtgtttctcttcatccccatgtgatgcattatttaacatacatgtttctctgcatccctgtgtgatgtcttttttaacatatgtattcctctgcatgccatgtgatgtattatttaacatatgtgttcccctgcatgcctgtgtctagtcttatttaacatacgtgttcctctgcactctcccctggtctgcatttctctgtacattgggagttagcttgggagatttttcttagagaactaaaatattacagatgtggttgaagtcttctgaatacagtcccccagtcagattctcttctctttctctttttctccctgtgggagcaggtgtcctgatttgtgtttatcctgccagggcacgtgggtgtgtgggcattccacctttcgctgtgtgtgtatccataaatgatgtagcgtgtgagtgtgtctgtgtattcacacacagatatatgattatttcacagctctcctctaccccttaacattattttaaacatttttccatgttaacgtgcataggcttatttagttttacatgctcattcatttttaactgtggaataatattccattgtgtgcatttgccacagttaatttttctgtcttcttgtgaaaggcatttttattttcctttcttactattacaaacagggctaccccagaatgtgcctggggtgtggttagaagtggtttcctgaatcctggggatgctcatttaaaactttcctagaagtggccaaatactctccaaaacgattctacagttctctcttccaacacatcaccaggctttaacactgtgtgctaaatgtaggatgtcaagtggcagctcttcgttattttaatctggatttccctgattgccaatcgttttgagcatcttcttccctcttgtaatttgttgatttttctgattagttatttgtatttttcatatgaatttgtagaaattttttctacattcagaaaaccaattctttttcattttctttatgctgtcttttatggtgtggtgttattttatcgtagtcacatttattaatctattactttagtcttaagtcatccttccttacctcaccatcactgagctgttctcttgtatttttttgcagctttagagtttgctttccatgcttaggtctttgatacacctggaatttatgtgtgagtgatgcttcctctttctgccgacgggtgacctggttttccaacatcatttggcggctgctccaccctttttccatgatttggaacggcgccaccgcctttgtcaaacacccggtttcatacgtcaggcctgtttctggctctcgttctgccccatgccttccctgtccaatccacagagtattaattattttagcttaacagtaagtcttggggagtgaagcaagagctaatttcctggtttgttcttcagcatcgcttgactgttcatggcccattgcttgtccatgtggatgtaaagatgagcttgttaagttctaccagggttctgctgaggtcttttattaaaaacaactttactgaggctgggcgcggtggctcacgcctgtaatcccagtactttgggaggctgaggcgggcggatcacctgaggtcaggagttcgagaccagcctggccaacatggtggaaccccgtctctaataaaaatacaaaaattagccaggtatggtggcgagtgcctgtaatcccagctactcgggaggctgaggcaggagaatcgcttgaacccaggaggcggaggttacagtgagccaagatcacgccattgcattccagcctgggcgacagagtgagactccgtctcaaaagaaaaacaaacaaacaaacaaaaaaaacctttaagatataacttaacacaccatataattttcccatttaaagtgtacaagtcagtggttttggcatattaaatttttaattattattattatttttttgagagggagtcttgctctgtcgcccaggcttgactgcagtggtgcgatcttggctcactgcaagctccgcctcctgggttcacgccattctcctgcctcagccttccgagtagctgggactacaggcacctgccaccatgcctggctaatttttttgtatttttagtacagtcggggtttcaccatgttagccaggatggtctcgatctcctgacctcgtgatccgtccgcctcggcctcccaaagtgctgggattatgggcgtgagccaccacacctggctaaatttttaatttttaaaaattgtggtaaaatatgtataacatgaagttttctgttttaacctttttttttttttttgagacagaatttcgctcttgttgcccaggctggagtgcaatggtgcaatctcggctcactgcaacctccgcctcctgggttccagcgattctcccacctcagcctcccgagtagctgggattacacgcatgcaccaccacgcctggctaattttgtatttttagtagagacggggtttctccatgttggtcaggcttgtctcaaactcctgaccttaggtgatccacctgcctcagcctctcaaagtgctgggatgacaggcgtgagccactgcgcccggctttgcaatttccaatttttttattgccccaaacagaaacttagtgcctattaagcaagaactccccacttcccttccttcagccttggcttagcgctaatttacttactgtctctatgaatttgcctcttccaggtacctcatgtaagtgggagcgtatgttatttgcccttttgtgtctggattatttcacttagaataatgttacccaagttcatccatgctggagcaaatgcagcattagagcgtcgttccttttgtggaggaagaacagttattcatgtgcatgccccacattgtgcgcacacattcatcaggtgatagacatttgtgttcctcccctcttccggttattgtgagtgacgctgctatgagcgttgctgtctaagtatctgattgagtcctgctttcaattcttttggatatatagctagaaggggaattgctggatcttatgttaattctatgtttaacttttttttttcatttttagttttttttgagatggagtctcactctatcacccaggctggagtgcagtggcatgatctcagctcactgcaacctccacctctcgggttcaagtgattcttgtgcctcagcctcccaagtggttgggattacaggcccccatcaccatgcctggctaatttttgtatttttagtagagacagcatttcaccatgttggccaggctggttttgaacttctgacctcaggtgatctgcctgcttcggcctcccaaagtgttgggattacaggtgtgagccaccgcgcctggccaataatagctatcttagtgagtatgaagtggtatttcattgtggttttgatgtttacttccctaatgattagtgatgttgagcatcttttcgtgcacctatcggccatttgtgtatcttctttggaagaatgttcattcaagtccgttgcccattttaaaattgagttgtttttattgttgttgagttgtaagagtatttatattttctggatattaatcccttattagagatatgatttgcagatattttctccctttctgtaggtttcttttcactttttgatagtgccctctggtgcagcagcccccaacctttatgacaccaggcactgggctcatggaagacaatttttccacagaccagaggtcgggggatggttttgggacgattcaagtgcgttattacatttattgtgcactttgtttctattattgttacattgtgatatataatgaaataattatacaactcaccataatatagagtcagtgggagccctgagattgttgtcctgcaactagacggtcccatctgggggtgatgggtcagtgacagatcatcaggcataagattctcataaggagcgtgcaacctagatccctcacatgtgcagttcacagtaggattcatgctcctatgagaatctaataccaccgccgatctgacaggaggcggagctcaggcagtaatgctcgttcgcctgccgccacctcctgcagagtggcctgattcctaacaggccacagaacagtactggtctgtggcctgagggttggggacccttgctctgatgcacggaactttttacttttgatgaagttcaatctaatctattttttcttttattgcctgtgctcttggtgtcatatccgagaaattattgccaaatccaatgttatgaatattttcccctatgtttcttctaagagttttctagtcttagctcttatatttagatctttgatccattttgagttactttctgtatttggtgtaaggtaagggtccaactttattctgcttggttgttgaaaagatcattctttctccacttaatggtcttggtacctttgttgaaaaccagttgacatatatgtgggggtttatttctgggttattattctattccgttgatctagctagttttaaattttctaccttttctacctgtttttgtttaatagtttactgtttttatctgaacaaaattcctctttcaatagttgatcctgctgaatgtcttcccgtagcattgggcttcctcaggtaacctggcattttggtttgaatagaagggtttttattgtcctttttttctttttttattttgagatatttatcttttctttatttatttattcgagtcggagtctcgctctgtagcccagactggagtgcaatggcgcaatctcggctcactgcaacctctgcctcctgggctcaagcagttctcctgcctcagcctcccgagtagctggaattacaggcatgcgctactgcgcccagctagtttttgtatttttttttgtagagacggggtttcaccatgttggtcaggctggtctcgaactcctgacctcaggggatccacctgccttggcctcccaaagtactgggattacaggcgtgaaccactgtgcccggccgatatttatcctatttttgacccccagttctgtctcagattttgtctgttacggctatgtgtttggagcgggtgatcacaaagccttcgccaagaaccctggatgcgcgttagaggcagagccagcaggattgttggtgacccggacgtggcatatgagagaaggaccggagtcagggatgaagtttcaggtttggtttaaacaataggtgactggtgcgatccgctgaggggaacaaagggggaaggagcaggactggaagtaagaatagaaagtttcttagtcactgtgatgtaacaactctgaactttagaaaaaaggtacatcttttatacttgtgttaaagtgaaaaaaataattctttagttgtgtaatgtttcatatgctttttaaaatacccatatggaactgttaaaaaggcagttgtatatatgagcctagagctccaggtctggattaaagatacacacttgggaataacggacatgcgtgatactcaaagctattgggtagctcctacatggaatgagccttggggcaccctcgttttgaatctctggcagagaaggcaaagctggcaaaagaaactaagaaggagcccccagggagtgggaggaaaacaggagagagttggcctaaggcaagagaccacaccctttaaaggagacttgaccgttagaattggcaagaggaaggcttgaggtagcatttcagtggagaggtgggtgagaacctggctggagaaagctaatgagagagctcaagataaggaagtggtgagaccgaggattgacaccatccgtgagttctgatgggaagggaacagagaaatgctctgtggtagaaggcagatatgggatctttagttttgttcttaagatgggagatactgggatatgtttttttgctaatagaactgaccacagtgtcttcctcattccacctttccaataccccacttccctgtcttcctgagataagggaaagaatggtggtatatgggggtcggttcaggagtccctcaggctccatcctgctcctgctctcagtctccactcctctcagaaggcagcttgaagtgcagctggggttggttaggggatatgggtcagccttaaactcaattggtagacagatttcctgccatgccaggggccaagtgtctattcagagatggtgcctttgaactggaggtttggtcatgtgggtgattgtgaacattcctgtgagcgcttctggattcagttcctgcctcctctcacctggcaagccgctctgtgctggccctgtggttggacagtggggggacacaggtgctggccctgtggttggacagtggggacacaggaatgaaggtgtcactgctcttgggagacatgaccctggtggtgggaggagtgtgtcctcttccaggctcaatgtggaaacctttacttcccttcttctccttgtttctgccaggatccttgccacggctggaactgacttcgacctgcgaacactgagggctgtgcgtgtgctgaggcccctgaagctggtgtctgggattccaagtgagtccagcgaagacaggcccaagccggcttggagtaacaacctcctctcctaccctcaccacggacatggccatggccatggtttggctttggtgactctgagcttgccacttttgaccccagggaaccaggcaggaggaagggaggagcaggccttttttggcctgtcacaccctccatgaaagcccacagggtgatgctgttattttaccctgacctggcttccctagatggaagctttgttcctcctcacatactctgtcacatttcagcattttgcttctttttctgagggtaaagaatggatgagaggttgaccaaggtggtggggaaggatgcctgagaaaatgtgcaaaagctgcaaagggccacttgtctcttggctcagtcttgtcagggccactggggactgaggccagccttaagacatgctcctgaagtgggctgcccacagagcctgccatgagcaggaggatggccagggtgacctcatgagccagtgaccacctggacccctattccttcagcccagtggaagtctggttttaggtttacctaagggcctgagtggacatggaactagagctgtgtcctcctgaggccactgagggaagacccgtgattggctccctgttctaccctgagaccttgccaggcaatggttctggcccatatccaagtgctggggccagactcgaaggggaggggtcaaggtttacaggctcctctgcccagttcctcacatgctgtatggccagtggcagaacattcccaggggcaggtcttttttgcctcactttctcccaaggagttgggtctgttaggaatacctgtacttctcccccaggatcccctgctcttccctcccagggtcccctcctcttagctcccagcattctctgctccttcctcccaggatcccctgcccttagctcccagcattctctgctcttccctcctagaattccctgttctttcctctcaggatgtcctctgacttggctcttccttctcaggatttcattctctttcctctcaggattctctgttgccccaccctgagccccactccccaccccagacttcataccctgacacccccacatcccactcctctgcctactttgagacacttctcagtcgacttctctctaggaccttatgctttgtccctaggactctcagctctgccctacacaagcactctctgcccctctgcgccttaaggggcttcagctctatcctttgcccttgcaagcactcactgcttagcaccttgctgtccctgctaggttcctgctgttctgtccctgcccccaccaaattccttgccctaccctgcccacgttgcttcctgacctgccctgttctggccccaggtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacaggtgaggccaggcagcaccctccagcacaggcaagtgccacggatgcgttcatccaggagatgggcactgttctaggtgctagaggggccttcttggtgccagatacatgaggtggagctgacattctagtgggggacatagacgatagcctgataaacacaagtaaataaacacagaaatataataattatcgattgtagtaacttttgggaagaaaacaaaaaggtatttgaaatagaataatttggggcctgctttacagaggggcccaggaggccaactctgccaaggtgaccgtcgagcagcatctgaatgcagggagattggagccgtgtggccacctgggcagaacttcagttaccagtagtagtagtagtaggtgcaaaggcctatggtgcggagcagcgagaacaagaggaatcatgtgggcttcatggccctgtcttattctgagagaaacgggaagacagtggagcgctttgagtgaggtgtggcatcttctgatcattcgggctgctcctgggagttgagtagaagatctcaatccagcagaggtgatggtggctggggccagggtgttgtgatagaggtggttaaaatgggtcaaattatgggtgtatttgtaggtaaagccaacagaattttctgagagtctatatgtgggggtaagagaaacagaagagttaaggatgaagctaaggtttgtggcttgaactacaaacttagtaaaggagaaaacccagccggcggtggctcacctatagtcccagcacttttagaaaaaggttttactagaatttagatcgttcgtgattttaaaaaaaaaacaaaaacctttaatccaactgtaaataaaagagaattttcttaaatccctgcagatttcctgcaaataccatacctcaactaagccttgagagctttccctttacagtcaagaacaaaagcaagtcacttctagtccacgtagcatttgtagtcatggccaggtcatgagacaagaaaaagaaaaagttaaaaaaaaaaaaaaagaactggaaaggaggagatgaaactcattattcttagtcttctttaccagcatttatcaagatatttggacagagaggaataaacttaggtagtcagttttgccttctaaacctgggagtatttgctttccagctgagcaactccacaaaatttctcctatgttgatagatattttcatgtgttgttatacaattttttttttttttttttttgagacggagtctcactctgttgcccaggctggggggcagtggtgcaatctcggctcgctgcaacctccgcctcccaggttctagcaattctcctgcctcagcctcccgagtagctgggattacatgcccatggtgccacgcccagctaattttttgtattttagtacagacagggtttcaccatgttgcccaggctggtctcgaactcctgagctcagacaatctgcccacctcagcctcccaaagtgctaggattacaggcgtgagccaccgtgcctggcctgcattttttaaaaatattttttttcggcctttcattgagatttttgagagtgaagggggtaaacgtgctgcttgctatcttgttccagagattagcagtggttttctggtctttctttaacccctctttctctggtccctggctgcctgctcggtttcagcacagtagaaggatgtccgccctgtagggtcagtgcagcgagacctgggccaggaggtctccagccaccctccgggtacatgttcggttggttccagatcatcctgcctgacaggcaccagactgcacagtggctgagtccagcttgggactggccaagggcctcaagttagatctgcgtgtcaggaggatattgctggcagtttggctgtgagggagaggtacagtcagcgtggcagtttggctgtgagggaggtagtttggctgtgagggagaggaacggtcctcgtggcagtttggccgtgagggagaggtacagtcagcgtggtggtttggctgtgagggaggcagtttggctgtgagggagaggaacgatcagcgtggcggtttggctgtgagggagaggaatggtcagggtggtgggaagaatgggaggttaggagtttgttgtttttagttttaagatgaatgggctgtgagcccaccatcaagtgatggtgggcaggttccagtaggagggagaggccagccgttactccctgagttggtcactcgtgagctcggggtcagcaagaggcgatgcctgatgcagattcgaggagggatggtgggaagttgagggagagtttctgttggtggctggttcctgcccacctgctgtgagctctccagagcccaggaatcctggtggggattggagagcttggtatttctgagctcagggtctgcttcattctccttcttgcagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatgtgagtggcgtcttggccctgggcctgagggcaggccctggacctcctgagctggtgcctctgggggtccatttaggggggcccttctgacctcagagcctctgcccagccctaggctcctccctgcacccctaggatgaaatgcaggctctttccggcagacgccccacccaagggtccaccacaggcagcctcagctcagactcctgaggtgggtcctcctggagttgactccttcgtgaaaatgaagcagaaggctgactggtggaggtcagagaagaaaactccagaggagatgctgctgtttctgttggcaaggacgatagtagcactgctagctgctctgggttaggccctctgggaagtgttttattcctgttgactcctctcaggaacctgttgcacagatgatgaggctgacttgtggagaagctgactaactttctccagcccgaggaccatgggcagctgttgctgtgccacccctctagggtctctgttggagttgagggacagtagggctgctgggcctcccgtccccaggctgcccggcgaaggtggtgaaccgcggagcagggccgaggcccccaagaccttcctcggtcacgcagggattcttagagtggagcctgtggcttgtgcatttgtttccttcatgccgagtctgtctggtcctgtttcctctttggtctcctcgctctcatcaggatgccggcctgtctctgcagtttacggcagcctggatttggtggccatgattgaagttgagtataaggcttggggggggtgcctgatggcccagctccctcacgttgcctctgcctgggtcccttcttggtggagtctcccatccccccaccaccgactcttgagcagatctgcctctttataggaaggcctctgctgctgtctgtcccctctgtgagtcctgtgagctaccagggcatgagaataattaagttagtacttgaggggctgtggaaggtggagaagggtcaggcgcctgtgggtcaggaatctgggaggggtgctaggttttgagtaactagaggatgtgttcccctcaggtgctgtcagggtggggagggggccggagtgcaaggtgctttcacctagagcttgttacttgtgccctggggtgaagcttggtccacgtgtgcctgggagcctgtgcctctctccccagcctccagcagctgtgctcatgagggctggtggcatgatggtggacaggtcctggggagagactggggccctttgccctgtgcctcatgcgttcatggagatagggctgggcattcagcaggcatttgctaaatgcttattgagctcgtttatcaagcttcttgaacaggcagatggcagatgaggagttaaggaaaagccagcacagggtccatgtgaaccagattcctcctcgagtgggagtcgtgtctgatgacaggcttgtgtgattgagggaatgaggaacaggacaaagccggtgatgaggagcttggctgttctctctctgtagccaatcaaggaacaattcccacaaagacagaccctaaaaatagctctgagctggctgcattcctgctggccccacccaaatgaaggactgtgtgaccaggtctccacagccctcagtgtccactggggcttggccaggggccgcacatgactcagattcttctgcctgggtctctgcctcccgcaggaggggatgggcaggagccccatcctggggcaggcagcactggccaggaggggccacagaggtttcagccagcatgtgtttcagtaggacccagtgagtgctggctccgcttacacagtggtgagcagaggcattcgacacgtaagggcatggacagtggcgagtgccgtgaagaaaacagaagaggttgaggagcaggcagtgacgaggtacagggtactgggagggcaaggcctggtgaggtctagaaaccagacatgcagatgctacaacaccttggaagcttggccggggcagcaagatgcagtcatggcagtgcctggggctggcgccacacaaggccccagagcaggtagccaagaaccgaccagtccgctcctccacactaagggcatacagggtcggtcactggagattagacaggagttttgaagaggatcctttggagagagcgagagcccgcccctcacctccaacccagtgagagggacttttgtggcccctcggatatacgctccttcaagcaatgacatctgggttctttgtgggcggaagcccacggcctgcagtaggggtggaggcagagagatggaaagctcagtccgtgttgggagcaggagtgggggtgtgagcaacagcgggcagccaggaccgggtgagtgatggggtctcagagtggattgctgaaaagctggtggcagcgggtggggcagcgtgggggcactccagcttgaggagaaatggctttgtctgtgcctggaaaagcaggcggagtcaaatggagctttgggagaacacacggatgagcctggggagagacgagtcggcagtaaattcctgttaggtccagagaggtgagatcatctcaggacagcaccgcacgaggaataacagctgtcccttctccctcccctgctgtgatagtgctgggtacaggggagcaaagaggggccgtgtctttctcttccactgaaagcaaccagctgtggcaggccagccagcgagagtgggtattgtcatggtgaagcatgtcagtttgatggccagctgagactgagactggacactttcttttttttttgagacagagtcttgctttgtctcccatgctggaatgcgatggcacgattttggctcactgcaacctctgcctccttggttcaagtgattctcatgcctcagcctcctaagtagctgggattacaggcacgagccaccccatccagctaatttttgtatttttagtggagacagggtttcgccatgttggccaggctggtcttgaactcctgacctcaagtgatctacctgcctcagcctcccaaagtgctgggatgacaggcatgagccaccacacctggcctgaacactttcaactgccgagttgaaactgtattttccacttgaaagtggctgtagaacttcgccttacccaggagctgtcagaatggtcatgggcttgtccaaattatcatctaggggcatgggaaggatttctccaatgaccatgtttggaggcgcagtggaggtaaatcatgttgctttatgattatgcacgtatgctttgcttatgttcattgtactagttccgtgaagatccaagtttgaaagtgttcagatccatagctgcattttgatgctagcacaaacaggccttgctcatagagtggatgtgagagaaggagaagtctcaacgatgatgtgacttgaggcactgagaaaggtgatgccatttactaagaaagggagaatcgggagacacgaatttacttagttttgttatagcagagggtggtggcggaactccaggattctgttttggctctgcaaaactttagataactattttcatacaagtggagatcttgggtgtgtaggtgggtgtttgagagggaattcagagggaacagcaggctgatgagcatttgaagtacttgactcatggacagtgtttaaaactatgtgagaggatgagatcacctgggtaataagtgcagatggagaaaagaaggcccaaggctgatactggggagaattccagcactcagaggtccagtaggaaagcaggagccacgaaagagatggggctggagcttttaagggggcaggaaaaacaccacgaccacacagcatcccgggagcagagtaaagcgttcggagaacatggtcagcaccacggccgcgcagcatcctgggagcagagtaaagcgttcggagaacatggtcagcaccacggccgcgcagcatcctgggagcagagtaaagcgttcggagaacatggtcagcaccacgaccgcacagcatcctgggagcagagtaaagtgttcggagaacatgatcagcactgcagccgcgcagcatcctgggagcagagtaaagcgttcggagaacaccatcagcaccgtgaccgcacagcatcctgggagcagagtaaagcgttcggagaacatgatcaacaccacgaccgcacagcatcctgggagcagagtaaagcgttcggagaacctgatcagcaccacgaccgcacagcatcctgggagcagagtaaagcgttcggagaacacgatcagcaccacgaccgcacagcatcctgggagcagagtaaagcgttcggagaacacgatcagtaccgcgatcacacagcgtcctgggagcagagtaaagcgttcggagaacacgatcagcaccacgaccgcacagcatcctgggagcagagtaaagtgtttggagaacatgatcagcactgcagccgcgcagcatcctgggagcagagtaaagcgttcggagaacatggtcagcaccacgaccgcacagcatcctgggagcagagtaaagtgttcggagaacacgatcagcaccgcgaccgcacagcatcctgggagcagaataaagcattcggagaacatgatcagcaccacgaccgcacagcatcctgggagcagagtaaagcgttcggagaacatgatcagcaccgcgatcacacagcatcctgggagcagagtaaagtgctcggagaacatgatcaacaccacaccgcacagcatcctgggagcagagtaaagcgttcggagaacatgatcagcaccacgaccgcaaagcatcctgggagcagagtaaagcgttcggagaacatgatcagcaccacgaccgcacagcatcctgggagcagaataaagtgctcggagaacatgatcagcaccgcgatcacacagcatcctgggagcagagtaaagcgttcggagaacatgatcaacaccacaccacacagcatcctgggagcagagtaaagcgttcggagaacatgatcagctgggccagatgttgctggaggtcaaggaagatgggaagcccggactgttgcgtttgataagaggaaggttgttggtaaacttggcaagggcggtctcagtggtgggacaacgccctggaatgcgtgggttacagggaggaggaggtgaggaaatcagggtggcaaccgcagatgactcttggagggagcagagcagtgggaagtaactgcagggagacaggggttaagggaatgggcttttaaaaaattaaacttttaatttaagataattgtagattcacatgcagtagtgagaaatacagaaatagctcatgcatcctttacccttttctcccagtggtgacaacctgcaaaactatagtcagggtcacagttaggatattgatgttgatacatcagtatcaatgatgttgacacagtgaagacgtagagcatctccatccctgcaggggtccctcctgctgcccttttgtggtcacacccgcatctctcctgccctcgccccctccttaatccccggcaaccactaatctgtttgccatatctataatttagtcattttgagaatgttacgtggacaaaaccacaccaaatgtaaccttttggtactggctgctttcactcaaacaaaattctctggaggttcacccaggtgttggtagcatgtttccttttactgccaggtagtattgagtggtgccaggtgtcaatttgtggtgccaggtagtattccgtggtgccaggtggtattccgtggtgccaggtggtattccgtggtgccaggtggtattccatggtgccaggtggtattccgtggtgccaggtggtattccatggtgccaggtggtattccatggtgccaggtagtattccgtggctccaggtggtattccgtggtgccaggtagtattccgtggctccaggtggtattccgtggcaccaggtggtattccgtggtgccaggtagtattccatggctccaggtggtattccgtggctccaggtggtattccgtggtgccaggtagtattccgtggtgccaggtggtattccctggtgccaggtggtattccgtggtgccaggtagtattccgtgctatggctgtaccatggcttgtttaaccgttcacctgtggaagcttccaatttggggttattatgaatagagttgctgtacacatttttgtgcaaacataagttttcatttctctgggataaatgccaaagagtgcaaatttctaggtatagtagttgcatgcttagttttttaagaaaccaaagcttttccagagggctacactcttttacatttccaccagtggtgtgtgaatagttcagtttttgtgcattctggccagtgtttggtggtgacacttttttattttagccattctgataggggtatagtgacacatcactggttttaattcgcatgtcctaacagtgagtggtgttgagcatctttctggacttatttgccatctgtgtatctttggtgaaacgtctcttcacatcttttgcccatgttctgtttgaattgttctttatatattctaggaactggttctttgtcatatatatggtttgcaaatattttctcctagtcagtagcttatcttttcatacttttcacctggtctttcatggaacaaatgtttttaaaatttgatcgagtccagtttatcaatttatccttttgtggattgggcttttggtgtcaactgtaagaactctgcctagtcctgaatcctgaagattttctttttttttttctaaaagttgtattgttttatattttacatgtaagtttacaatctattttaggttaataaaagtgtgaggtttttgcctgcctgccttccttccttccttctttccttcctccctcccttccttcctccttccctccctccttccctccctctttcccctcctccttccttccctccctcccttccttcctgtagctccaacaccccttgttgaaaaggctgtatttcctccattgaattgcctttgtacctttgccagaaatcagctggacatatttatgtgggtctatttcaggtccacgtgtctttctctctgccaataccacgtagtcttgcttattgtagttacctatatgttttgaagtcaggttagactgattctttccatgttattcagtttgggagaattgacatcattactatgttggatgttccatgtccaatcagaacatgttatttctcttcatatatttagatcatgtttgatttctttcattagcattttgtagttttcagcatacaatatacattttgttagatttgtagctattatgttttcttattttctttgaatgattctaatgtgttttgagcacccctggagaaactggtgttctagtactagagtgtccagcaaccctgccctcacaggggatgaaaggaagcggaccttggtgttgacagtgtacccttcatgggatacttggattacttggcaggcagccagtgcctggttgtcccgcctgtgaccagggggttcctgatacaggaagcttgtttatactggcagacatccttgtggctcttgtccgacccgtgtctggtttgtgcctgaccagcattgcagtgttgggagcccatcctagttccccagggaaaacctggccaagggtagccctggttcttcagatggaaggcacacattcagtcaccaccacaacaggaaataagttcaacgatgtattacctacagatcggcagggagggcaccgtgagtggggagcgccatcctccctccccaggttatctgaggcagtaatgaagagtcagagaggtatagggggaggcaactggccatgctagggaatagggtgtgggtccctttaaatttgtgggcgaatgcctgaatggtctgtttaaaggaggcagcagaaatgtgtagtctgctaggtgggagagatgcctctaagttcttatctctggccacgttttgggtgtggtgttctaacacctaggcagcaacctttgctatgttgttcccattagaaaatggtattgtattttaaatttcagtgtccatgtgttcattgctagtatatagaaatacaatggacttttgtatgttgatcttgatcattcaaccttaccaactcccttattagttctgggagatttttttgtagattccttgggatcttctatgttgataatcatacaatttgcaaacagaaacagtttatttcttcttttggatctgcttttttttttattgtgctaaaataccgataacataaaatttaccatcgtaaccatttttttttttttgagatggagtcttgctctgtcgcccaggctggagtgcagtggtgcaatctcggctcactgcaagctccccctcccaggttcatgccattctcctacctcagcctccggagtagctgggactacaggcacgcgccaccatgcccagctaagttttgcattttttttttttttttttagtagagacgggatttcgccatgttggccaggatggtcttgatctcctgacctcatgatccgcccacctcggccttccaaattgctgggattacaggcgtgagccactgtacctggcttccttttttcctttcttttttttttttttttttgagacggagtctcactctgtcgcccaggctggagtatagtggcactatcttggctcacttgcaagctctgccccctggattcaagcgattctcctgcctcagcctcccgagtagctgggattacaggcacctgccacagtgcccagctaatttttgtatttttagtagagatggggtttcactatcttggccaggctggtcttgaactcctgacctcgtgatccacctgcctcagcctcccaaagtgctgggattacaggtgtaagccactgcgcccagccacctccttccttcttaaggctgagtaatattccattgtatgacattttgcttatccattcctctgtcaatggaccattgggttgcttccatgttttaactcttacgaagagtgctgccatgaacatggttgtataaatatctctttgagaccttgctttcaattcttttgggtatatacccagaagtggaattgagggatcatatgataattacatttttaagttcatgaggaactgctgtatcgttttgcacaatagttgtaccatttgacattcccaccttttggtgggaatacacatgcatttccatttctgcacatcctcaccaatacttgttaatttctgtgtttttgatagtagccattttaatgtatgtgaggtggtatctgcttgtagttttgatttgcatttctttaatgattagtgatgttgagcattttttcttgcacttattggccatttgcatgtcttctttgaagaaatgtctgttggagttccttgcccatttttgaatctgttgttttggttgttgttgagttttaggcattctctgtatattctgagtataatccttttcagatatatgatttacgattttctcccattctatgtgtgccctttttactgaattgatggtgtcatttgatgcacaacattttaaaattttcatgcagtctagtttgtctgttttttcttttgttgcctttacctttgatgtcatatccaagaagtcgctgtcaaatctaatattgtgaagcttttgacctatgttttcttttaagagttttactttttttaggtctcacattcaggtctttgatccattttttatttaatttttgtatatggtgttagataaggatccagctttcttcttctttttttttttttttgagacagagttttgttcttgttgcccaggctggagtgcaatggaacccgcctcctgggttcaagtgattctcctgcctcagcctcctgagtagctgggattacaggcatctgccattacgcctgtctaatttttgtatttttagtagagacggggtttctccatgttggtcagactggtcttgaactcccgacctcaggtgatccgcccacctcggatttgctgaaaagactgtccttttaccataaaatggtcttgacgctcttgtcaaaaatcatttggccatatatgcaagagtttattttgggactctgtattctatccccttggtctgcgtatctcgatctatgtgcgtagccttatggcactggctagaaacttcagcattatgttgagtaagaatggcgagagctgacatatttgccatgctcccaatcttaggaaaaagcatttgatctatcacaattaagtataatgttagctgtacggttgagttgttgttttttcttttgaggtagatgctgtttatcaagttggggcagttctactctattctattcttacttttctgagagtttttgttttgaatgggtgttgaattttgtcacatgtgttttctgcactgatatgatcatgtgagttttcttctttagtctgttaatatggtgaattacattgatttttgaatattgaaccagccttgcattcccagaataaatcccacatggtcatggtacctaattctctttatgtgttgctgaattgtatttgttagcatttttactaaggagtcttacacttatattcatgagggattttgatctgtaattttcttgtctttttttgttgttgttgttgagacggagtcttgctgtgtcaccaggctggtgtgcagtgttgtgatcttggctcactgcaatctccgcctccaaggttcaagggattcccctgccttagcctcccaagtaggtgggactacaggcacccaccaccacgcctggctaattttttgtattttagtagagacagtgtttcaccatgttggcctggatggtctcgatctcttgactttgtgatctgcctgcttcaacctcccaaagtgctgggattacaggcgtgagccccaccgtgcctggcctatgattttcctttttttgtattgcctttgtctggttttggtatcaaggtaacacaagcttcataaaataaatcaggaagtatttattcctcctctgttttctggaagagattgtatagaaatgtgttatgtcttttaaaaacgtttggtaggattctactgtgaaactctctgggcttagaaatttctttttggagatcttttttttaaataacacttttgctgcaatataatctgtgtaccataaaattcaccattttaaagtttacagtttacagttcagagttttttgtatgttcaaaaagttgtgcagccatcattgttatctaattttaagcattttcattaaccaaaaaagaagccctgtatccatgagccatcagtccctatttccttattcccacagcctctggcaagcactaacctttctgtctctgtagatttgtctattccagacattttatataaatggaatcatacaatcggtggccttttgtgtttttacatccacgatgaagcaagtattggtatttttttgtcaagtatgattttgttgtgtatttatagcatattttatttatatttcatgagttgatggacatttagatatttccacttttaaaaattatgactaatgctgctatgaacattcttgcacaagtttttgcaaggaatatgttttcatttctcttgggtatggacctaggattggaattactggatcatagaactctgtgtttaaccatttgaggaaccaccaaactgttttccatagtggcagtaccattttatatttataccagcagtgcacaagggctccagtttctctgcatccttaccagcatttgttgtctgtctgaaattttaaccatcaggccaggagtggtggtttatgcctataatcccagcactttgggaggctgaggtgggaggatcacttgagcccaagaatttgagaccagcctgggcaccatagcaagaccctgtctctacaaaaacattaaaaagttagccaggcatggtggtgtgtgcctgtagttccagctactcgggagactgaggtgggaggatcacttgagcccaggagctggaggctgcagtgagccaggatagcgccactgcactctagcctgtgtaacagagggagaccctgtctttaaaacagtaataataaaactaaaaaataagacaattttcaccatcttagtgggcatgaagtggtatttctgttcagttttgacttgcatttctaaagtgacttatttttatttttgggacagggtcttactgtgtcactcaggctggagtacaggggcatggtcatagctcactgtagcctcaatttcctgggctcaagtaatcctcccacctcagcttgggagagtagccaagaccacaggtgcacactgccaagcctggctaatttttaaattttttgtagagatgaggtcttcctgtgttgcccaggctggtctcaagctcctgggctcaggcgattctccctcctcagcctccgaagtagcaaggaccacacgcgcatgctaccatgcctggctaagtttttaaaactgtttttttttgtagaggtggggtcttgctatgttacccagactggtcttgaactcctggcctcaagtgatcctcccaccttggcctctcaaagctctgggattacaggcatgagccaccgcatgcagccattgttgagcatcttttatgagcctattcatcacttgtatatcttctttgaagaaatgtcagctgggcgcagtggctcacgctgggggtttagatgattatttagacttccttcttttgtgaggtggacatgtaggtctatatgttttcctctggcactgctttagctgtgtcctgcaatttgatgtgttgtctcttcactttcattcagttcaatgtatttttaaattcccttgaaatttcctctttgacctatgagattattatatagaactgtcttgtttactttgtgtttggagagttacctgttatctttctgttattaatttctagtttgattctattgtggtgggagaatacactaaactgaaagaattttaattttaaatttgttgacgtttgttacatggctcggaatatggtctattttgatatttattttgtgggcacttggaaagaatgtatattctgctgttgtgtgctgcatgtacagatgttgattgattcttttggttgatggtgttgttgagctcttttatatccttgctggttttctgtctattctacaaattgttaagagagaggtgtagaagtctccagctttaattgcagatttgtctgtttctcttttcagttctgtcagtttctgtatcacttattttgcagctctgttgttgagtatacacatatttagacttgctatttttttttgatggattgacctttttatcattatatacatgtttccctgtgtctcgggtaattttgttttactgggaggtttgctttatctgatattaatctagccactccaatttaaaaaaattaatctttgtataaatctttttttatatttttacatttttttggagacagtctcactgtcacccaggatggagtttagtggtgtgatggtgtgcaatctcagctcattgcagcctcacccttccacactgaaggaatcttctacattagatggtattatctggggagggtcttgactacgagttgtccaggttcttggcggtttgaacaaagaattgcacaagatgcacaaagcaacaaaggaatgaagaaatgaagaaatgaaagcacagatttattgaaacaaaagtacattccatagtgtgggatcgggctcgcgtaaacggctcaagagccctggttacagaattttctggagtttaaatactctctagaggtttcccattggttagctgcttacaccctgtgtaaatgaagaccaggccctctaccattctgattggtcatgggaggcgaccaatcaggtactttccatttttcgtctgcgatacagtggaatggggggcgttgcaaagggagtagcctcttcttttgttacttggatgtggagaggtggagttttccttttgatttagttctaggaagtcagcacaaatcggccttaggttccttgcctccagaccctattctcctgcctcatttcccccgagatgtgatccccatcatctttataggaggccgagggactgatggttttttcttcagtaactgcttcatgctgatttgggcacagttcctacctattggggatcatggaactctcaccctgctctgtctagtggagacatggtagttgctggatggccaggggtggtgtctttacctggaactggctggaaaccttgtctcatgatcatctgaagcttgatggtctctgggcgagaggaaatgaatttgtttaagagatttaatgaacatggtccaaaaaccaaggcaaatatagtcattagtgatgggccggctagaggaaggagccatgcacctcaacttagcatttctgaccaggagccccatgactcagacagctgttgtcgtatcttaggggcccagtcagctaatttccaggcggcatcccttactaatcctgattagttgacataaaaacagcatttttcctctagaaaaagacataagccacctttttaagcagttaggagatccagtccccttcaattctgtaaagtgactgctgccaaggagtctgtctgattttgtatggcgacgatactttgggcagtgtcttctgagctttccataaaatctctggacaagttagtgataggatagggagattgcaagcctgctaactcccgtttctactcttgctgttcttcctaacccaaccaaaaggggtgtgagttggatggctcatttgtgtctggtggttgcagttaaaggtatagtgaagaattggttgttgggagctacattaattttgggagctaaataacaagttacaggttccagtccagttggctggtaaatctaagtaggaactggtcccgcacgggaaaaaggctccttgtttttcaagacagaacttgttttctatggtgaacacatgggctagcttgttgttttcactttcccatatggttgaggtctttgctaaggtggccctggttaaaggctggaaaggatcttgggaagtatcttgagttgccccagcagttctcttttcccagtggaggtagttaggcttagtgtccagtaacaatcacccagaggtattttcatactggggaaccaaaaggcaactagacgtctcaggattagtacattcttcacaagggaaaccgtgaatgcagctagtgggcctgcctcgaccatacttaggctgtccatcctttaaagcccttaaccagggatggtttccatgaaaaccgtacaggttatctaaatgatgcggtttgggtaactgtatagcttacgtaatcgagtgaaggattaacttccagggtgtagttgcattgatgactttattttatctttacttttatttatttatttatttatttattatattttttgagatggagtctctctctgtcgcctaggctggagtgcaatggtgcgatctcagctcactgcaacctccacctcccaggttcgagcgattcttctgcctcagcctcctgagtagctgggactacaggcgcgtgccaccacgcccggctagttttttgtatttttagtagaaatggggtttcactgtgttagccagaatggtctcaaatcttctgacctcatgatctgcctgcctcggcctcccagagtgctgggattacaggtgtgagttttttgtatttttagtagaaatggggtttcactgtgttagccagagtggtctcaaatctcctgacctcatgatctgcccgccttggcctcccaaagtgctgagattacaggtgtgagtcaccgcgtccggcacattgatgacttttcaaggttccaaggaccggaccagaattttcgcttctgttaatacaaagtggcacctgcaattttagctctgtgtacatttatattgggccccaaattggtttctgaggggatgcaactccagaaaggttgctcagatgggattggagtaggtttactgcttatcctgtcattgtaacccttgtcatttccatgattttgaattcatgtatgtcatccaggctcattagtttgaagagagttcctcctttgtagttagggtgataggtcatttccttaagggcccaagattgggctgggatcaggatggcagtatatttagatgatgatggagataaacaaaaccaacagtcctttgccagggctgggctggtggtatttaagtctttgtgttaaatttaaagttcttaataaatacccagaatccactaattgctggaggggtaaagggaagctctgttgtgaaataaagctgattgctagtaagacatggttcctgtatacacaggctgtgggtgaccattatggaacaaaaaaaaaattacttatttgttattttgtcctatagaatgggaacttcagggggtggatacctatgctgtcaggaatgcttgttataaaaatgaattgaaacactttggttaattattacaaaggaagtgattccatccattttgaataaaacaaattgtaaaaatataaaaaatagctaccaatatccagcttacgataagtatgcaacaaagacaccaaggaaagttggtaggcatttacttatttttcggctgtcttttaaacaggtacttcactgttcccacaggttcacaggtgtagtggctgataggagcttcaggttccaggtccagggcttcagttattgcaggcttgaccctggaaagatggatccaactacctaatcctagtactttgaccacagaaggcttgtccagcaccactgaaaatggtcccttccatttgggttgcaatagttgagcaggtgatccctctttccatgttttaacaagtacctgatttctcattttggagatcatggcagacgggaggcaggactagattgcagttcccactcggatggccagagcagcctgtggaggattgtatcgtgaacttttgctccagaatgactgcagaaataaatcaggaaagccgagagaacccatagaccctctgaaggaagcggattgctccagcaggacctgggagatacccaaaatactgtgctggtatccacagctgagagacccacagacagttcatatcacaggactctgtgcagacaacccctagtaccagcccagaacccggtagacttgctggatggctagatccagaagagagacaacaatcactatagctcagctctcaggaagccacagctctaggaaaatggggagagtactacctacatcaagggaccaccccatgggacaaaagaatctgaacaacagccttgagccctagaccttccctctgacagagcctaccaaaatgagaaggaaccagaaaaccaactctgacaatatgacaaaacaaggttccttaacaccccgaagaaatcacactagctcactagcaatgggtccaaaccaagaagaaatcccggatttacctgaaaaagaattcagaagattagttattaagctaatcagaaggcaccagagaaaggcaaagcccaatttaaggaagtcaaaaaatgatacgagaaatgaggggataaattttcttttttttcattatactttaagttctagggtacatgtgcacaacgtgcagatttgttgcatatgtatacctgtggcatgttggtttgctgcactcgttaactcatcatttacattacatatttctcctaatgctatgcctcccccataccccccaccccatgacaggctccggcgtgtgatgttccctgccctgtgtccaagtgttctcattgttcaattcccacctgtgagtgagaacatgcggtgtttggttttctgtccttgcgatagtttgctcagaatgatggtttccagcttcatccatgtccctacaaaggacatgaaatcatccttttttatggctgcatagtattccatggtgtatatgtgccacatttttctaatccagtctatcattgatggacatttgggttagttcttagtctttgctattgtgaatagtgccacaataaacatatgtgtgcatgtgtctttatagtagcatgatttataatcctttgggtatatacccagtaatgggatcactgggtcaaatggtatttctagttctagatccttgaggaattgcccactgtcttccacaatggttgaactagtttacactcccaacaacagtgtaaaagcgttcctattgctccacatcctctccagcacctgctgtttcctgactttttcttttttttttttgacggagtctcactctgttgcccaggctggagtacagtggcatgatctcggctcactgccgcccaggccggagtgcagtggcacgatcttggctcactgtcgcccaggctggagtgcagtggcacgatctcggctcactgcagcctctgcctcctgggttcacgccattctcctgcctcagcctcctgagtagctgggactacaggcacctgccaccacgcccggctaatttttggtattttttagtagagacggggtttcaccgtgttagccaggatggtcttgatctcctgaccttgtgatccgcccgcctcggcctcccaaagtgctgggattacaggcgtgagccactgcgcccggctgtttcctgactttttaatgaccgccattctaactggtgtgagatggtatctcattgtggttttgatttgcatttctctgatgaccagtgatgatgagcgttttttcatgtgcctgttggctgcataaaggtcttcttttgaaaagtatcctttgcccactttttgatggggttgtttgattttttcctgtaaatttgtttaagttctttgtgcattctggatattagccctttgtctgatgggtagattgcaaaaattttctcccattctgtaggttgcctgttcactctgatggtagtttattttgctgtgcagaagctctttagtttaattagatcccatctatttcggcttttgttgccattgcttttggtgttttagtcatgaagtccttgcccatgtctatgtcctgaatggtattgcctaggttttcttctaggatttttatggttttaagtctgacatttaagtctttaatccatcttgaattaatttttgtataaggtgtgaggaagggatccagtttcagctttctatatatggctagccagttttcccagcaccatttattaaatagggaatcctttccccatttcttgtttttatcaggtttgtcaaagatcagatggttgtagatgtatggtgttatttctgaggcctctgttctgttccattggtctgtatctctgttttggtaccagtaccatgctgttttggttactgtagccttgtagtatagtttgaagtcaggtagcgtgacgcttccagctttgttctttttgcttatgattgccttggcaatgtgggctctttttttggttccatatgaactttaaagtagttttttccaattctgtggagaaagtcattggtagcttgatggggatggcattgaatctataaattaccttgggcagtatggccattttcacaatattgattcttcctatccacaagcatggaatgttcttccatttatttgcgtcctcttttatttcattgagcactggtttgtagttctccttgaagaggtccttcacttgagggggtaaattttcaatgaaatagagtgcataaataaaaaacaataaaaacttcaggaaacaatggatgcacttagagaaatgtaaaatgctctggaaagtctcagcaatagaattgaacaagcagaagaaagaacttcagagctcgaagacaaggtttttgaattaacccaatctaacaaaggcaaagaaataagaataagaaaatatgaacaaagcctccaagaagtctgggattatgttaaacgaccaaacctaagaataattggcgttcctgaggaagaagagaaatctaaaaatttggaaaatgtatttggggaaataatcaaggaaaacttccctagccttgctagagacttagatgtccaaatacaggaagctcagagaacatctgggaaattcattgcaaaaagataatctcccaggcacattgtcatcatattatctaaagttaagatgaaggaggctgggtgctgtggctcacacctgtaatcccagcactttgggaggccaaggtgggcggatcacctgaggttgggagtttgtgaccagcctgaccaacatggagaaaccccgtgtctactaaaaatagaaaaaattagctgggaatggtggtgcacgcctgtaatcccagctactcgggaggctgaggtaagagaatcgcttgaatttgggaggcgaaggttgtggtgagccaagatcgcaccattgcactccagccggggcaacaagaatgaaactctgtctcaaaaaaaaaaaaaaaaaaaaaaaaaaaaaaagacaaaggaaagactcttaagagctatgagccaaaagcaccaggtaacctataaaggaaaatctatgaaattaacagcagatttcccaacagaaacactacaagctagaagggattggggctctatcttcagcctccttaaacaaaacagttatcagccaagaattttgtatccagcaaaactaagcatcataaatgatggaaagatagtttttttcagacaaacaaatgctgagagaattcgctactaccaagcaagcactacaagaattgctagaaggagctctaaatcttgaaacaaattttcaaaatacaccaaaatggaacctccttaaagcataaatccaacaggatttatataacaataacaattttaaaaacccaaggtattcaggaaacaagtagtatgatgactagaatagtatctcacatctcaatattaatgttgaatgtaaatggcctaaatgctccacttaaaagatacagaatggtggaatgcataaggattcaccaaccatctgctccctttaagagactcacctaacacataagactcataaacttaaggtaaaggtgtggaaaaagactttccatgcaaatggacaccaaaagcaagcaggagtagccattcttatatcagacaaaacaaactttaaagcaacaacagttaaaaaagacaaagagggacattatataatgataaaaggccttgtacaacaggaaaatatcacaatcctaaatatatatgcacctaacactggagctcccacatttataaaacaattactagtagacctaagatatgagatagacaggccaggcacagtggctcatgcctgtaatccagcactttgggaggccgaggtggatggatcacctgaggtcaggagcttgagaccagcctggccaacatggtgaaaccctgtctctactaaaaatacaaaatagccaggtgtggtggcaggctcctgtaatctcagctatttgggaggctgaggcaggagaatggcgtgaacccagaggtggaggttgcagtgaggcaagatagtgccattgcactccagcctgggtgacagagcgagattctgtcctaaaagaaaaaaaaagagagagaaatgagatacacagcaacacaataatagtggggaacttcagtactccactgacagcactaacaggtcatcaaggcagaaagtcaacaaagaaacagtgaatgtaaactataccctggaacaaatggacttaacaggtatttacagaacattctagccaacaactacagaatatatattcatcagtgtatggaactctcttcaagataaaccatataaataggccacaaaatgagcctcaataaatttaagaaaattgaaattatatcgggcaccttctgagaccacagtggaataaaactggaagtcaactccaagaagaaccctcaaaaccatgcaaatacatggaaattaaataacctgctcctgaatgatcattgggtcaaaaaatgaaatcaagacggaaatttaaaaattcttcaaactgaggccggatgtggtggctcacacctgtaatcccagcactttgggaggctgaggcaggtggatcacgaggtcaggagatcgagaccatcctggataacatggtgaaaccccgtctctaccaaaaatacaaaaaaaaaattagctgggcatggtggcaggcacctgtagtcccagctactcaggaggctgaggaaggagaatggcatgaacccgggaggcggagcttgcagtgagctgagatcacgccactgcactctagcctgggcaactgagcaagactccgtctcaaaataaataaataaataaataaataaataaataaataaataaataaaaaaaaataaaattcttcgaactgaatgacagtagtgacgcaacctaccaaaacctctggaatacagcaaaggcagtgctaagaggaaagttcatagccctaaatacctacatcgaaaagtctgaacgagcacaaacagacaatctaaggtcacacctcaatgaactaaagaaacaagaacaaatcaaacccaaacccagcagaagaaagagataaccaagatcagagcagaactaaatgaaacttaaacaaaaaaacacaaaagataaatgaaacaaaaagctagttctttgataaggtaaataaaattggtagcccattagcaagtttaaccaagaaaaaaagagagaaaatccaaagaagctcaattagaaatgaaatgggagatattacaactgacaccacagaaatacaaaagatttttcaaggctactgtgaacacctttacccatgtaaactagaaaacctagaggagatggataaattcctggaatgatacaacccttctagcttaaatcagggagaattagataccctgaacagaccaataacaagcagtgagattgaaatggtaataaaaaaattaccaaccaaaaaactccaggactagatggattcacagtagagttctatcagacattcaaagagaattggtaccaatcctatcgacactattccatgagatagacaaagagggaatcctccctaaatcgttttatgaagccagtatcaccctaatatcaaacctggaaaggacataaccaaaaaagaaaactacaaaccaatatccctgatgaacatagatgtagaaatcctcaacaaaatactagctaactgaatacaacagtatatcaagaagataattcaccatgatcacatggttttcataccagggatcagggatggtttaacatactcaagtcaataaatgtgatacaccacataaacaattaaagacaaaaatcacatgatcatctcaatagatgtggaaagaaccttcgacaaaattcagcatcctttatgattaaaaccctcagcaaaatcggcatacacaggacatacctcaatgtaataaaagtcatctatgacaaacccacagtcaacataatacagaatggggaaaagttgaaagcattccctttgagaactggaagaagacaaggatgctcactctcaccactcctcttcaacatagtaatggaagtcctaaccagagcaatcagacaagagaaagaaagaaaggttatccaaattgggaaagaggaagtcagactgtcgctgtttgtttgctgatgatatgattgtttacatagaaaaccctaaaaactcctccagaaagctcctagaactgataaaagaattcagcaaagtttccagatacataattaatgtacacaaatcagtagctcttttatatactaacagtgaccaagctgagaatgaaatcaagaactcaaccccttttacaatagctgcaaaacaaacaaaaaacagaaagccaaaaaacttaggaatatacctaaccaaggaggtgaaagacctctacaaggaaaactacaaaacactgctgtaagaaattataggtgacacaaacaaatggaaacacatcccatgcttatggatgggtagaatcaatattgtgaaaatgaccatactgccaaaagcagtctacaaattcaatgcagttcccatcaaaataccaccctcattcctctcaaatttggaggcatcacattacccaacctcaaactatagtataaggccatagtcaccaaaacagcatggtactggtataaaaataggcacataggccaatgacagaatagagaacccagaaataaacccaaatacttacagcaagcaaaaagataaaagtggagaaaggacacactattcaacaaatggtgttgggataattggcaagccacatgtaggagaatgaaactgaattctcatctcttaccttataaaaaatcaactcaagatggatcaaggacttatctaagacctgaaactataaaaattctagaagataacattggaaaaacccttgtagacattggcttaggcaaggacttcatgaccaagaacccaaaagaaaatgcaacaacaacaaaaaagataaatagctgggacttaattaaatcaaagaacttttgcacagcaaaagaaacagtcggcagagtaaacagacaacccacagagtgggagaaaatcttcacaatctatacatctgagaaaggactaatatccagaatccacaatgaactcaaacaaattagcaagaaaaaaaatcccatcaaaaagtgggctaaggacatgaatagacgattctcaaaagaagatatacaaatggccaacaaacatggaaaaatgctcaacatcactaatgattagggaaatgcaaatcaaaactacaatgtgataccagcttactcctgcaagaatggtggtaataaaaaaatttaaaaataatagatattggcatggatgcggtgaacagggaacagttgtacactgctggtgggaatgtaaactagtacaaccagtatgggaaacgatgtggagattccttaaagaactaaaagtaaaactaccatttgatccagtaatttcactagttggtgtctaccaagaggaaaataagtcatatgaaacagagacttgctcacgcatgtttacagcagcacaatttgcaattgcaaaaatgtggaaccaacccaaatgcccatcagtcaaccagtggataaagaaactgtgatatatatatgatggactactactcagccataaaatggaatgaattagtggcattcacagtgaccttgatgagattgggactattattctaagtgaagtaattcaggaatggaaaaccgaacgtcgtatgttctcactcataagtgggagctaagctgtgaggatgcaaaggcatgagaatgacacagtggactttggggactcaggaagaaagggtggggtgagagataaaagactacaaattgtgtgcagcatacactgcttgggtgataggtgcacgaaaatctcataaatcaccactaaagaacttacgcatgtaaccaaacaccatctgttccccaataacctatggaaataaatttttttttaagtaccttatctcctggcctgattttgggttgctggttagttgccagtgtggggagtctttgagtttcaaactttttttttttttttttgagtttcaaacttttgtaaagcctgctgaaatggtcccaggttaactaggtatttcactaaagtggctgtttctggatcagtatttagatcattagttaaaaatggcctcctatataacatttcatatgggctcatattaatttttgctctggggaaattatggactcttacgagagctgtggacagcaagttgacccaagtttctgatgtttcctgacatagcttagctaacacccattttagagtttgattagctctttccacttttctagaggattgaggcctccatgctgaatgtaaatagtatttgattctgagagccttagcaaccccttgaattatttgagagataaagaacgagtcattatcactttggaggctttgaggtaacccaaactcgggaaatagttctttgaagaaccttcacaacttcattggccttctgtgttttggtgtagggtaagcttcaatccagccagtaaaggtatctgtaacctgcacggaccttgggggactgaacaaaggatgacgaatgcgggaataaagataaagacaaagagtatatttggaagaaggggtcagggggctccttgcttctagtgaacaagggccctgagctttacacagccctccgtatttattaggcaaaagagatagcgagaagaggagggggtggttgtcagcaggcagtttgattcacagcaggcttgcaagaccgcattctttgaacaataggctctagatgtcccagtaggtaaccgcaatgagcacggtgccagggagtgattgccctcagcaaacctcctggttgcaggcacagtcatgagtttgcccacatcctgctttcatgataaacaagtttgctgtttgatcatataacctccagtggaatactgagttggtcatgtctctctggccttcagctccctacaggtgtctattagtactaacaaatcttgtatcctctacaggctggcattgtccttatggccctttgggtttcctttgcgtgctctttgggcattcagggcattgccagtgatggctgtcataatttttgcttgccatttttctttactctgttccccttttccttccttcatgattgttatacatcatgaaagcaatatcaagaagctgattttgattagtttgtgggcccatctgtagcttttggagcttatatctaatgtctggggcagattggattagtatattttttaaaggcttcctccagtctgccatgaaacatggctggattttctttcttgcccagtgtaacttcctttaccttatcataatttactgccttattctctttctcttcctccaaggagagcctcaagaaacttagcctggtggttcattccctcgggtgtgttatagtcccaattaggatcagtaatggagattatgtctgggcctaagtgattgccctgagagtttcaaggaaataagtcatctgcttcctggcgggcagcctcaaagatttgtttcttttccaaggggctgcaataggttgctagaatgaattgaacatctcccctgagagatcaaaggctaaggtcaaagtttgggacccatctccaaattcctagggttctcagaatagcttcctagcttttctgtatgttgttttatatcagttatagaaaagggggactgcactaggactggcccctcagctcctgctacttccctaaggggtagcagggctggagggggagattgtttctctccaaatatgaggaggacttagctggaaccccgaattttgctcttgggtttgagcctcaggagcacttggcaaggagttatacaggggtggttgcacttccctctgagagacaggtggcctttgtaaaagggggtcatctacaatatctagttctgccttaagaccttccttttcagggcaggttccaggacttttgcagattgttgggttttggtatagggccatgaagacctgtacgtatgggatttctgacaatttaccctgccttttgcaaaacaggtctaattgcaggatggtgttgtaattaagacttcccatgaccaccaattattcctggctgtccagctgatattggggctatacagtattatagtagaaaatcagacgttttctccttagattgtcagggttcaactgattccagtggttgatgatgcagccaagcagggaatcagagggaatggatggagagttgcccacagtggtctggaagagagaagaggactttcaaaagtggaggtcctactaggtgacccagattttacctggggtggccatctggaaaaactctgggtcttgtctgcggttcccaagggcatccccacctctggggccccatcttagtttgtcagatatgtctgaccttagatgggtgccagcaccactttggaacggttcccttcacaatcagtggcccactatgagtttcctcttgtccctggctgaaggccccgacttctagcatccttataatttgataaggccaagcttttaacttcagccaatatgttcatacacagaatctcttttacaattaattttcataagcctacaacttgttcaaacctttggatttttcctataccacttaaaacaatcctttaaccctctaaacttaggcaacataaattatacaacatttcttgcataatttcactttcacaaatctttttcacgacttacccagatcatctacgacatgcttggactttgttacttgtcctaaacatccctattttatttctttacttttattattattattatcatattccaggctggagtgcagtgatgccatcacagctcactgcaacctccgccttccaggttcaagcaattctgctgcctcagcctcccaagtaactgggacaacaggcgtgcatcactgtgcctggctaattttttttatatttttagtagagacagggtttcaccatattggccaggctggtctcgaactcctgacctcgtgatccacctgccttggcctcccagagtgctagcattacaggtgtgagccactgcacccagtcatatccctcttttaaaacaacagtcattttactttaggacaagaatttaccatacaagatgcctttttatataatataaaatctcttttatgtataaacttctttgcatagctagggggctaagtgggtttcttttgtccttagccagtcgaatagatcaagtaagagaaggggtcaaaatgcctaggagacattatcttttgtctttactagctaactctacaggagaatttagcataagaaaagagggtttaagttccctgaaatgtgtgaattcctccttgacaagctgccactgccaattgtgtcacacgtagggatcagggagtataaccaggaaagacagaaaagagtccttcccccttccaggcagggcagctatccctatcattcctcggccttcaggtaacactggagagtggccccagcaagttgccctcagttactggggagctactaggaaatgactgctgaaaaactgagaaaaaaaaaaaaagggaaaggactcaggtccctcatgtgaaccaggcagtggtggtcaggtgcttccatatggatacctttcagtctctccgtagagtggccccagccagagacctgcagttgcctccatgcttaggtgctctctgtcaagtgtcctgagttggaaagagagacagaaaatgcttcccctgtatggagcagagaggaaaagggaaaatgagaagaaaaataactcccaaactttgggcttgcctcctggctggcttgccaaaatacgttaccgggggggtcttgactatgagtcatccaggttcttggcattttgaacaaagaattggacaaaatgcacaaaacaacaaaagaatgaagcagtgaaagcacagacttattgaaactatgctccacagagtgggagtgggctcaaacaagttgctcaagagtgttagttacagaattttctggaatttaactactctctagaggtttcccattggttacttggttacactctatgtaaatgaagactgggcctgctaccagtctgattggttgcaggaggcaaccaatcaaaggctgaagtgaagttataaagttaaaccctatgctaatgaagacttggcccacgagcagcctgattggttgtgggaggtgaccaatcagaggtactttccattttttcatctgtgacacagtggaaggggggtgggccgcaaagggagtagctgctgttcttttgttacttggatgtggagtggtgttttccttttgattcagttctaggaagtcagcacaaatcggccttagggtccctgcctccagaccctattcttctgcctcaatagtactataatttttgcttcatctgtcaaacataatttaaaaaactcaaaaggagaaacaaatccagttacctatatttttacactttccatttttcttccttccttcctaatagtgattcaatttttactcatttcctttctgtttagagacctttcattattcattttttcttaggagagttctgctggtgacaaattctcctggtttccctagtttttcatttgagaatgtcttgatttcccaaaggatattcttggtgggtataggtgtctgggttgaccgttcttttctttcagcacctgaaaaatattatgccacttccttctggcctccatggtttctgatgagaaaccatttgaattgttttccccatataggtatggtatcatttttttctgctgcgttcaagattttttctttgtctttagttttcagaagtttggctataatgtgtttgcctggggtttgctgagcttcttaaatctgtatgtttgtgtctcttgctaaagttgagaagttttcagcattcctttttttttttttttttttttttgagatggagtttcactctgtcacccaggctagagtgcagtggcacaatctcggctcactgcaaactccgcctcccaagctcaagcgattttcctgcctcaggctgtggagtagctgggattacaagcatgcaccaccatgcctggctaacgtttgtatttttagtagagacagggtttcgccatgttggccaggctggtctcgcactcctgacctcaggtgatctgcctgcctcggcctcccgaagtgctgggattacaggtgtgagccaccacgcctggccgtatttctttaaatactgtcagctttgtcctttttcacctgtctttagtgctctgatgacatgaatatcagatcatttgttatagtcccatgggtttttgaggttcacttttctctccttatcagaatggataattctatcgttctttgttttcttactgttcactgattccttccacatccccttcattctcttgttatgcattttcattgagattttcgactttttttttagctctaaattttccctttggttctgtaatccaaaaagttatcagagacaagtctcaatcaattcagaatttcattttggcaaggttaaggacatgcccagaataaaaaaaaaacactttggagaaaggtatttggtgtgtttgtggtgtgtgttgtgtctggtgtgtgtggtgtgcatgtgtgtgtgtctggtgtgtgtgtggtgtatgtggtgtgtgtagtgtgtgtggtgtatgtggtgtgtgcctgtatctggtgcatgtggtatgtgtgtggtgtgtgtgtgtgtggtgtgtgcatgtgtgtgtggtgtgtgcacttgtgtctagtgtgtgtatgtggtgtatttgtgtctagtgtgtgtggtgtgtgtgtctgatgtgtgtggtgtgcgtgtgtttgtggtgtctctgtggtgtgtttgtgtatggtctgtgtggcatgcatgtgtatggtgtgtgtctgttgtgtgtctggtgtttggtgtgtgtatgtgtgttttgtgtgtgtggtgtatacgtgtgtggtgtgtgtgtgggtgtgaagtatgtgtgtagtgtgtgtggtgtgtgtgtggtgtgtgcatgtttgtggtggctgtgtgtccagtgtgtgtgtgtgtggtgtatctgtgcatgtgtgtggtgtgtgcgcttgtgtgtccagtgtgtgtgtatggtgtatgtgtgtctggtatgtgtggtgtgagtgtgtgtgtggtgtatgcatgtgtgtggtgtgtggtgcgtgtgtgtgtctggtgtgtgtgtttgcgtgtcctttgtgtctggtgtgtgtggtgtacgtatggtgtgcgtgtaggtgtgtagtgtgtgtgtgtttggtgttggtgtgtgtggtgtgcatgtgtgtggtgtgtgcgcttgtgtgtccagtgtgtgtgtatggtgtatgtgtgtctggtttgtgtggggtgtgtgcgtgtgtgtgtgtggtgtatgcatgtgtgtgtcgtgtgtggtgcatgtgtgtgatgtgtgtctgtgtgtgatgtgtgtctgtgtgtgtgtgtggagagggagatttatcatgaggaactggctcatgtgatcacagaggctggcatgtccacatctgtggttctgcctggcgggcttgtgtgctgtccacacatggagagctgatgatgcagttcccgatggcggtggccggcagaggtgaaatccagaggcacctgctggagacttttcccttacccaggggagggttggtcttgaatgtgggttgaatgaggtccaccccacattacagagagcagtggtcttcactctgtggattaaagtgataatctcatctcagagcacctttgtagaagtatctgtaaggtactgtcaagtgtacttgaccaagtatctgagtaccccgtggcccagctaagttgacacaacattaaccatcacagcatctaagaaattggtgctcttcttggttcttagtatgacaagtgagtttcagttgaaaactggccatttttggcctttcagcatgggaccttggatctcagttaagcattctgcgttggctgtcagggaaggaggagggctgctgtcttgttgccggtgagtgcagaagtctaggttccccacttggcatctgttgacttatggtagcgtgttctccttactgctgggcgggggtggccggtctggctccccaccatgcctcaagggaactttcctggctgggagggttagaggtgccttgttcttgttctccacgtgatttctgcacactgtgtgtgggtgggcggctttgtgactgctggatggtggtaaaagtcctggctgcacaaggcccttctgatagctccctagctgcagggggtgcccctactgcctgtgtaaatggaagtcaaggtgtcccgtgtggtcttcactagtaccgcggaggtgggcttgggctggggggccgtgataacccctgctgaggaggaacgttccacttcctacttggctttctctgacagcaccccatggagggtgaggggattcggatgcctcactgcagtctaggtgctcctctgggtctttgctggaagggagggatggagatggagccagcgttttctgtgagttgtctgagagctccctgtcctgctaggctgccttggttagggagagctggcttttgctggtactttttttggtcgtctgtgccccttgggcatttccaaattttaggcttcagcagctccaaatgtgggatataagaggcaagaagaaaaccccagaaacacaccttatatcctggggtcctagctagtctgctctattttctccatctttcagagtcattctatatttgctttatgaataattttcagtatgttaattccacctagtgggaacaatatggcagagtatgtctgctccatcttcccagaagtggaagtcctgttttttaagatgagaggaattagagccagttggctactgatgggaacactccactggggagggaaattgcgggagccaagtgcttgagcaggtgagaggggctgaggctacagcagcgatatctcctttttctcaagaagggaggacaggtttgagggtgtgcttgtgggaagttggtggctttggtggccactcagtccacagatctgagctgcatgtgagtccggacagaggtgtggtctagtggttcatattctaggaacatgaactgcagctggagctgagattctgaatgtcacttctggtttcggatccaggaatctcaggggccagcctggaatcagtgtccaagggtcaggaaccacgagcttcagtccatgcaggggtggaggctgcaaatccgccaggctggcagacactggagggcaggaatgccaacagcagcacctggagatcagcgcccgctgcagggcagtgccccaactgtcctcctgcctctgtcttggtggagtccatcccatgtcttgtgaactgcctctgaagagaggcgtccaggaacgggactaggggctgcctcccttggcacccaccaccctcctggtttctctccagcaccagacttgcagggagaaagaggttctctacaccccttagccacatcccctgggaatgcataaaaatgaaacaactatggaatcaaattgggttcaaaggagcgcacccttttgtgggctgtgctataaaaagcaaaagatctgggaaagaaggtccctctttgctttcagctattcagatcatgcctgagtgctgggcgctgtctcaggccaggcatgtggtgaaactgaaaatgcagatgggcccactgttgcctctcagctgtgggagctgctgcatgtggacttgggtctgatgtggacttgggcctgtgggcccccttcaggaggacatggctttggagctgcccaggatgtctggtagccagggaggtgtctggcagaggttgggtgctcatgccacctcggggcatccacactgctgtggctccctgggcctactgcttggcttttgagtgttgccaggcagtggctggcagcactgagtgtccctggtcctctgggagctgcagtccagagagaactctgccagcaagggcacgtctgcctgtgggtgctgcctggactccagccccatgcttggacctccctgtgactggcctccccactgcctggaccctaccaggtgtgtgcttctgagaaggaggcctgttgggggctgggggtgctcctgtggccgggactgtgttttgtccctgtccttcctcatctccctctccttgcttccagacaaacgatgcggccggcaacacctggaactggctctacttcatccctctcatcatcatcggctccttcttcatgctcaacctggtgctgggcgtgctctcggggtgagagaccatgtgggggatgtgcaggtgcccctctgtgttctcagctgaggggtcaacaggggcacgtgtgacacttggggtgggggcctggcccatgggtgccctctgtggtggttgcccctggtgttctgggttctggtagcccttcctttgtgccaccatcctgacctgtccttgatcagcctctcggccccttatccctgtcatacccctggcctttccgtggtctctgccatgggagagtagctgccactactcatctgggtagacaggaggtgtggtctgtaatgggaggttggtctggggggatgggaggtgtggtctgtaatgggaggttggtctggggggatgggaggtgtggtctgtattgggaggttggtctgggtggatgggaggtgtggtctgtgatgggaagtgtggtcttggtagatggaggtgtggtctgggacagggtttctgagcagcctctgtggccacagagagcccctctgttactgtggtgagaaataactgggggcaccctgatctctgtagcagtcaccactgggctcgccaccctggccctgactgctggtgtccacttcctctcaggtcacctctttgtgccaagctactccaggggatggtgagagagagggctcagggctgggggtccatgctggagaaggtggagaaagagtcctctctgggagtgggatgtggtaggcgggcatggccaggtgggcctgtgggcacacagcccctcctgtcccaccctggggctgagagctgaagagatgccatgtatggggcctgactgggtttggtatttggggctcctgccctaccacagggcaaggagttgtgctaggaaggaggtggaaggcatcaggcctgcctggcttcctgctcccaccttggcctcagctccccagtgaggctggaggagtacatctcccctctgtcctcactatgatccctgctcaggcccacggctccgagccaggctggggatagagcctggtgaacctgggagttctgccacgctgagcaggacaggagcagccagagtggggatggctggagccgaagcctctgggctccagcaggagatcgtgcccttggttttggccctgtcctgtaaagggtgtgattgtcattagcaggcctctccaaaagcctccatgggaaccagcaagcgaccggctcacgggatggaaatagaactcctagcctggcggggtagctggcggaggcttgaggcttggaggaggcaccgggggagggacatctcagctgagaccccactgggggactaggaatgagccaggctaaggaaggaggagggtctttcaggcagagaacagctggggtggaggcacagtggacagaaggttgtggcctgtgtgttgcagagatgcttggagctggagtcagagggtgttgtggggagagggcacaggggctgtcagggggctggcagccaccaggcttgtgaggtgcctgggctgtgctgagggtgctgcctggtgccaaaggtgctgagaacgctgcctggtgggaagcctggcaggagcataggtgggttcaaggggaggcaggagagcagcctgctcagggcttccttctgcatccctctagggaatgtgcagaatagcctgaggggctggaggggaggcccaaggcagggcctgcacggtatttcccactccttccccactgtgaggatcctggcctctggggagaatgggatatgtgatgttcctcccatcagcgcagctgaaccctccctcaggcccacaggcccagcagagggcccccaagccaggggctggcaccccccatgtgggtcctgcaccccggggtggcagtggtgagaggccgccttcccagccttgctctgtgggaaaagccgcggctctgccatgtctgggcgagagctgcaggaggggccagcttggggccaattcggcatctctctctccattcccagagctcccatcctcacagcatcccagagaagcagaagaggtggcccctgtcctgcctcttctcacccagcgaggacagaagctcagggagggctggccctgctgccggccactgcgtgagaagcagctgctctgtggagggggccagactgctggggggagttgctgctgggagctctcagatcagttcaagcagtgatgtccttgcccttcccctgccccccaggccctctcattctcagggcatggccacagggattggtctgggtggggaggccacagtggaccctgccttcctgtagatttgggacttgggatgcccagatgggagggtgcacctgggcaggcctggtcaccttgcactgcctgggctgtagcagctcagtgcctagcggacactggccctgcgcccagggtcagtcacggtcagagccggggattgttgcaccggggctgtgtgtgctgggagtcatacctgccacacccactccaccaactcagaagcttgtgtgtgtgtgtgtgtgtgtgtgagagagagagagagagagagagggggagagagagagagagagaatggcttgcttctggcactgtgagccttaaagcttggccaggaggctggggctgggctggggatgctgagctggaagggcaagtgttctctgctggtcaccatgacggctgtgaaggctcaggcggggctggggtgagatgtcgggggccaatgacagaaggtctcctctcctgctcactgtgagcctcagaggcttggttgaggaggctacgtggactctgcggtattacccttctgcctctggcctgccctgacccagtcccttcttccctgtccctgtctgtccctcccacttcccacagaggctttgcatctgaaccaacagaggaagcaaagtgaacgttctcctctggagaattctcgccaggagctctctggaggacagcagataacagagcctggcacaaggggagggaggaggcgcatgcctaggttgctgtaggcaggggctgtgaaattgtccctgctctctagaactgcccctctggggaccaaggcaccgtccctaagtgccacgggagtctgaggatggagggccacctgggctgctcatggaggccctctgggtgcccagggagctgtctggtgctctggagtgctcatctggagtgctcaggttagaagaggcctgggtggcaggggcctgcctgaagcagcagcctgcagcctgcgtctcctgtcccaggctttccctggtcctttttgtctctggggctgcacacctgtggggcttgcactcacctgatcttgcttttccggcccctgcatggtagggagtttgccaaggagcgagagagggtggagaaccgccgcgccttcctgaagctgcgccggcagcagcagatcgagcgagagctcaacgggtacctggagtggatcttcaaggcgggtgagggcccgtgggagccactgcactcctggccggccactgttagttctctgtccccaattctgctctgctgccagctggggtgccctggctgctgggtagagcctgaagggattttgtagtgagcagagtgagaagggatttctctctagctcacccaggggcctggcaccaggcagccatatggctctgaggacagtggccttttaaatggaggactctgccatggcccagcctaaagctggtctctccccattagtgtcagccaagtcccttctgtgccctgactctgggttttgtcaagcctggactccctcccctcgccccaggccagcactctttcctccacatggggcatccactcacacctcctaaggtttcccaagtgcctcttcagagatgaactcgcctgtggcacagctgttctcagggaagcgacgtgtgggtagggacgggcagacacaaggcggctgagtcctcttcacaggggactgtctgtccctgtagaaaaagctcagctgtgggccctgctggcttctggaagtctaagagctgataaggcagccaggtgcagtggctcacgcctacagtcccagcactttgggaggccgaggtgggcggatcacctgaggtcaggagttcaagactatcctggccaacatggtgaaaccccatctctactaaaaatacaaaaattagccgggcatggtagcacgtccctgtaatcccagtggggaggctgaggcaggagaatcgcttgaacccggaaggtggaggttgcagtgagccgagattgtgccactgcactccagcctgggtgacagagcgagactccatctcaaaaaaaaaaaaaaaaagagctgagaaggcagggccttccagacagagatgtgcctctgtcctggggcattcctggggtcaggagggctctgacctgaggctgtgttcccctcgcagaggaagtcatgctggccgaggaggacaggaatgcagaggagaagtcccctttggacggtaggtggcacttgctggtactcctgtgtggtggagtgctctggtggccacgtgggtggtgacacgtgcctgcttgcatgtttcacgcgaagtgctcttggcagtgccaggcacctgcacagccatcacatgaacacagactagggccatggtgtctgaccctggcacctgacacaggcccacactgcaggtttaaaccgagctgtgtctatccccagggcttggggtgctgctgctcccagagaccatgggagggctcatggcacaacctggggccatgagagggagcccgggccccactgctgtggttgctggcactagttaccagcatagctgcagcagcaggaaggctgccctctctgcacacccaccgctcaggtcagggccagacagcatgggcacttccgtggcaatctcagccggccccatgcctgcggctctgagcaggtctatgctgtccctgttgtagtcctggccttgccccagatggacgtttcctggtctccctggtggccaggcctccccactggcctcattttggaagaaagggaaagcggggacccctcaccctcaaaattccttgtcccttcagctctggggactgggagggacccaagggggcccacaatcatccggcctcagccccagttcaggacaggagctcaggagaggtcactggtcccagggggagggtgatcccatgccccgctgaggcaggtggcctgagggctgcagctcaggcagtctctcccatcctttgtttaaagcagtgctgaagagagcggccaccaagaagagcagaaatgacctgatccacgcagaggagggagaggaccggtttgcagatctctgtgctgttggtgagtctcagggtgtccctccagctctgccaggcttgagctggacatggagtgcatgctccgcttcccctgctacccagccactgttggacgccccttcttgcccaaacgcctgcaggctcctttcagacagtttgctgctcctggctttgtgacccccatgtggacatagggcccttagccatatcccaaggctggaggactctatagggccacctctctcttcagcccctgtctctttttcactttctggacctgctgcctctgaggctgttgtgtcatcccctacctctcaaatagtacaaggaacattctggttaatttatccaacagagctgtgtcggttcccttcctctctatctggtaccagattctggttccagaagtgcctgggccttgcttcattttgagacaccaagtcagatccaatctggacttccttgctgtacagcagtctgtgagtggaccagatttagaagatgtctaccattatattgttacatgtatgagacagaactctttaataaaacaggaaacacacacacactcatgcgtacacacacatacacttaaactggaccttttctgtcctcactcagcactaggaaactcctgttaacaacttccaatgtacccttccctatttctccatgctcacctcagataacacacacaaacactcatacatccacacacaaatatgcatgtagagttttggagtcttctgttacaaaaatgatttcatacaaacttttctcaccagtccctttcctaatctgctcctaatcaatttgtctgattctagccccccttgtcgggtgcaacctggcgttgctgatgtggagtcactggagttgttcagttgctcgtctgctgatcgtctgctgatggccatttatttctagtgcttttatctcactatgaaaaatactgcccccaagtctttgtgaatggctgtccttcctcactagtgcttttctctgtggggcagattcccaggagcaggtgctgagggtaagggtgtggtactgttcagagttctgtgcgaccccacattccatccacagtacaggccaaccttcgccctcatccagtgctatgtgacggctccttttgatttttcccagtttgaggccaatttgatgagtgtagagtaatatttctttggcactacaattttcctttctcctactgtccgtgatgctggccctctttctaaatgtttgttccctgtctggacttggcctttggtgactcttcccatatgctatacagttttctagtgagtttgtttgtaaattattttgtatttattttgacaataatgagataccaatgtatatcatagatctgaatgttttatcatcttataattttattttatttaattaatttttttttgagacaaaaatttcgctcttgttgcccaggctggagtgcaatggtgcaatctcggctcactgcaacctctgtctcccaggttctagtgattctcctgcctcagcaacccgagtagctgggattataggcatgcaccaactgcccagctaattttttgtatttttagaagagacagggtttcaccgtgttggcctggctgttctcgaactcctgacctcaggtgatctacccaccttggcctcccaaagggctgggattacaggtgtgagccaccacacctggtccatcttataattttaaacaatttattatatgattgtggtagctaaatagtttccttctattgctattttatctagagtttttattctgattttgtaaaatgaattgaagagttaaaatgtcttcatctatggtttggaatcctttaaataacactggaattatctttttttatagatgagataaaactgtgaatctatataatccaaaaaagaaaaaaaaaaaggatttggaccagtgttgtgacttaggctttgttaggaaatcgccccgttctcagggtgttgggatccctttctgtggcgctgtgcaccggctctctggcgattctcttaacctcgcctgtgtcgagtgcttgtgcctcattcagcagatgtctatccagtgcccgccacgtgccagcaacggaggcatgggggccgcgacactggagaaactcctaataaaggcccttcatcattggagtttccgtccagtgggggcatcaaacaacaaataagatagtaaggaaaataggccgcatgccagagcccctgtccggaggaggaagaggtcaggaaggcaggagtggaagcgtgtggagggggggcggtgccagaagttcatggccatagaaggcctgaggaaaaagactgcctttgagtaaaagagttgcaggaagtgaggacgcctgagggacgccggggcgggggagaggggaggttggcctgagggaagccaggggaggggaggtcagcctgaggaactactctcaggccgacctggagagagaggggagcttggcctgaggaacgtgtgtggcggggagggaaagttggcctgagtgagggggagggggagggaaggtcggccggagggaagccgggagaggggagttaggcctgagggacacccggagagaagggaggtccggggagaggggaggtcggtctgagggacacggggcgtggggtggcgaggtaggggagcgggaaggggaggttggcctgagggacgcggcggtggggtgtgggggaggttggcctgactgggggggagggggaggggaggtcagcctgagagacggagggggaggggaggtcggcctgaatgaaggacacccaggagaggggagatgcgagacgccgccagggaggggaggtcagcctgagggatgcccaggggagagaggggaggtcaggggagaggtgaggtcggcctgagggacctctgggaaaggacattccaggcaacgagtgccaagaccctgaggcaaggctgtgcttggcacccaggtgtggagaacgtcttggaggccagcgcggctggagtgaggtgccatgggctgtcggtagcggtcgaggaaacctgagagtcagacaggctcacttccaaccgggaccccaggccgccctggtggtttgcagaggggtgacaccctctggcttctgtggtataagggtctctctggagactgtgtaaagtgttcctttttctccacaacctctccatcatgtttgttttgttttgtttactttttaataatagtcattctgattggggtgagatgatatctcattttggttttgatttgtatttctctaataatcagtaacgttggttttttttcatgtttgttggccacacgtatgtcttcttttgagaagtgtccgttcatggcctttgcctactttttaatggggttgtttgttctctcagcaccgtttattaagtagggtattctatttaataatagggaatacatcctagctttattcctaggtattttatttttatttttttgtggcaattgcaaatgggagttcatgcataatttggctctcagcttgcctgttgttggtatataagaatgctggcgatttttgaacattgattttgtatcctgagacttagctgaagttgtttatcagcttgagaatattttgggctcagatgatggcatctgcaaacaaagatggtttgacttccctttctatgtaaataccctttatttctttatcttgccagattgctctggccagaacttccaatactatgttggataggagtggtgagagacatcttgtcttgtgcaggttttcaaggggaatgcttccagcttttgcccattcatgatgatattggctatggctttgtcatatatgtctcttattattctgaggtatgtccctttaatatctagtttattaagagtttttaacatgaagggatgttgaattttattgaaggtcttttctgcatctattgagataatcatgtggtttttgcctttagatctgtttatgtgatgaatcacatttattgatttgggtatgttgaaccaaccttgcatcccagggatgaagcctacttgattgtggtggatagattgtggtggataagctttttgatgtgctgctggatttggtttgccagtattttgttgaggatttttgcatcaatgttcatctaggatattggcctgaagttttctttttttgttgtatctgtcaggttttggtatgaggatgatgctggtctcatagaatgagttagggaggagtccttcctttacaattgtttagaatagtttcagtagaattgataccagctcatctttgtacctctgggagaattgagctgtgagtccatctggacctgggctttttttgattggtaggctatttattactgcctcaattttagacctcattattggtcttttcagggattcaatttattcctggttcaatcttaggaaggtgtatgtgtccaggaatttattcatttcttctagattttctagtttatgtgcatagaggtgtttatagtattctctgatggttgtctgtatttctgtggggtcagtggtgatatctcctttatcatttctgattgtgtttatttgaatcttctctcttctctttttttttagtctagctagtggtctatctattttattaatttttttttttttcaaaaaactagctcctgttttcattgatttttttgatggatttttcatgttttctatctccttcagttcagctctgatcttagttatttcttgttttctgctagctttggggtttgtttgctcttggttctctaattcttttagttgtgatgttaggttgttaacttgagatctttctttttggtatgggcatttagtgctataaatttccctcttaacactgctttaactgtgtcccagagattctggtatgttatatctttgttctcattagtttcaaagaactttttgatttctgcattaatttcattatttacccaaaattcattcaggagcaggttgttcattttgcatgtagttgtgtggttttgagtgaatttcttaatcttgagttctaatttgattgtaccatggtcttagagactgttattatttcagttcttttgcatttgctgaggagtgtttgacttccaattatgtgatcaattttagagtaagtgttgtgtggcgatgagaagaatgtatattacgttgtctttgggtggagagttctgtatatatctatcaggtccacttgatccagaggtgagttcaactcctgaatgtctttgttgattttcagtcttgatgatctgcctaatattgttggtaggttgttaaagtctcccattgttattgtgtgagagtctaagtctctttgaagtctccaagaacttgcttcatgaatctgggtactcctgtattgggtacatatatatttaggacacttagctcttcttgttgaattgaaccctttaccactatgtaatacccttcatcatcttttttgatctttggtgatttaacgtctgttttgtcagaaactaggattgcaacccctactcttttctgttttccatttgcttcataaattttcctccatccctttattttgagcccatgtgtgtctttgcatgtgatgtgggtcttttgaagacaacatactgatgggtattggttctttaacctgcctgccattctgcgtcttttaattggtgcatttagcctatttacatttaaagttagtattgttattattattattttttgagacagtctcactctgtcgcccaggctggagtgcagtggcgtgatctcagctcactgcaacctccgcctcccaagttcaagtgattctcctgcctcagccttccaagtatctctgggactacaggcatgtgccaccacacctggctaatttttttgtatttttagtagagatgaggtttcaccatgttggtcaggctggttgaactccagacctcaaatgatctgcctgcctcggcctcccaaggtgctgggattatagtcgtgagccaccatggcccgcctaaagttggtattgttacgtgtggatttgatcctgtcatcatgatgctagctggttattttgcagagtttttatgtagtttcttcatagtgtcactggtctgtttacttcagtttgtttttgcagcggctagtaatggtttttcctttccatatttagtgcttccattaggaccccttgtagggcaggtctggtaataacgaattccctcagcatttgcttgcctgaaaaggatcttatttctccttcacttatgaagcttgatttggccagatatgaaattctggatttggaattcttttaagaatgttgaatattggcccccaatctcttctagcttgtagggtttccactgagaggtccactgctagtctgatgggattccctttgcaggtgacctggcctttctctctggctgcccttaacattctttccttcacttcaaccttagagagtctgatgattatgtgtcttggggatgatcttctcatggagtattttactggggctctctgcatttcctgaatttgaatgttggccagtcttgctaggttgaggaagttctcctggatgatatcctgaagtacattttccaacttgttccaatctccctgtctctttaagttatcctaatcagtcatagattcagtctctttacataatcccatatttctcagaggttttgttcatttctttccactcttttttctctgtttttgtctgcctgtcttatttcagaaaaattgtcttccagctctgagattctttcctctgcttgatctgttctgctattaatacttgtgattgcattgtgaagttcttgtagtgtgtttttcagctctaacaggttggttatgttcctttctaaactggctgtattggctatcagttcctgtattgttttatcatgattgttagcttctttgcattgggttaccacatgctcttatagcctcataagtgaagttcattattacccaccttctgaagcctacttctatcatttcaacagtctcagtttcagcccagttctgagcccttgctggagaggtgttgtggtcatttggaagaaaaggggcactctggctttttgagttttaagcatttttgtgttgattatttctcatctttgtgggcttatccacctttgatctgtgaggttgctgacctttggatggggtttttgtgttttgttgttgttgttgttttctgtttgtttgctttccttttagcagtctggcctctcttccctagggctgctgcagttttctgtgggtccactccagagcctagttgccttggttttccctgtacttggtggtatcgccagtgaaggtcgtgaaacagcaaagatggcatcctgccgcatcctctataagctttgtcccagggggtgctgacctattgctggcctgaatgtgcctgtaggaggtggctggagaccccagttgggaggtcttacccagtcaggaggaatgggatcaaggacccatttaaagaagcagcctgactgctttttgatagagcagctgtgctgttttggagatgccttcgttccctgatcagtttgagctttccaagtcccacaggctggaatggctgagaagcctgaatgaccaaagtggtggcctgccctgcccctcctgtgtcctgtgtttaaaagatattggattataggtatatttattaaaatcaagtctattggccgggcgcggtggcgcatgcctgtaatcccagcagtttgagaggctgaggccagaagattgcttgaggccaggagtttgagacaagcctggacaacatagtgagatcccacctctacaaagaaattaaaaacttagctgagcatggtggtgcatgcctgtagtcctacttcattttatttatttatttatttatttatttatttatttatttatttaagacagagtctaaccctgtcgcctaggctggaatgcaatggcatgatctcggctcattgcaacctctgcctcctgggttcaaacgattctcctccctcagagggattacaggcacccaccaccacgcccagctaatttttgtgtttttagtagagacagggtttcaccaggttggccaggctggtcttgaactctgacctcatgatccgcccgccttggcctcccaaagtgtggggattacaggcgtgagccactgtgcccagctcattttattttttatgaagttcctcttgtatttctagtgacttttgtttatatatttagtcactgtatagtttgggcaatataaagtttatgattgttacatcttcttcctaaattatgctttatttcatcacacagtaccttcttaatctgtgcagttcctctgctggacagttgcaccttgtcgacattgaatgtcattggttctactttttgttgctatcactggttttggtttttaacttgcatttgcctggtacctttcttttcctttcatttccagctcttctttatcattttaagtgttcttgtaaattgtatttacctgggttctgccttttaaatttttttttttttttttgagacagagtcttgctctgttgcccaggctggagtgcagtggcgcgatcttggctcactgcaagctctgcctcccgggttcatgccattctcctgcctcagcctcctgagtagctgggactacaggcacctaccaccaggcctggctaattttttgcattttgtttagcagagactgggtttcaccgtgttagccaggatggtctcgatctcctgacctcgtgatctgcctgcctcagcctctgaaagtgctggggttacaggcgtgggccactgtgcctggccaaaattttttttattttttatttttttaatgagacggagtcttgctctgtcacccaggctggagtgcagtggtgcgatctcagctccctgcaacctctgcctcctgggttcaagccattctcctgcctcagcctcccaagtagctgggactacaggcacgtgccaccacgcccagctaattttttgtatttttagtagagaaggagtttcaccatgttagccaggacagtctcgatctcctgacctcgtgatccgcccgccttggcctcccaaagtgctgggattacaggcgtgagccaccgcacccagccaattttttaaaattttatttatgtatttaagagacagagttacgttgcccaggatgatcctcctgtctcagcctcctgagtagctgggactataggtgtgcaccaccatgcctggcttggtggttttgcttttttttttttaaaaaaaaaacccagttgtatggtgtctgtttctaatggtaacgggtgaatccagtctctccatttagtataatgtttgactctattcttcatcccaagttctgctgctttaatcgagttgctgtttattgctcctctcctcccttgcttatttttactctctaattcttctgttccacaaaaggttgccttcccttccctgctctcataattgtcaacgtacctctttactgtttttgtttctttagcatctttagtaccaagatgtactagttccatcactcaattggtctatttccctttattctgcctccacccatacccagtaagtcacagcctttccagtacttgccctgcctccgcatcctggtttgagggtgttcacttttcattcttgactgtcgcccgtcccttcagactgcccccacaggctcccctatgcccaggggccctcagctatcattcccgtggcccgctctcagagccctaacctcagtcacctaggtttaccttagcatcttctcttctcttcagtccttgctcactgcaggactgtctcctccgttttaactctgtcctgtcactcggctgctctcccctgaaatgaatgggggtgttggtggtggctgactcttcgagttcctgtgtactctcaggtgcccttccttgttccccactgaggagcgagatccaggctgctgtgcccactgcaagtgtctctctctctcatttcctgttgcacatgaggcatcggacactcggatgcttttcctttgtcagtgacttgctctctgtctgcccctcaaactgcaggctcagggcccctctggcgcggagtgcttccctccgtttgtctcattattctgtctccttttcttgatctcctgcatctggagcccctcctgtttcacgtggtgttgcttgctctgctcctgtcagtccatgccctcttccttgagctcgcgttcacctccacgttggagatgctgcttgcgcttgactgaactcccctttttttcatctgctgagtggtttccgaagagaattttatttcttctctaaaagtttttttctctctcttttagttttgttttattttgagttatgtgttgctatacttggatctctgggcctttgttgacttttccttctgggtacccagcagacaccgaggattcacttacattcaggacccactggcctccactgttggttcagggtgggcttggggcctggggcctggtggggaggagacgaagccgtgcttgaatctccacattctcagcactgcttggtgccctcgactgccttctgcctgaggactggctgtgtcaccaccccaggcttgcccataacccgtgtcaccctgtcggccctgacgccttgtcagctggttgagccccgctgagcttggccctgtgctgtctcactgaatcccacaccaccttgtgaggtacaggtgactgtgctctgttttcagttgaggaatctccaggctgcgtgatgtgcacgagggccaggggtgacagccattagggcctccatcagctcgtgctttagcctcacgtcacttttgttgcccccagtggcaaatacagcagctgcactggaaggaaacactttcttgtctgtctccccactgtcctctagaagggttattgagaacagggatggatgttggtcattttgtgttttctgggctttggtcagggcctggcacaatttgtacacattttttgaacaaatgggggttacccaggactagcaaagagtctgccttagggcacaagagaaagaaatctaagtatttgcagcagtcaggccctattctcagcagtacttcactgtgtcatcattcataggttaatgtaatatggaatttctccctagcttgaagatgtcctatcatttttcttgaaataagctttttcattataaagaatatatgctaattaagtgaaccctggaaaatgcaggaagctgaaaagaagcccagtctctcttggttttcccaaagctgtgattccagagatgtttccgcgtttcctgtagactctctgcttttactggagcagactggagtccacagtggctgcttgctgtccttagggacctgtgcctcatccccggggaacaaatgcatctgtcttgggtgctgctggggttgctgagctgggatgtgaggggctgcacccagctctcccccagggcgtctggatcaggagtccctctgttaggtcttgctcagtcccctggctctggcgcctctggcttctctaaagtcgatgtttacagcaaggaactggtggactttaagggcaatgtctggggagtgtggttctgtgcaaatacggctgttggcatgactatggttgtgcctgtgacaggcgaggatgtgtgtggttgtcttgtgttgtgtgcacaggaagatgtgtgtgtgtggggggctgtggcccattgtgaaagggcagcatttctatgaggcctttctcatagcagaggctgactggttcttactggctggtggggatggccacagagtcccctttggagaatttgttgcttgtcttcctggccacgtgtgtgtgcagacacagtgggtttacatgagtcacgtgttctctttccctccttcccagagtggccctgtttgtgtccacaggtgtgtgcctcatgtgcactgaggagtgtgtctgtgtgagcatctcattggatcttcaaaagtgagcgtggtcaggctggatgtgtgctgtgaagcatgtgcgtgtgtgactcctgtgttcctgcacaactgtgtgtgggtgcatggggggttcagagtgtgtgggcttgttctgtgcacagctctgcctgtgtgtgtgcccctccttatctgcattgcacacctgcctccctcctgccctactgctgcctctgtggggagtggtcatccctggccttcagcagggctggccacatgccactgagagcctgggtgtgcacatgtacacacatgtgtacaaacacacagaaaatgcacatagcacacgagctatgagagccactgagagcctgggtgtgcacacatatgcatgtgtgtacaaacagaaaatatgcatagcacacatgcccacactgcccctgctcttttgtgccactgagaacctgggtgtgcacacatatgcatgtgtgtacaaacacacagaaagtacatgtagcatacactgctccccacatcctcacacagggaccccatgctcaagcccaggtattcaaagcccactgagagacccatggctggggcacagctgtctgctctctgagaacactgagaggcacccacatggccaggcttagtgcacaaactaagaaacccttacacaggcagatgtgctctcctgcagagacacagccagctcctgtacagacacacctgaatcctcatagagacccttccctcagttgttaagcattgatcaagcccctctcagtgtgaggggctcagtggtgaagaagacaatgtggccctgtcctcatggagcctacagtcttgtctgggagttgggcatggaacaggtcaacaataaaacacagtgacaggtggtgatgtggtcagggccactgtcggaggtgagccgagggccctgttctaaatggtgtgcccagagcaggtgctctgtgcaggtgacgttaatgctgagacttgaaagtgtgtgggaaggagtccagtgagggacgcatttcacacttgggatattgtgtgaagggccagggcacagcaggactggtgtgcgtggacatgggaaaaggctgctgggttgggtggtgagcagggtagagaagcagtcaggctggagcaggtagacaaagtttccaacagtaagtattgtggacattgaacagccatggaccatgcgtaaaccgatgagcttggctgtgttccaggaaaactgcttagaaaacaggcagcccatgcgtgctgacccctgagtccggagggcgagagagggagggccagatgctgcagggctctgtgggctatgctgaagagatgggatctggggagggactaactcagatttatgtcttcaggggaaaaagcttggggtgctcatggagagtggcctgggggcatcagggctgtgctcctagaaggtggctggggatgctggggaccagagaagtgagtacagatcatccacttcaatctggctctcacatctggcacccagtaaccatggagatcatcagggccttggttccctcagctgtgaagtggaggtcacaggggtcactggcacaattgtctgtgaccggctggggctgggggcaggtgtcctccagagtgcgtctgtgggggtccacaggtggggtaggcgggtgcccattggtccccacatcctcagtaactccccatcccctcaggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtgtacgtatccccgtccctccctcaggtgcttcctgagcatctctgctctcagtctggaaaccctggtccatgccctggggctaccccaggtgggacgggacccacccccatgttgctcaaagtatcccacagccctagtcagcctccaggagcctctgtgggggcctggggtgtgtccagagctggagggtggcctctccagcccctgggttccagaaagcacagctggatctgctagacccctgtccctcagcatagtgtgagactggttgaggggtccgaggcacccagggcaggatatatgtgggacgaccaggggcgagtcaggccaggcagatgggtgtcctcccctgagagggcttcagacccacagacaggggacttagccccacgctcctttccaccacgtggctgctgattctgccccgggttcctgaggggggagtcctggcttcttaccctccccaggttcccctggttaccttcatttttctttacaattggctaaatctggatgcattcatgcccttccgtggagtgagctgtttgcagttctgttccacaagcctcagcacaggggccaggatgggcccctccaggcctggtctgtcacagcctcggactctctgtcccatgtggaatacagcattgctctgtggtcttacttcacaaacaggatcaaaaccaaagagtccacccatgttttatgtcctttcaggtagtgattcagccctcctgaccccaggggtcagctgcactcaccctgctgggtgtctacagcggatctggagacagggcctgtttggggctccctggagggcctcagtctccccttgagggccctgtttgcctgaagctgccgaggcacccaggaaagccttttccgactccagagaagagctatcccagctcccagttccagcctggctgtcactgtgtcctgctgtcacggtggcctcaccagggctctagccggccggctgagccctgctctgtagaccagagggcctcacctgctctgcccaggagtgtgagggttccctgagctgcaggatctgacagctccacagtgggagagatggggctgcaggtcacctggaagcatgggtgggagagtggctgtgttggggtggaactctgggctacagtttcccaaacttgacattgaaatctacgacttccgaacggggagatggtgcggaggggcagaagcaaaaggagccaagagagctccggctcaggctccctgggcggctgcaggtcgagaagcagcttgtgtacatggaactgcctgtcccagctcctgactgacacgtcctggggcccacagggtggtacctcgggactttgcttgggcctgagttcagtgtctctcttgagtcctccggctaaggttttcccacccttgggggtcaggtggggaccaaggacttcctcctgacccagtgactaggcctgttcttccccgtgagaggctgttggtgtgcagtgagtcggcaggcagtggggtaggggtagggctgcacagcccagtcgcgcatctgctgtgtgcgagcacagggctggcagtgtccaggcgttggtgaggccacaggcatccctgaccgtagaccgctactgtgtcttctctgtggtttcctggagttcctggcttcattgtgtcactgagggaaaaatggctggagggaaatgtgggcagtgtccctgacagccgggctgggcctgagggaggcttgctcagtaggtaggacaggcttgccagaggcgagggggtgtggccgcccagcctagagcagctttgcaggggctcatcgtgggttctgtgcacctcggctgtccattctccaaggacctgccctcaatgcattgccagaaccttcaaaattgaggctcgagtggttaagaggggcactgtcaggacttgccatcctgtgagcccctggggggccttatgcagctcaccagacttgctcaccctccctctgctcccatagcacaccatcctcttggaagacaaaacctggttttagtgatctgtctctgtttccccctcagcttgtgaactcctggggagaagggtgaactctgtccccatgctggctcaaaacagcaccagtgcctgctggtaggatgcatgatacaagagtgtacgaatgaatgccctttctgggcctcagagtggaggctgagtatgtgaggctgagggcctctgttcctagggagagtgagagggcagacaggatgttggaggatttcagatctctttctctgaaagttttaccgtttgcatttcttgtacttgttccttgcaaagtgctctcactttggtctcctggggagcaaggtgtgtgcctgggtagcctcccctcccagatctagggtgtgggtgccagcagtcccatctctggggcctctcctccctgggtccgagcccctcgtgtggggagcccgaggcctttgtgacccacgcagaggggctctgggactttgtggccaggcgtgttgggcctttccaagctgcttgtgtattcccctgggcttgctggggtgctctgcactggactgcaggggtcacggctttcctgccacatctcacacctggtggtctgcacagccaggcccaggtcagagctgtagggtccagtggtctcagttgagggtggatccttccattcccgagcagccctgcctgagggtcgctgggcatccatgcctctcacagggggctctcggcttctccagggacactgcttggccttgttatcatcccatgcttagcttgagtgcctggtgattttctggctggtgtcagaggccaggcttgctacaggtgacttgctccaaggaactggttgtccatgtcctcaggccatacaaagtggggtgtccgctccctgagactcctgtctgtttgtacggtgcctgagtggtctgtgaagttgtcatctctgcttatcccaggtctgggctgctgcagacttgcccccgaccgaggctgtctggacctgtgcagcacagcccttggtggaggagattttaggagcataggggtgggaagagtgtgtggccccctcttccagtgtctgctttatcagaagttgtgtctgctgaaggtcccgtgtcccaacagagactgtagagggggattcagaagccctgggaaggccgagctggactctgcccagttgtggactctcaggggcctgcccttcatgccctcccagggccttgttctccatgtgggctctgccctgggctctgttgcctccctagcccctgctgacctggcagagccatggtgcctttggcctgaccagcactgtgagaagtttaagagccaatccctgcccaaccctttgggaggagagtcagagacagtggcctcaccctgacgcctaggactcctggctcagccagcggctgggcctcgctgggcctcctgctgcctgtggcctcacccagctctggagccacggcgttcttctgtgctgcttccctctttctgcttgggctgggtgagcaagagtctgtgtaccttgaattcccagcacagccctctagccccagcatggcctccctcagtactgaggcccggaagggtcagcaggacttctgagcccaagacagcccccctccactgctgctgtgcccgcaggaacctctgtgtgacttggtgacagtgcaaggggacagtgcctcttggcagcctcgtgctggagaggagtgcagtggtggaggaggtctaccctcggggcagcaaacgtgaacagaatacaagtcagccacagtgccgtggacattgtggggagaggcgtctttccactgggaagtcccagtggaaaggtgggagattctgacaaggaggttgagggaccccaccttcggtcagagattggggtgaggccagaggcggaaggaccagctggaagctgtagctgggcctctccttggggtaaatggggccctttgcctcatagccccaggacctcctctggtgaggagggggcacccccatgaccccagaactcacacctgggctgatctcgggagcttgcctcctgctgagcccgtccttctctgggtctcagaggcactagggactcaccacctttcagactggaacaggtacctctccgtgtccctctgaatccatcgttcctttcctaggctgagacttcagagcataggaccataggccaggcctggaaggctcagccctgggaaggcccagaggtctggtgtcctccagtctgggctggagccagagtgggaggaggcctcgagctaatccccctcttctccggcttctcctagattttgcagagtttgttttcctgggtctcttcctcacagagatgtccctgaagatgtatggcctggggcccagaagctacttccggtcctccttcaactgcttcgactttggggtgagtgagaggcctgatcaggggcccaggctgtatcctttcctgcaggtgcacacagccccctcccataggccatgcccagtgtgggctggggtctgtgaccctacatgggtcagaaaggctgcctgaagacagtgaggagcagggggctggcagcgggaggcctgtcctggcggggcctgactgatgggagtgtcagcctcagcagctctctgtcggcgggaggtcacccttccctcttctgatcctgtccatagattttcataatcagctgaaggctctgcagctacctccatgcctgggatctcgcaaacctgtggagggctcagtctctccccagtggagctcaggggggctctggccctgggcaggcttgggtacatccaccagcacttctggggttggggcacgataggccatgatggtcctgccctctctgtgaggctgggggaggtggtggccctggcctgagtctctttaccaacttatgtaggtagggaggccttggaggcagtgtgtttcccagcttaccatgacagttgaacacagacggcagggcagggcagtctgagaattaccaacttatgtaggtggggaggccttggaggcagtgtgtttcccagcttaccatgacagctgagcacagagggcagggcagggcagtctgagaattaccaacttatgtaggtaggggaagccttggaggcagtgtgtttcccagcttaccatgacagctgagcacagagggcagggcagggcagtctgagaattaccaacttatgtaggtagggaagccttggaggcagtgtgtttcccagcttaccatgacagctgagcacagagggcagtgctgggcagtctgagaattaccaacttatgtaggtagggaggccttggaggcagtgtgtttcccagcttaccatgacagctgagcacagagggcagggcagggcagtctgagaattaccaacttatgtaggtagggaggccttggaggcagtgtgtttcccagcttaccatgacagctgagcacagagggcagtgctgggcagtctgagaattaccaacttatgtaggtagggaggccttggaggcagtgtgtttcccagcttaccatgacagctgagcacagagggcagggcagggcagtctgagaattaccaacttatgtaggtggggaggccttggaggcagtgtgtttcccagcttaccatgacagctgagcacagagggcagtgctgggcagtctgagaattaccaacttatgtaggtagggaggccttggaggcagtgtgtttcccagcttaccatgacagctgagcacagagggcagggcagggcagtctgagaattaccaacttatgtaggtggggaggccttggaggcagtgtgtttcccagcttaccatgacagctgagcacagagggcagggcagggcagtctgagaattaccaacttatgtaggtagggaggccttggaggcagtgtgtttcacagcttaccatgacagctgagcacagagggcagggcagggcagtctgagaatcttctggattctcagaccccgcagggagcacaggacacttcctgggacctgaacccagagcctagggatatggcactgtcggcacctgcccagaggctgagttctgagtcttcctgctggaggctgggaatgatgggtgggcacgccgccccctgagggaggagggaggagtgggagtaagtactccctccaagtctttgtaccagagcacttcaagccctcccgtaaggagcaacaagtgggagtgacaaggagtgatgagtgggagcattgcccctctcagggtggagtgaagggtgggagcagagtcccccaggaaggagtaacaggcgggtgcactacccccgcaggaaggagtgacaggtgggagcactaccccccccaggaaggagtgaagggtgggagtactaccctccctcccaggaaggagtgacaggtgggagcactgcccccccaggaaggagtgaagggtgggagcactaccctcccccccaggaaggagtgacaggtgggagcactgccctcccccaggaaggagtgatgggagcactgccccctccccaggaaggagtgaagggtgggagcactacttcccccccaggaaggagtgacaggtgggagcattgcccccccccaggaaagagcaacgggatcactactcccccaggaaggagtgaagggtgggagcactaccctcccccccaggaaggagtgacaggtgggagcactgcccccccaggaaggagtgatgggagcacttccccccccaggagggagtgaagggtgggagcaccacccctcccatgaaggagtgaagggtgggagtactaccctgccccccccaggaaggagtgacaggtgggagcactgcccccccgagaaaggagtgaagggtgggagcactaccccttccatgaaggagtgccctcccatgaaggagtgacaggtgggagcactgcctcctcaggaaggagtggggagtaggagtgccgccccccaagggagggtttggagctcggcagagtttacaggagccagagaggggcctggaccgtggtagtaaagcttcagttagaaaattcagcttaattggactttttctctcatgagcattgtacttacacaggtggtagacatttgtgtctgtgattttgttgaatcctcacaaggactctcattttactgatgataacggcagacattgtgtgactggccccaggctgcccatcagtttgagaggagtcagtgggtgagcctggctttctggcctcgggggtagtggttttgcatcatgctgtgcttctgatctctgaggaagggaaggcagtggccatccagggtgctctctgagacatggagacctgtgatttcagtagacagtgggaagacagcaacccttcttaccctttgacttcttggtcacaaagaaggtctgagtgcatcggccaagggagccgaagagatggaggcgtcagagatgcagggatctttttcatgtcttccaatcttctgatctgaactgactggatctcaggacatggggataatttgcacataagctaacacattcttctaacacttagcagctttaaactacaaaaatctgtctcacatttctatggcttaggaattcaggtgtggcactgggtatctctggcgcagggtcccccatgaggcttcagcccagttgaaggccaaggatatggtcattccacggcttgactggcactggagaatctggtgtcaagctcatgcatttggttgctggaacgccgagttcctggtcatgtggcctctccacaggctgccggagtgtcctcagctgtggtctgagggagagaactgagagtatgtacataagacagaagttatagaaaccctgtcttgaaagaaagatcccatcagttttgccatagtcttttagttaggagtgagtcactgggcccagtgactgggccggggagaggaatatatgggggcaggtattatgcaaggatgtgaacaccagacagtgatgaccactggggccatcgaagaggctgcttgccacagcctgccctctggctctcagtaactcatatccttcccattgtaaaacaccttcaccctgccaactccccaaaatcttatccattacagtatcagctcaaaatccagaatctcatcctcagttaggtccaggtgtgggtgagactccttcggtgtagttccctaagtgcagtggctgcggtacctcttaatctgttgacctgtggaactagagagttatctacactcaacattcagtgtgcagtggtaggatgggcatagggtaactgcagtagatattcctgctcagcaaggggacaccaggaagctgagccactggtccatagggattctgaaatccagctgggcacatgcgggaaagtctgggattcattgttacagacaggaagccctctgggctcttggttctgccctctcactccctttgcttttccatgaaaggtagttcaggttttcagctgaatggttttctcagcctacttcccactggcagaattttgggaatctaaagacctattttcgttttgtattgtcttgattctttcagtccaagttggtgatgtctctgcatatatgtcctctaagaactttatggatatgttgtgaagcttggggttcactttattattagaaaaaagctctacccacacctattaggccttagaccttttctgtctgtgttcctgttgaaatgctaagggtcaacacctccagtgtcttagagaagttcctgcttcattgaccagatgtgtgaggcaccctcaatctctttgaagagcctgaaagtgtggctgagtagtgctctgaggcaccacctttgatcgttttgggatctcaaataaaagtcacagtcttgcccttggcttcatctttagaccatgccacctttctctctttttaaaatttcaagttttatttagattcaggggttacacgtgcaggtttgttacatgggtatattgtgtgatgctgaggtttgggatacacacgatcctatcacccaagtagtgagcatagtacccggaagatagtttgtcaaccccttccccctccctcctccctctagtactccccactgtctattgttcccttctttgtgtccatgtgtatccttgtttagctcccacttgtgagaacgtgtggtatttggtgtttgtttctgcattaattcacttaggataatggcctctggccacatccatattactgcaaaatacatgttattttttttaatagctgtgcagtcttccatggtgtatatataatgcattttcttgatccaatccactgttaactggcacctaagttgatttgtgtccctgctgttgtgaatagtgctgtggtgaacaaatgcatgtgtctttttggtagaacgagttatagtcccttgggtatatagccagtagtgggattgctggatcaaatggtagttctattttagttctttgagaaatctgcaaactgttttccacagtgactggactaatttacattcccaccaacatccccttttctccgtagcttcgccaacatctgttattttttgactttttaataatagccattctgactggcgtgagatgatatctcactgtggttttgatttgcacgtctctgattagtggtgttgagcatttttttccatatctttgctgagaccttgccattatttatgttgagatctggagaggctaaacatattcaaaaccagcaagtcctggcttccttttatttaatgcagtttccttggtttatctctctcctctcatatttgactacaagcagcaagaagacatcaggtggcaccttcagcacttggctcagagatctcttgaggttgatcccctggttgattaagcatgttttctacctttttttgtgtgtgtgtgtctcgctctgttgcccaggttggggtgcagtggcacgatctcggctcactgcaacctctgcctcccgggttcaagcaattttcctgcctcagcctcctgagtagctgagattacaggcacccaccaacacgtccagctaatttttttgtatttttagtagagatggggtttcaccatgttggtcgggctggtcccgaactcctgacctcaagtgatctgcctgcctcagcctcccaaagtgttgggattacaggcatgagccaccacgccttgcctgttttctactttttacatagctgcatgcaacagtgtggctaaattttctgccagcacacaacaggaccccttcctctagtttcctatgaaattctcctcgctttcctgcagaccctgatgtgcagcatgcttaatgtccaaaattctatgaactgtgtgttaagtgcgctttagcccttcattaatgtgctgctcagtgtccatcctctggttccaaaaccactcccacattttaggtttttatcacaacatcaccccacttctgattccaaaatctgtattgacttttcctgctggggaacaaattatccaaaagcttggtggcataagaaaaatgtttattatttcactgtttctgtgagtcaggaatcagggtggcttaactgggtgcacctggcttgcagtctctagtgaggctgcagtcttctcaggctcatttggggctggagaattcacttccagcctcatgctcattatggctgtcaatggacctcaaaacatctgcttccaggctcactggtgtggctgctggcaggcctctgttcctggtcacatgggcctctcccagctgccggagtgtccttatgacatgatatttggtgttcagagaaagagttaagagttcccaagacagaaaccagtccttttgtaatctgatctcagaggtgacatcccatcacttttgctgtattctgtttactaagagtgagtcactaggtccaacccatccttaaggggatagcattatacaagggagtgaatactgggtggtagggattactgaggccatcttagaggctgcctactacatgaaccagtgaggacaaattttgataattagtggaaaacaggacagatgctggaagactggcaatgagaagaaagtatatttagaaaactacaatcttcaaccctaggcaaacatctggatgatttgctagtgcagagaaaagttggtggtgatgatcaagggcaacatgtgatcaccaagaacagatggcactcttggcaagactggggtggcaagcttacccaatttgttgtattgatagggttatcacaggttctgtgcatattggtgtacctggttgttgacagaacgttagatattctctgaatggcgatctgtggacaacgtagagaaatgtgcagcagatgactgtgcatttgagttgatccataaatggtgcacagccattcccagacatgctggttaacagattagtgtcaatctgtagggaagtctctagagatgtaccacagggctctgtcttagcatattcatcgttctctcagtgacttcgtaagagcattgacgttaagctcatcagctttgcagttgatgcgaaattggtggaaatgactgaaactttggaaaatatatgtcccaaatacaatgtaattgagtttgagaggctcaacatttgaattctccacaccagttgcagaagtgtggcttagaggaaatgagaattacacacatgaagaagacatgggcgctcctgctgactgtgagcccagattgtgccccttgaggtatggtggcctgggagagaattcagtttggggccccttgcttgtcctgtccagagggaaggtggtaaagggtctgctgtgttccagccccactggtctgtcctttctgagtccctcacaccgggccctgaccaggacggccctcctcacagtctatctgaggaatggctggaaggagggacgtgtaccttgctcacaaattccagctcaccaacatcaacagtgcatgaaacaaacaggcaggcttgccataatctgttcttggtggcatgtgctgtttcctggtcattgggagaagaaaagactcaagatgcaatttatgaatctgagtatcttggagcagtggcagaaccagggaggggaagttacagggagacagattttgctagtctgtgagagaacagtctaacagtcagggctgtctgaaagtttgcccagctccagaggtgttgaagaagacaccagtgtcaccaggctgtggtcaagcacagaggaggtattagaccaggtggttgtaaggtctgccaggaagccagcaggcctaacctggtccatgtcctgtgtcctcctggtgtgtctggggtggggggtgggagggagggcaggtaccaggactggtgggactctatagcctttcccaaaggttccaagagctcagtgtgaggtgtgtgccttgtgttaccatatctggcttgattgtcagacaaggaagcaggatggttccttacggagaggtgcagccacgcagggtgtgcacacacatccatctgcatgcacaggtgcagatacggtgcacccaaggctaatgccatcccgttgcaggtcatcgtggggagcgtctttgaagtggtctgggcggccatcaagccgggaagctcctttgggatcagtgtgctgcgggccctccgcctgctgaggatcttcaaagtcacgaagtacgtcccctgcgctcccaggcgagggcaggtgtagggtggagagggcgtgggatcagccacacagggtgcttgtccccaggagttcacagcacccagaagctctctctgtggcttatagttgatttaaatacaaaaggtggttccaaaacggccttgtggggccacatctgccctcagggccatccctgactggcctccgtgctgccggcacaccctttagctttcttgttcacttgctttccacgatttcccatcgtctcctgtcttgaaaccaccaccccatcttcccagccttcaaaggtgactttgctttgtagttaatgaggaagacagaagtcatcagatggaagcttttccatcatccagcccccaagtctgcctacctcccctgcagctccacccctggagagcctgtgtgcaccctgccatggtcctgagcttctcactgagccagcctggcacctgcctggcccctgtgctcaggcctgctttctccaccctgcaccttgctgacgatggcagtgacaagaccatgtttacagttatgtcccacttgactctggaagtgagttgctgcagtttgcctacaaagagactgaagcccaggaagtgacagatgcaggtagtgagagaaggaccagggtgaaaacccttcccctcactgccagagttgtagtggggaagagagagagagactctcctcacagcagtctcatcggcagcaaaggctgcaccgcggaggctcctgagcatctggaccctaccagacacacacgtgggccagcatggactttggtgtgtgtccttggcagctgcagggcccaacaagcagaactgccgacactgagcccgtgcagtgccaggtcataggtcacacctctagtgaccaagatgacctctcagaagcccactgacctccccagggcaactgaaatcccaggtcttttccaatccattttaaatccaaacctaagaccataggaggatatgaagctataaaggcagaagagttttgggcagagttgagtcccgctgggtccatgaatcctcactggcgctctgtgctgtgtgtcctcagacttctgttgccttcccagaacttgctggtgtgaggcttcaggaagtgtccacagggctgcctttaccccacctccaggtctggcatcttaggctccattttctcccaggaagtaggtgaccctgtcctgaggcaggctggcctagacccctgctagtcccaggagaaggttcaattcctttcccagagtcttccatcccgtctgccattagccctcaggtactttgtaagagaatccatggaggatagcggggcctctgatgtgggcgccagggagaaggacatggtttgggagcccaggggtgcccagggatagagtgagcacagaaggagaccagtgtctgtcttgcagtccctccattccagggagatgggacagcacgtgcagaggcacagggacatgagggaccggcccctcagttgccatcagcagcctcggtggcacctgtgtgccatggggacccgtgcatgagcagggcacggtcactgccctctgggatgggaagcgttgagggataccacagagagtctgcgtggtgtcaccctacaagctctccacgccgcgtgtcccttgtccctggtgagggggcactggagccagggtctctgccaccggccacagcgcttgcagatctgctgtaggttccggtgtagctcttcctgctgtgggctgatgacaacagttgtgggacttgcttcacatggcactggtctgagacacttggtggctgactgggtgttgaggagtgaggggcagggaggggccgaggatgaagtttgggattgggcctggccacctggatggtggcctcgtcctcctgaacctagggacagggagcagtttgggaggacgaagtgagtcctccactgggtgtgtttttctctgccttcccatggggccctcagggagagaagtccagggtagtgggcctgaaactccagagaaaagctctaacttcacacctaggtgtgcagccctcagggtttagaaagtcagtggagccttaagtgtggctgcagagagccatgaatgtgaagtcagcgtctggagctggctcagaccccctgcctggccccgcaggtactggagctccctgcggaacctggtggtgtccctgctgaactccatgaagtccatcatcagcctgctcttcttgctcttcctgttcattgtggtcttcgccctgctggggatgcagctgtttgggggacagtaagtgggcccgggagggagagctcaaggctgggggcttgcagggaagcagagctcagagcagacggtgccgcccaggctgcctccacccaccttcccaccaggaaggtcctcagaggggccagtgtgcagccatctgcagcctgaagcgagcaggttgaggccacgctggagcctgcaggcgctgcctcgctgctgacgggactgccacttcccaagccttcctgttttcctcaggttcaacttccaggatgagactcccacaaccaacttcgacaccttccctgccgccatcctcactgtcttccaggtaaggcacctgctctgcacatttgcggcctgcccggctcccgtctcccctgggtgctgggaaggcggactctcctgtcattccctcccttgttcctccacacggcccagatcactgacttttcagacacagtgttcctcaaacgagggaagcacaggcagtcagcaacctgcagatctccaggtccgggggccccagcccctacggtgaaggaagctggattctgtggcagcactgtagggagcaagtgtagttcccggggggcccagctggccttcaagccaccagtgtatctcttagctcctgagacttgcatgcacttctgttttttattctccgagaacaaaaacaaagcacttcctaaacttctccccctcctatctcagatcccagtgaccccctcagttctcatctgtatctggaaaactacccccctcagctcctcgggaagtgggggctgggggcccacttctctacgacggagaccttgttggctcatgcagactctgccctcttggagggttccctttcgaggactttcttggttgggtactctccccttccataggctgtggccccacagtcctgcccatgactggccttactgatgagagcatgccttgcattcctgtcccatgaaacatacttggatgccatgtctgagactgaacaggatggtggctgttgtcttgcctgtgatgcctcttacggaggcccaacaggctgtgtttgctgcaggccaggggcttggcttggctccctggctcctggggctgctgatcctacccttggtcagggctggagcctacaacttgtgtgaagagaggggccctttcggtcccactctctcgaagggaggaagtcttaccagcagacccttcagaccaaattagacgattggctcaaagaggagttctgtcctaatttgcaccacagtcctccatgactgtcccctttctcacatcttcccactcacccccaccctgctgggctggagcctatgacccgtcagctcctagtcactgccaggcagagccagctcttctcccagaggtgcatctgccccaggcctgtcagggccttgctgttgtcatcccttcttcctctctggtctcatgtttgagttgctgcctcttctcctctcctcttattcctcgagtgggaggcacttgtcagcctccgactgtcctccctttctctgacttgaaagcctcggctgctcacaggccagtgacttccagactttggtctcccagatgtttttgagctcttagtgggtgacaggacctatgtcagcctctgggacagaggtgggtggtctcccagccacacgacggggaggtcacaggcctggagctgcccgtagggtcctgaatgtcaggcaagggaaactgggaggaggcattcccagcaaagcagcaaaaacgtgaggagtgtctggggtggcgacaaggtggcaggtgtgggatgggaaactccaggtgtgggcgggccaggctgaggctttgccctgtagaagctgttgcagggaggggctccatgccaggggggtggcatggtccatgaccacagccacgctttgccatgtgtgttgcaagaaaagacctgagtgtgatgagggagagaagttgaagttgggaggaaagtgggcttttctgatcagatgatgctctgattcagacattacatgccccctgctctgaacacagcaataagataaaaaaaatacacttagaaaataaaaggacctagacaagtaaaaacaaaatctctgaggaatagaaatggaacagaacatacagtggtgagagacagcagagacccaggcaccaggacatggcttgagataggcagatgggcttgggagtctgagttccatggcagcagaagtgtgcaggtgtggctcagccccctctgagcactgggggaggtacctgggccctttggaggaggctgaggaggggtgaaggcttgttgagctgcagagaccaggaaggctgcagggcagggctgactggtggctaggtctgtaattcccacaggtgaatctggaccagggtcctgagatcccagggtgggagcccctgcttctgaatggggttgggagtggggcagggagggcatgtgaggaggaagaaagcagcttcagctgtgctcatggtggagctgcaaactgagggctgggaacagccagcatcccagacagtgccaacagcatctacagtcagaaggcgtaatcactcccaaagaaaaggaaataacagaacaaacacaggtgactttaaaccgaatatgcctaacatcctccaaggggtaaagggggaaccagttaaaaacacaaaattatgaaaaaaggcacctaagaacaaagaaaagacctaaaccaaatcctagaaatgaaatatacagctatttacattttagaagcagagtgaaccgtacgccgggtgtgatcagagagagtatgggtgagccggaggatgtggtggggctgagccagctgggcatggaggcttcctggagagaaggaagtgagggtgggctggagtggaggctcccatgtgaggtgcgaaagagagggtggccagtgccccttccgagtgagtcctggagaacatgtgctcagatgatcaagcaggataaacaaataattccagacctagacaaattgtgatctcaagaaaatcttatacgctgccctagaaaaatagatttcctacaaaataatgacagatagtctgatggccaacgtcttaggagcacagatgccagagggtcatggagaagtaacggaaacactggggtacaatcactattcgccaagaattctgaatccagacagctgtggtttaagcgtgagggcagagctaaagacactttcagacacaaataggagtgagttaccaccacccacccagatcatttgaaagcacgacaaaagcttatacatttagtaaagtggatgatttagaataaaaaatactaatgtatttttacccaagaagaaattaactgaagaaaaaacaggaaatggaaccatttcagaaattgaataattaggtcagaatcggattaagatggcagataggaggaaggactagcttgcagctcctgctcggacagacagaacagcgtctggagactcacatcatgaacttttgctccaagaactaccacgggaagttcttggaactaccacaggcaagttctcagccctgggcactggctgcctggaaatagactcagtgctgttgggggtgggcacggtaggagtgagaccagccttttggactgcgggctgcgtgggagtggggtgaggcctgtgactgctggctttctcccactttcctggaggacctgtatgactaatggccttaatcctcctgggaacataactccattggactgagaaccacacacccatcccccacagcagccacagcaagccccgcccaagcagagtctgagctcagacaccctattcctgcccccacctggtggtctttctctacccaccctgatggccgaagacaaaggttataatctcctgggggctctgtggtcctgcccaccccctgagaaacctgaatacttaattaggctaccttagggcaagtttgcatcctctctacaggacctcagctgatgctctcttgaaagcgccacctcctggctggaggccaaccaatataaaaccagcacacttaacaaaaatacagccgaggaccctcacagagtccacttcactcccctgctacccccaccagagcaggtgctggaggtcaaccaatataaaaccagcacactcaacaaaaatacagccaaggaccctcacagagtccatttcactcccctgctacccccaccagagcaggtgctggtatccgcacctgaaagacctgaagatggatcacatcacaggactcttgacagacactccccagtaccagcctgaagcctggtagctccactgggtgggtagacctgcaagagcaaaaacagtcattgcagtttggctctcaggaagccccattcctcagggcagggggagaacaccacatcaagggagcacccccaagataagagaacagcagcccttgagtcgcagatcttccctctggttccaaatgagaaggaaccaggaaaacaattctggtaatatgacaaaacaaggttcttaaacacccccagaagatcacatcagcttaccagcaatggatccaaaccaagaggaaatctctgaattgccagaaaaagaattctgaaggtcaattattaagctaatcaaggaggtaccagagaaaggtgaaattcaacttaaagaaataaaaaacatgatacaggttatgaaaggaaaattcttcagtgaaatcgcataaaaaaatcacagtttctggaaatcagggacacacttagaggaatgcaaaatgcactggaaagtctcagcaatagaatcgaacaagctgaagaaagaacttcagagctcaaagaaaaagcttttgaattaaccctatccatcagagacagaagaatttcaaaaaatgaagcctccaagaagtatgggactaagttaagtgtccaaacctaagaataattggtgttcctgaggaagaagagaaatctaaaagttaggaaaacatatttgagggaataattgaggaaaacttacctagccttgctagagatctagacatccaaatacaagaactcaaaaaacacacttgggaaattcattgcaaaattcattgcagaagaattcatcacctaggcacatagtcatcagattatctgaagtcaagatgaaggaaaaatcttaagagctatgaggcaaaaatatcaggtaacctataaaggaaaacctatcagattaacagaagatttctcaacagaaaccctacaagccagaagagattgattagggtcctatctttagtctccttaaacaaaacaattatcagccaagaattttgtgtccagtgaaactaagcctcataaatgaaggaatgatacagtcttttacaggcaaacaaatgctgagagaattcgccactaccaagccagcactataagaactgctaaaaggagctctaagtcttgaaaaaaatcttcgaaatacaccaaaatagaacctccttaagacacaaatccaacagaacctctataacaataacaatgaaaaaaacagcatggtattcaggcaacaaatagcacaatgaataggatagtatctcacatctcaatattaatgttgaatgtaaatgacctaaatgctccacttaaaagatagagaatggcagaatggataagaattcaccaaccatgtttctgctgtcttcgggagactcacctaacacataaggacttacataaacttaaaggggtggaaaaatatttcatgtgcaaatggagactaaaagcgagcaggaatagccattcttttatcagacaaaacagactttagagcaacagcacttaaaaaagacaaagagggacattatataatgataaaaagccttgtccaacaggaaaatatcataatcctaaatgtatatgcacctaacactgaagctctgaaatttataaaacaattactactagacctaagaaatgatatagacggcaacacagtaatagcgggggactttgatactccactgacagcactagacaggtcctcaagacagaaagtcaacaaagaaggaatgaacttaaactataccctacaacaaatggacttaacaggtatttacagagcattctacccaacaactgcagaatatacattctattcatcagcacatggaacattctctaagatggaccatatgataggccacaaaacaagtctcgggaaatttaaaaaaatctaaatttggagcttgcagtgagccgagatccggccactgcactccagcctgggcgacagagcgagactccgtctcaaaaaaaaaaaaaaaaaatctatattatatcaagtactctctcagacgatagtggaataaaattggaaatcaactccaaaggcacccacaaaaccaggcaaatacagggaaattaagcaacctgctcctgaatgatttttgggttaacaatgaaatcaagatgcaaatttaaaaaaatctttgaactgaacgataatagtgacacaacctatcaaaacctctgggatacagcaaaggcagtgctaagaggaaagttcatagccttaaatgcctacatcagaaagactgaaagagcacaaatagacaatctaaagtcccatctcacacaactgaagaaacaagaacaatccaaacccaaacccaccagaagaagagaagtaatgaaaatcagagcggaactaaatgaaattgaaacaaaaaaaattacaaaagataaattgaacaaaaagctggttctttttagataaataaaaagataaatttttttagttaaaatttttattttatctatctagatagataaaatttaaatttttgtctatctagattaaatttttgtctagatagattaaatttttattttgtctgtctagatggataaaatttttattttgtctatctagatagataaaattgatagaccattggtgagattaaccaataaaataagggagaagatccaaatataagctcaattagaaatgaaatgggagatattactactggtaccacagaaatacaaaagattattcgaagctactatgaacacctttatttatgcacataaactagaaaacctagaggagatggataaattcctgaaaaggtacaaccatcctagcttaaatcagggagaattagataccctgaacagaccagtaacgagtagcgagattgaaatggtaataaaaaaattacgaacaaaataaagtccaggaccagatgaattcagagcaaaattctatcagacattcaaagaagaattggtaccaatcctatcgacactattccacaaggtagagaaagagggaattctccctaaatcattctataagccaatatcaccctaataccaaaaccagggaaggacataaccaagaaagaaaactacagaccaatatccctgatgaacatagatgcagaaatcctcaacaaaatactagctaactgaatccaacagcaaattaaaaagataatccaccgtgatcaagtgggtttcatatcagggatgcagggatggtttaacatatgcaagtcaataaatgtgataacaccacataaacagaattaaaaaccaaaatcacacaatcatctcaatagatgcagaaaaagcattcaacagaatccagcatcattttatgattaagtcctcagcaaaatcagcatacacgagacataccttaatgtaataaaagccacctgtgacaaacccacagccaacataatactgaaccagtaaaagtttgaaagtattctcccaagaactggaataagacaaggatgcccactgtcaccactctcttcagcaaagtactggaagtcctaaccagagcaatcagacaagagaaagaaagaaagggcatccaaatcggtaaagaggaagtcaaactgtcactgtttgtttgccgatgatatgattatttatgttgaaaaccccaaagacttttccaaaaagctcctagaactgataaaagaattcagcaaggtttcaagatacaaaattaatgtacacaaatcagtagctcttttgctcttttatacattaacagcgatcaagctgagaatcaaataaagaactcaaccccttttacagtagctgcacaaaataaaataaatacttaggaatatacctaaccaaggaggtgaaagagctctacaagggaaacgacaaaacactgctgaaagaaatcatagacgacacaaacaaatggaaacacatcccatgttcatgtatgggtagaatcaatattgtgaaaatgactatactgccaaaagcaatctacaaattcaatgcaattcccatcaaaataccactatcattcttcacagaactagaaaaaacaatcctaaaattcagatggaaccaacaaagagcctgcatagccaaagcaagactaagcaaaaaaggccaggtgcagtggctcttgcctgtaatcccagcactttggaaggccaaggcgggcagattacctgaggtcaggagtttgagaccagcctgaccaacatgatgaaaccccaaccctacttaaaaaagtacacaaattagccaggtgcggtggcttgtgcctgtaatcccagctacttggaaggctgaggcagaagaatcacttaaactcaggaggtgaaagttgcagtgaaccaagatcgcgccatccattgcactccagtctgggtgacaagagtgagactccgtctcaaaaaaaaaaaaaaaacaaaatcagcaaaaagaacaaagctggaggcatcacattacccaacttcaaactacgatataaggtcatagtcaccaaaacaccatggtactggtataaaaataggtacatagaccaatggaaaagaatagagaacccagaaatcaacccaaatacttacagccaactgatctttgacaaaataaacaaaaacataaagtggggaaaggacaccctattcaacaaatggtgctgggataattggcaagccacaggtaggagaatgaaactggatcctcatctctcaccttatacaaaaatcaactcaagatggtcaaagacttaacctaagagctgaaaccataacaattataaagataacatcagaaaaaatccttctagacattggctaggcaaagacttcttgaccaagaacccaaaagcaaatgcaacaaaaacaaagataaatatatgagacttaattaaactacaaagcttctgcacagcaaaagaaataatcaataaacagacatcccacaaagtgggagaaaattttcacaatcaatacatctgacaaaggactaatatccagaatctgcaaagaactcaaatcagcaagaaaaaaacaaacaatctcattaaaaagagggctaaggacatgaatagacagttctcgaaagaagatatacaaaagcatatggaaaaatgcttaacatcactgtcaggggaatgcaaataaaaaccacagtgtgataccacctcactcctgcaagaatgcccataataaatgaaaaataatagatgttggtgtggatgtggtgaaaagggaacacttttacactgttagtgagaatgtgaattaatacaaccactatggaaaacattgtggagtttccttaaagaactaaaagtatatctaccaccatttgatcagcaatcccacttctagatatctactcagaggaaaagaagtcattatatgaaaaaggatacttgcacatgcatgtttatagcagcacaatttggaattgcaaaaatatggaaccaacccagatgcctattggtcaacgagtggatgaagaaaacgtagtgtataccagtatactatagaatactactcagccctaaaaagagtgaaataatggcatttgcaacaacgtggatggaatcggaggctactattgtaagtgaagtaagtcaggaatggaaacccaaacattgtgtgttctcactcataagtgggagctgagttatgaggatgcaaaggcataagaatgatacaatggactttagggactcgagggaaagggtgggagggggacgaggaataaaaaactacagcgtatgctgcttgggtgatgggtgcaccaaaatctcagagataatcactaaagaacttagtcatataagcaaacaccacctgttctcccaaaatctatcgaaataaaaaataaattttaaaaaatttaataattaaaaatctcctgctcaagttaccaagttcagatagtatgatatgtgaattctgctatttaagaaattattccaattttatacagactcctccgcagaatataaaaaaggatagctcgccactcattgtatgaaactagagtagccttgataatgaaaaaaactaaacaaggacactatcagaaaagaaaaatacagatcacttctgcaaatacagatcacttctgcaaacacagaagcaaagcatctgggggaaaccatcattaatcaaatctagatattcttaaaaattatttttataattgactagaacttttcctagaaatgcaagataattcaacattagaaaacctatgaatgtaatttgtcacactaacagattaaggtggatacaaaccctgtatgatcagagaaagcactggaactgtagcacaagcacagtcagccagaggtgagaggagcggagataagattgcagagttgccgatggctgaaactggatgggcatgtagggctcattgtactccactctgtgtatgcttcaaatgtccgtgataatttttttttaagtaagacctaacactccttccaaataaaaatgcttagcagattacagtagtatcaggggtcttagcacagtagaacaagaaaaaatgaaataaaaattgtcgggattgacaagaaagaaaactgtcattatttacagatgaaatatttatacacagaaaactcaagtcctgtcatgcagatagtatttacatagaaaaacatgaaattggattcctaccttgtaccaagtgtgaaaatcaattctagataaattaaaagacaaatgatgtagtatgaaaggacaaaggataaaaacaagtaactcacaggagaagaaactatgatcaattttactgcagtcagggaaatgcaaattaaaccctcaatgaaacaaccatttccacctgtcagtttagccaaaattaagagatctaacaatattaagatttagagaagaagtggagaaattagtgtttctttatgctgttggtgggttggtagaaccactctgaagggtaattcattatatcccatccactggaattggcacgagcagttcctgccaggtatagttttttgcccaagtgcacaaggaaacatgtaaagccatcctagcagcattatttgtaataacaaaaaactgaaaatcacctgcatgttcaccatcagggaaatggataagagaagtgtgatctgtttgtgcagaagggaaaatgagtgccttagaactaaatgtatttatagcgtatgatactatttaaggatgaacaatgtgcaaaacaatgtcatatactgtttatgatatggatgtagtaaacgtataaaagcttgcacaggaatgattagcaccaaattcaggacacagttttcctggtggtggggtgggggttgctgggaggtggggagagggagaggaatgagactggggagttctggccacattctgatgttttatttcttaagctgggtagtgggtacacagaggtttgttaaattattcattgcatctttcggagtgtttaaaatattgtgtaattgaaaaataaagggatacgaaaagatgaactaactaaacattgaccaaaagaaagccagtgtaggccgggcacggtggctcatgcctgtaatcccagcactttgggaggccgaggtgggcagatcacttgaggtcaggcgttcgagaccagctggcctacatggtgaaaccccatctttactaaaaatacgtaaaattagctgggtgtgctggtgctgaggtgggagaatcgcctgaacctgggaggcagaggttgcagtgagctgagatcacgccactgcactccagcctgggcgacagagcgagactccgtctcaaaaaacaaaacaaaacaaaagaaagctcatgtattaatatcagccaaaatagaggtgaaggtaaaaagaggacggatgagaataaagaggcatattacatgatgaaaagaggacgcctccagaaggaaaacactgcagggcatgaacttgcaggacctaacaacctggcctcagaacattgaccaaaaacaggcagaattacaaggagaaataaaaactttaccatcttataagagatttataacatgtctctgtcaaactgcaggatgaaactgacaaaagattagaaaggatctaaaaacatgaaccagttgtcacatacagaactgtacccaacagatagtgaatagaatattcattatttggggcacttggaacatttgcagactttgaccatttattaggtcactcaggaaacttcaacaagtattaattactgtccagctgggcacagttcctcactcctgtaatcccagcgctttgggaggccgaagtgggcagatcacctgaggtcaggaattcaagaccagcctggcgtggtgaaaccaaaatggcgagaccccgtatctactgaaaatacaaaatttagccaggtgtggtggtgggtgctactgtactccagcttgggtgacagagtgagactccaactaaaaaaaataaaaaataaaaaatgaatattgctgtcctgcagagcacaactttgatatcatttagataagcaggcaccgttaatgaaaagtcatttaatatctttcccatatttgtaagttgaaggatttgggagtaaagaggaaatcagaaatcacgatggccattacagaatatttagaactgaacagtatcaacacttgtaagaggaatccgaaacaacacttaaagaaaaacttataatcttaatgcagttatcagaaaaaaaaaaggataaaaaataaacaagtactcttaaaaaaaaaagtgtcttgccctgtcacccaggctggagtgcattagtgtaatcatagctcactgcagcctcgaactgggttcaagtggtcctcccacctcagtctcccaagtagctggggccataggcacacaccaccatgcccagctaatttctattttttgtagagacgtggtctcacaatgttgcccaggctggtctcaaactcagtgggctcaagcgatcctcccacctcagcctcccaaagtgctggtaatgcaggcatgagccacagagcctggcttaacaagtacttatatgaaaaatctagaagaaggaataataaaccaaagaaaaattgaaagcagatgatgctaagagtagacatttgttgtacagatcactgaaacaccaagataacaagcatgttcatgaagtagataattgtacagcgactgatcaagggaaaaaagcacaaacaaaaaatgtaacccaaaagggagtcgtaactataggaaaatgagatttttttttaattccaaaagaatactttggcaactttatgccatgagattggaaagcgtagatgaaacatgctttttttttttttttgagatggagtctcgctctgtcgcccaggctggagtgcagtggtgcgatctcggctcactgcaagctccgcctcccgggttcacgccattctcctgcctcagcctcccgagtggctgggactacaggcgcccgccactacgcccggctaattttttgtatttttagtagagacagggtttcaccgtgttagccaggatggtctcgatctcctgacctcgtgatcagcccgccttggcctcccaaagtgctgggattacagacatgagccaccgtgcctggccaaaacatgcatttttataggaagacattaagtggattaaattagctcaagaagaaattttgaaaacctggacatttcataattataaaagaaatttaacagacagtcaaagttctcttcctatctttctgcctcctgcctggggcccagtcattataaggcgagtttcaccaagcctttcaagaagaaataataactatttgactcaaacaatttcagagaagggatgaaatcatttcatgaggctagtacaaccttgacaccaaagccatgcaaggacaatttaagacaaaatgcagaccagaacgcaagctccatggggcagggtctttgttttatccactgaccatcctaagcacctgaatatcgcccaacacggcaggtacgctaatgtctccccagtgaaagtagattcattcaaatctcatggcataaagcttccataatattcttctgtaattaaaaaaatctctttttcctatgttatgacccccctttcgtgttacaatttttatttgtgctttttttcccttggtcagtcttgctatacaattatctacttcatgtgtctccttaaaaatatgctttttacagtcttgttattttggtgtttttttatctgcatcacaaatgtctgcaaataatctaaaatctattaaaaaatcaaatcagctgcatatattaaaaaagaacctaatagctaaactgtgttcattctagtaatacaagaaatacaaataatacaggaaattgtcagtataattcctaatctctacaggttaaaagagaacatgtgtcatagatgcagaaaagtgaaacattgataaaaataaactttaattcatgataaaaaaaagtcatactaagaattgacaggagtttaaaaaaatctggtaaagagtatctacaaaaaccctacaaccaggatgggtgatagctaatgggtatgagtttctttttttgaagggatgaaaatgttctaaaatggactgtgataatggtgacacatatttgtgagtatactaaaaactattgtatacactttaaatgggcgaattatatcccaataatgctgttatttaaaagagaccatagcaaggatcatagataatagtaaaagattagaagtattgttaaaaggaaaataaggatgcctactattcaagcagtcgaagctaatgtcgtaagaaaaaagaaagaagtaaaaagactgaaaaggaatagaaaaaaactattattatttgcaaatgtgattatttactatagaaaatcctagataatatattagatataataagaaaattcatcagtattgctgaacataggataaatgtacaaaaatatagcttttctatataataaataacattattcaattagaaaattcaatttaaaagaaaggtctcattcacagtagtaacaaaacttccaggtacccagaaataaatctaactaaaattgtgcaagacttttgttgcagtaattatgaaatgtcattcaaggccttaaggagctgtatgtgtgcagagagatgtttataagtaggaagccttaaaatggtgaaggtgtcagttctccccaatttaatttatgaatcaacgcaatcctgatccaaattccaatgggactgttcttggaattcagcatattgattatatggaagagtaaaagtccaagaaaagacaattcaggaagaagaaatttgtcctaccatatatcatgactttttataaagctatggtaatgaaaatagtgtggtatatgtaaaaatgaaatatcaaaagaacagaccagagaacctggaaacattccaaacatatatagaaagttggttatatgagaaagatgtcattggaaatcaatggaggaaggatggactattcaaaaatttgggtctgggaaaattggctttccgtatgaaaaaaattggatcatcatctccatgcatgcacaaaacttcagttggattagaaacctaaatgtaaaaaatcaaacttgaaaatgatttaaagatgatttaaagagtaagaggccaggcatggtggctcatgcctataatcccagtgctttgggaggctgaggtgggagtatcgcttgaggctcttaagttcaaggtcagcctgggcaacataatgaaagcccatatccaaaaaaaaaaaaaaaaaaaatagctgatggtgcacctctgcagtcccagctacgtgggagactgagacaggagaattacttgaggccaggagtttgaggttataatgagctaggatcgtgccactgcggcctgggcaacagagcaagacccagtctttagaagaaaagaaagaaaaaaatatatattatgaaaatatctttatgatcttggatggagagaaatttcttctcttttcttttcttttcttttttcttttcttttcttttcttttttgaaatggaatctagctctgttgcccaggctggagtgcagtggtgtgatcttggttcactgtaacctccgcctcccgggttcaagcgatttttctgcctcagcctcccgaatagctgggattacaggcacctgccaccatgcccagctaatttttgtatttttagtagacagggtttcactgtgttggccaggctggtcttgaactcctgaccttgtgatccgtccaccttggcctccaaagtgctgggattacaaacgtgagccactgtgcctggcccaaatttcttttttttaatggagatggggtcttgcgattgtgccactgcactccagccttggcaatagagcaagaccccatctccaaatttcttttttttttaaatggagatggggtcttgctctattgccaaggctggagtacagtggcatgatcatagctcacacaactggctcaagtgatcctcctgcctcagccttctgagtagctgggactacaggtgcgcactaccacacctagctcattaaaaaaatttttttgtagacagggtctcactatgttgcccaggctggtctctatctccaaagtgttgggattacaggtgtgagccaccactcctggccgtgtgtgtttgtagtgaaaatatctttatgaccttggatggagaggaatttcttaagatgcaaaaagcagaaaacataaaggaatagactgataagactgatatttaattacattaaacttttttaatacaaaaataaaagcaaacaggagactaaagatatttacaatagataatgcaaatagagtattagtatatacaagaatacataagcaagtctcaaaagtcagtaagaaaaagatgagtcatcagaaataggagctggggggttgaaaggcagggcacagaagagatctaagggcccctgggcaggagaaatgatcaaactcacgggcttgccttttttttttttttttttttttttgtagaaatggggtcccactatgtcgcccaggctggtgtcgaactcctggggtcaagtgatcctcccaccttggcctcccaaagcgctaggactacagacgtgagccaccacgcctggccagtgcttttaagccctttcacgtttatcagattgggaactgtcaaagggcgtgacagtgccatgggtggtgtgaggatgtgatgaagaaccatcctctgctgctggcgggaatatgatttgggataaccattttggaaacatctagtgaagtcggcgaaggtgtgcatagcctacatacctggcagctgcagttctggagaaacttcacatgtgcacaaggggacacggcagcaaaaacccggaagccactaaaagtacctgtgagaaggaaaataggtaaatggaaggaaaactgtgtgatggtttacacaaataagtagatttatatgtatcaacatggagagccgggtgcagtggctcaccctggtaatctcagcactgcaggaggctgagggggggctgattgcttgagcccaggggttcaagaccagcctgggcaacatggcaaaaccccatctctactaaaaaatacaaaaaattagctgggcatggtggcacctgcctgtggacccagttactcaggaggctgaggtgtgaggattgattgggcccagaaagcagaagttgcagtgggccaagatcacaccactgcactccggcctgggaaacagaacaagaccctgtctcaaaaaaaaaaaaaaaaaaaatggagaaacctcaaagctgtattgttgaatgaaaacagcaagttgaagaatgatgtgtagtctggtaccttcctgtgcatgtttagcacgtatgcagtattctgtttatacatacgtgtatgtgtgtgatgtgtagtggaaccctaaagacttggatccattcatccaacaagggactactatccacaatatacaaggaactcaaacaactcaacagcaaaaaaaacaaataatcacatttaaaagtgggcaaaggctctgaatagacatttctcaaaagaagacatacaaatggccaacagatgtatgaaaaaatactcaacatcactaatcatcaggcgaagacaaatccaaaccacagtgaggtatcgtctcacccatttgggatggctattatcaaagacaaaattaacaaatgctggcaaggatatagagagaagggaactctctcacactgttgatgggaatgtaaattagtccagccactctgggaaacagtatggaggctccttaagaggagccataccacaaaaatcccactgctgggtgtttatccaaaggaaaggaagttggaacatgaagtgctgcctgcctcctcatgctcatggcagcactattcacagtagcaaagataagggatcagcctaagtgcttgtcaacggatgaaaggatacagaaaatatggtgtatatataacagaacactattcagccacaaaaagaatgaaatcctgtcatttgcagcaacatggatggaagtggatgtcattaagttaagtgaaataagccaggcacagaaagagaaacttcacatgttctcactcagatgtgagagcaaaaaagctgatctggaggtagaggttagaatgatggctaccagaaggtgggaaggctgtaggaagaggggatgaaaagagggtggttaaggggtacaaacacagttagatagaaggagcgagttcctagtgtttgatagcatggtagggtgactataactaacaacaatatattgtctatttcaaaataatcagaagaaaaggtttgagatgttcccaacacaatgctaaatgtttgaggtgatggatatccgaataccctatttgatcattgcgcattgtatgcatgtatcaaaataccacaagtaccctaaaatatgtacaaatactatgtatcgataaaaagaattaaaaaacggcagggtgtggcggctcacgcctgtaatcccagcactttgggaggccgaggtgggcggatcacgaggtcaggagatggagaccatcctggctaatgcggtgaaaccccgtctctactaaaaatacaaaaaattagccgggtgaggtggtgggtgcctgtagtcccagctacttgggaggctgaggcaggagaatggcgtgaacctgggagacggagcttgcagtgagccgagattgcaccactgcactccagcctggatgacagagtaagactccatgtcaaaaaaaaaaaaaaaaaaagaaatttaaaaacccccacaaataaatagaaagtgaaaaaagaaaaaagacttggatctgtgtcagatccctggttggagttggtcacggggagggggaccattgcacatggggcaaaatttccattttgggtgggggacacatgagtgtttattattttattttcttgtatgtttccaaaaattaaagtagaaaagagacatggctactaggacaagggttgcatttagccaggctgtgaggctagacccaccaagtggagtggcaggaactgagagcataaggctctgcttctgctgggtggccgtgtgcagcccagtcccctgtgaacctcggcttccttgactgcagtgacgtggatggcgctgtttcgtctctccatgcctgatctcactgctgccctcctcgcctctgcccacctccttctcctgttgggagctcccttttcatttctggctgaaaacctagagtatgttagtcttttaagacccagttctgcagccatgtccttctggaagcttttctggaggaccctgggatgcccagaccttcggagacagcatcatctaaagacctggatgtgcatgtgtggacgtggcagtgcgcgtggacgtggcggtgcacatgcactcatgtgggtgggggtgcgtgtgtgtggggaaggcggccatgggggcttgccctgtgttctctccatcctggcagatcctgacgggagaggactggaatgcagtgatgtatcacgggatcgaatcgcaaggcggcgtcagcaaaggcatgttctcgtccttttacttcattgtcctgacactgttcggaaactgtatccttctgtggggctggggcagagggtggtcagtgcttggccctcctcttctccatggccaccacgcggatccctccaggaggactaggggccgtggacgtgagaggtgcattctcagagctgagtgcagatggagaacattctgcaggtggccggagcgcagggctctggaggctttgggactcagcttgagggagcatgagctgctgcgtgtgggggtatccagaggtgggggtgggtgcggccagcagcaggcccaggacagactctgagcagcagtcggggagcctcacactctgggcaggtgggtttttgttttcactttgatttaattgtgtacttaggttttggcactgggctttaaaaaggagcccttccccctgctgataccatcccctttgcagagaaatgtaaggaaaggttttctgtggaggatgtcagttgggctgtttcaggaccttgagtcagagggtgagtctgtggggtcagagcgagcccagccgccggtggtgagctctgccctagcaagggaccatgatagggacagggctgtggccaaggaagatctggagggagaactacagcattcgtggtataggcaagggtgagggctatgacaggcagtgtgagtgggtccccctgtagctggggtgggaagttcaggcctagaagtgtctttggttctcaaactcatctgggcatcacagtcccctgagggatggtaagcctggattccagccctagcccagggtgtcagaggcagtggggctgggctggggcctgagaatgtgcattctcacaggctgcagggggagcccgtgtttctgttctggggaccccactttgagaactgctgtgacagaacaccccacagggccccgaggagctggagacaatgtctcacagtcgacctcccggctctgcttctaccccgaacttctcacacacgatggccactccaccccgtctgtctgtcctcgtctctgcctcactggtgccggtgccctcagtgcccttgcagacttcaccttctttcctgtctccatctccctggctcctcattccttgctccacctctcctaggctggcccagcaggggctccctctctcagtcttgttagtcacggggtggtccttaggctgcagctcagggcctggtccccagagtgggggatccagccttcctgggaagttgagtgtgtgtgagcctaggaggggctccagagagcctgagggggcagtgtctgctttggagatgggtggccctggggctggcaccggaggcaccaaagaaaggcagccccggttgtcagagagggacggaagcctcagacaggacagcggtgtccagaaggaggtgcctctgcctcaagacagagcagtggccagtggttcaccacagctgagtctgaccctgacactgaggccaggcatgctggccacgagcgtccccctccctgtccactcagcgttagtcctgctggatcccaaggggcatggcccttggtcctgctttctgggcatggaaaggcctctgaggtgtcagtggctgtggctggtgcctggaggtgtcagcctggcctcagtgtcctgccctgtgggctctgctggagctctgcgtggactcacctgtgaggctctggcctggggtatgcgctcccttgacccccagggagggggcacctgtccagccagagagggacctgacctgccagggtcactgctgttggcctcatacagagccagctgctattcggcctggcagaggccagtaccacagggagagtggctgtagcctgggcaggggtgagtcgcaggcctgtggtgaaacgggctggatcacgtggagtgcaaggttctaacgggggcagcttcctctccctacagatgctgtggtgcatttggcagcttctgagtcacttttggttgtcagcactgatggggaggggctgatggcctcaagtggacggagaccaagggtgctgcctgccgtcccatagaggattgcccagccccaaatgccagcagggcctgggctgagaaacctggagtgataaaatggccaggagggcacccccaatggccagggtctggaggggcagacccaagtcacagtcggggtcctgactatgtttgtggtggttctgggaaactgtgcaggggcagggaggtgagagttcaggaaaaggctgcttccagtgatgggtgaagagttccttttgcaaagaaaaacaccgtgatgggacaaggacctggtcccgcgagctttgagaaggaggccgcacaccccaggcggtgcctgtgccggtacctgtggcaggtgcttccctttgggccttggtttcttcatttctaaaaggtggggcagcacctcacactgggtcctgggaggtcagttgaggcaaggtgcagtcccaggaaccagatcatgccatctgccgtctccacggcctgacgtgagtcctgcaatctacggagcggatgccgcaaagaagaggccccaggacaccatgcgggaaaaggaaatggaaaggaggggaaggtagcactaggtggcatctgtgggcctaggacttggggcccagcatgtgctggccacaggtgggtttgcaagctcgtggtttgtctgaggtggtctctgctcacaggacccagaaggcagtggagccccacctggagcctgtggagtaggagctgtttgtggggaggcttcttgtgctggccggggcttggggagttgggagcacagcaggcagaccatgggccctcgttaggaggcagaggcagatggctccagcacagcctctgagctttgctcctgcacagtcagcccgaaagagctgggttgggggaagaggctcaggtgggcattaggggaggctgggtgatgggaggctgagcaaaggagggattggcagagaggctggaggtgaggatggaacagggggctggagggcctagtggctgggctggagtgtgtctggggatggggccttggggagctggtaggtgccaagggaaggaggctggaggctggttgggatctggggagatgggggaagctgcagtgtgactggggccatgtggggcagaggttcccttcctcagctggacccaaccagacactctgctgaatgtctttctggccatcgctgtggacaacctggccaacgcccaagagctgaccaaggtaggtggcgacagggagggaccggtgtcagcccatgtcacttgaatgtggccgcagccaggaagagtctgggtcctgggttagggcctcgtgtccaggagcgttgccttgggtcctggcgggcagaggctggtctgtcactcaggggctggaggctggagctgaggatgcagggagagccaaagccccgaaggcagatggacaggcaggctctcagggaagccagcacagggaagaatggcctgaacggcagggtgtgctgggagcaggaggggcctgagcaggaggagcagctggtggccctatcccagcacagctgtgccacagtgggacagctgctgcttcaggcagtgctcagcgggtgccattttaatattcatctcatccctgagcctggtgggggatgcaattgtacatgtctccctctgtgatatccctccggatgacacagtcccctcctggtcatgctctccccagccctggacacttgtagtgtggccacctgccatctcagtcgcaggcttgtgtgttgactcaagccctagctcctagtagaggtggtgctgccttctggtttggtgtgaaccacgctgcaaacgtcccacgtgcatgctctgcacatcagtgtgtacctgtgtgtcaccatgtatgtgtcactgtgtgccctcttctgcctgtgcaccatccctggacaggtgtctgcatgcacctgtgcatgtctaggggtctgacacagttctgtcactccagtccagtgtctctccatgccttccctgttccggggctgagagaggcaggttcaggatttctgtccatgggcagcagagatgcaggtgtgccacagagcttctccaagagtgagtgctgtgcaggtgcccctgctccccccagccgagctctccaggaggggggtgtggtccatgcggtgtgccagctgcagcctgagcctccctttgcttctgctcagccttcttactcccacgcctccagacctgggccatggccatgcctatgcctaggggcccggattcctccctggcgctctggtttctggcttctctctgttcctgtcttcagctgggccgcttgggttgggggagcccaagcccccacagagctctccttggtgccggggttgccttggagcccggggccctagctgtcctgggtgggctgcactggagcgctggggccccactgtctctttaagttctgtcatgaaggaagatgcatggaggaagccatgtccttggggccctgtgtccacatacatgtaccctcattggtggccccccttttgtgtaactggcctcatttaggaatttcttctctgaggatcggggccactgggggcctgtctgtgtctggctgtgggcatttttctgggctgaccaagagccgcaaagtttatgactcgaccatccccttcccttatattcccataatattcccacaaaagcattacagcactatgtaccttttgaagcgaggataaacttgaatttgttttagaccttccaggggactttagaacactccctggagtgactggcaaagtccctgccccagagggtgggaagctggatgcagccggatctgcgaggagggacctgggtgtgggtgtttcacgctgggtctggctttgcctcctctctgggcttgaagttcgaaggtctctcctctgtggagggaaattcgcaggcagctaacaagggacttagtttctgccagcgttgcgccccgaatgcagattcaaggacattttagggaacactgggaatgctggctcccaggggagccaggtgggtctgggcttcaggattttgaggaaacagtggtggccccagcagtccagatggacaacgtggaagtcgtagcttccattctgaggcctgtggtctcagccgagaactattgatccggaacccaggtgccgagcatgttggtcttgtttagtgacttagggtcagggccagagggggcagaggaaactgcacctgcctgcacatgtgcacatgcccagccctgagggcaggagccatgtgaagttcagggccaggcactgcaagtggtcacccaggagtgggggagacagggagaggcttctgacagccacagctggggaaatggggacagacatggtctgctggctccaggcagaaaagctcaaagatggtgcgtggccccactggacaccctcctggtggcagtgcttgtgggcagtgctgggtcaggacttagccacaggtgcagagcctcttgcccttgctcttggctttgttaaagtgtgacagatgctcctggggggacaggtgggacaaaaggagggacagatttgcatttcagtgggcaagtttgaggtgccatggtacagacaagctgaaggccaggcatggtagctaacacctgtactcccagcactttgggaggccgaggtgggaggatcacttgagcctaggaattcaagaaaaattaaattaaaaaaatttagccagtcgtgatgacacgtgcttggagtcccagctgcatgggaggctgaggttagaggatcacttaagcctgggaggtcgaggctgcagtgagctgagattgagccactgccctccagcttgggtgacagagcgagaccctgtctctaaaaaaaaaaaaaacaaataacaaaaaacaaaacaaacaaatggaaatatccaggcagtggctgggtacctgggttagagctcagagtaaggtcaggatagcacagaggtgaggccgtcgcctccagggagacggcacaagcaagagggcactgaggaaggaatcctagtgaccattacctttgagtcacagacacagaagggaaggccctggagagcaccagagacagctcctgtggaacaggtcgtggggggccacattcactcaggggttggctgcctgtctccactggatagagagcagcactgtgtattttttgaggcccctggaggaagagctgatgttatatatagccagtgttagagtggctataacactgtgaggggaactggacatttctctttgctcaaacaggatgaagaggagatggaagaagcagccaatcagaagcttgctctgcaaaaggccaaagaagtggctgaagtcagccccatgtctgccgcgaacatctccatcgccgcgtaaggctcctaggagtggattgtggggtggcagtggggctgctgcagggtcccatggctgggccctccccagggcaccccttccagaggcttcctcagagggcctctggccttggcgggtgaggacacagcccctcctcggaactgggatgagagcctgggggctccagggctttttctcagtatgagcagggccagggtgtggccaggcacagccctcacattgtggctgggattgtctctgctgtgatattcactccctggatagcctcagggtggctccaggcccctccccaggcaactgtgaatcagttgggggagggagtcagtaagttgcttttatgcacagcttttcagaaatttattttatgagccaagagattctaggtgatacctgagcagtctgagagacttactgcagtttccaaaaatgtctctgcaagtgtttggtactgggacagatgttagaggaagttattctggcgaaaactgcgtattccatagaaccatatttggaggtgttaggggctttagagtttgggcaaagtgtccagcccagggccaaaggctgcactgagccgagctgtggggaggtcagtccctgggaagggaggcaggaaagtctggcccatggcctggtcacagggtgggccacaagagtgcagagatgcccttactgggagcttgttctctaggcccagctgaatttagctctggagccactagctccgtctggctgcatgcccaccccccacacctcccattccccatgctgatgggcgggccccagctcttcagccggccacccgccctgccgtgaacacggaacacagggccgggtgcagccacaggtgcatctgtagtgacgtgtgtctgcacttctgtgtaagcatgttggcatgtggatgagtgtgctaggtatgtgtgtgtgatgtgtgtctgcactgctgggtaagcatgctggcatgtggatgagtgtgctaggtgtgtgtgtgtgcacttgagagttgcacagtgagcatgtgtgtgagtgcatgtgctgagtgtgtgcacccccataccagccctgatcctgcctggagggcaccaggaagatggtgtttgcggagggcctgtctctaagcctagcagaaagtgctggtctttggggcagaagcagctagaagaggctgcagcccgccggggactcaggcagggatgggaggggcctgcaggggaacttggcagctgtggacacggtggccatcacgcagaagactgctgggggctcagtcctcagttgtttaatttcgatctttcattgtcttggccaattcggttatttggttcattagttatttagtccacttagtttggttacttggtccaggggtttgctaccagggctctgtgagctctgcaggtgggtggtctgcagtagatggggcgagtggtgtgttcagctcctggcctcgcgcaggcctcgtgttgttctcctgaagacttgccttctctgctgttcctggaggcgagcacttgtcccttgacccctgctgcctgccggccctgcctcctcctgggggtatgggagggtgtccactcccatctggcctgagaccttgcagaagaggctgccaggtccctggcagtcatggagcctgagtcaggctgcctgaaaaggaggctggacactcttccttatctgctgccctgtcctggtttggagacactgctatgcaggaacaaggcagtagactggcatccttgggcacagtgtacatcgacaccacctgttggcctgagcaccatgctgattcctacgcgaggaaagagcttcttttttcccgggggacccctaggtgttctgcctcacggtgggtctggagccaggtgtcagctccagtgccagcatcctcaactcaagcaggctgcagccctcacacgtggcaaggggcagccggcccaagccagcccgaggcgtccaggtgtcagcccccatggtccctgcctgcggtgcagctgtgggccctcatcctctgtggcatgtcctcagcccactggtttggacatgacagccagtctgatttccgccacaagagaccctgcaggaatcaaccttgaggggtttccctcaaggagggccctgcacctggcgaggcctggccctgctgctgctgtttgcgtgcctgtgttgtgctgagacctccgagggctgaaagctgtctgtcatctgtcctcgtctgcttcctgttctcctggtgggacgagcagcgctgcctcctgccctgctctcatttccagcaccttgagctgctgggctgtgcgagagcagtgcccttgagtacccttcacccttctgcccccaacagctgtgctgcgtggcctgcggagcggggccaatgccgggcttggtgccctgggtgctgggaggacttggggtgtccttggtgtttgagaggttctcagtgatgctctgtttggcttgacacagacggtgccagaacatgcctcagaagggcaccctagcgtgtcgcatgcagtgctgtgcgtatcctgggcctcaggtgacagctgcttgaagggacactaaggtgggcctcaggtgacactgcttaaagggacatgtcttcctggttctctgctgggtcagcctcatcctcacatgaatttctgaacactggcagcctgcagagtcacactgacactcacacacacacacatactcacaaatacatataggcaagcacacacacaggcacacagactcacatacacacttatacacaagtacacacagacacacagtcacagaagcacacacagaatcatacacacagactcacacagacacacacacacagacccaccctcacaacactcacaatctcacacattcagttataatcatcccacactgtcaatcacatacacacataatctcacacattcacacacagtctcacacacacagtgtcacactcacacaccctctcacacacatgcctgtttgaagccagagcctgtgggcaagtaagctggtttgactgcccacaaaggcacagagagcttggccttgagaaggaggggctgcagcccacctggccctcccctgggaagttaattggagggaaatggctgtaaagggagctttggtttctttctgttggttttagaaaagcctttgaaagtcacttggaaatggctggagctgcatccaaaaggaaggtgggttggcgtgtggcttgatttgccctggaggtgtcctggtggcccagaggcgcctgggttgcagcctggggagccctggggctggaaccagagtggggtccaggtgcttgccgggaagtcaggtgggttcggcagcagggaccaggcggcatctccggaaagggcaccctcgcctcctttgttagcctacgctgccccatctcgagggccgggagacggtgcggtcagcctcccgccgcagggtgcgggggcaccctcgcctcctttgttagtctatgctgccccatcttgagggccgggagaccgtgcagtcagcctcccgccgcagggtgcagggggctgtttggaactgcaggaaaatcggtgttgggtcttcccagccgcactgcctgtcctgggcagtgtgtgctgagtgatggatgggcccccgagctaatggcttctgtcttccaggcattacagggtttgctgtctcacttcagtctcacttttctgcatgtgtggaattggttctcaacttctctttcaccctgaggtctcggctggtgcccgtctgacggacgcgtctgcggcctcctgtccagatgcacatggcagcctgcgcctacactggcgtggctctcagtgtcactggttctctcagaactctgtctctggttttctcacttctgtctgttctgttttttgcatgtgcagttttgtaaagcaagctcgaggtactgtatctcgcagctcatctgtctccagcgtgaactcaccgtgagtcgctctgctacgatattccatccatggcttcatgataactacatgcagacaccttccttccactcctaactctgctatctcaccgcaagtcatttgcttcatggggcagctccaggccgggcttctgtggcctgagcggggaatggtgggcttgctccctgatgtccccaagtcctgccacggggtcagaccctctgcgctcagcgcctcctcctttccctcctggtctctgtctttttgtctgctgcctgttgtgtccgctcactccggtgtctcgagtgtgtctgcttctcctgagtggactgggcgtcatgggttcaggtctccttgtggttcccatgaggtcagggccctgtgagcaggcacagcagagagtgctctttaggggctcactggggacgtttatgggtcctcctaggccccttacttgggagggactgtgtctgtgattctcaggaagtccttgttctagcaagagcagagagctgttgtccacttgggaagctcacagtagaccacccagggcccaaggcagagacacggaaactccagggtggccctccagggagtgactggctggcatcccctcgggcagcttctcatggggaagtgctcatggatggctggtccgcaggggcttcccctggagggcaaggccaggccctgcaggtgaggggtccctgaagtggtcaggtgcagttaggccacctgccctgatggaagtggccaggtgcagttaggccacctgccctgatggaagtggccaggtgcagttaggccacctgccctgatggaagtggtcaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgtcctgtccctgtcctagtggtggtgaggcccctgccgcccccgccctgcccagtgcttccttgctggcagccagcatggagctgggctcagtctttccacgagcactgtttgctgctggctgtcagaggcactgatgtctcctggggcaagaaagcatgctggatcctgcatccatccgcggggtggaataagatgtaagatgcagatggtggccgggcgcgctggctcacacctgtaatctagcactttgggaggctgaggtgggcggattccctgagctcaggagttcgagaccagcctgggcaacatggtgaaaccctgtctctactaaatacaaaaaattagccgtgagtggtggcgggcgcctgtagtcccagctactcggtaggctgaggcaggagaattgcttgaacccgggaggcagaggttgcagtgagccgtgatcacaccactgcactccagcctgggcgacacagcgagactctgtctcccaaaaaaaaaaaaaaaaaaaaatgcagatggcaggtatccatggtgtcacaccagggctgcttcatattgtcagcagttccgggttgtctgagcccagagacctcaaagcagggccacagagcgccttgaggccacttccaagtcctgtagttccccacagcacccagctgagcatggctgagccctcctccctggaacagctgggttgtgcctaccagctgaggccaggacacaggggtgccagtcgtccatgtgacttccttaaagaacccttttaaaccaggactttgcctggattaatcaccagccacacttcactctaagttggtgtggatatgtgccagatagagcaaggacagagacaggggccaggggaggtgcaggctgacttaagacaccatgcagagaggcccggcacgcagattcagagacctaggggatacctccagagaggaacttggtggtgctggccgagtgagggcagatgcagacagtctctggtgacgttagggctgacagtggcagataggcccggaaggaacaggccaggtggaaccagtggggctgcggggggcgggcaggtgccctagcgtaggctgctcagcatgttgctctgcctgggtggtcacgggggagcctgccagcctgacagcgccctcagcccagcagacagcctggcctttccctgctccaggtgtttcctgggcgagaaggagccacacctgaatgcaagggtgagggcagagctatatggtctggagcccaccccaccttcacacagaccctgtgcctctgcatgttccccatggtcctcactgcctgtctttttggaactgcaatgctggtccccaagattcacggcttcatcagagcgggccaccctgctgaccaagtggctcagagcccaggcccctctcgggcactggagtggactgggaggcttgaggcagtgaacagcctccgccctcacagggctcctgtgcctggtgcaagcccctggggctgccttctgttttacaccactcagcactgttggcagtagagcccttttgtcttggtcccagctggggttggtgggtcttctgtgggtcagttgtagggcacccctgggagcaggggcagcacagtttaaatgcatcagggatacaggtcagggcctggggcttcaactgaggctgggggtctgcagacggcccctacaggtagccctgcctgcccccaccccacccaagctcccaggtgagacacagacaccacacttccgctttcattcgtgcaaagtgctgcccctggacattgctcccactgcagcctggacttctacaaaggggcaggatttattgttcacctgcctggggtgggccggctgcagggactgggctttcccacatctggctgctctgtctttgcaggtcagagtggtgctcagcggctcagggccccggagctggtggccgccggcctgggcctctgcaggccgtggttgtagcctgtgttgttagtgcagttggggtctggccaaggactcgtgtcttctttagaaatgtttttcctttttgcccttgcctgtgtctgatcctgactcactgtgggaccctgagcaagtaacatcctctctctaggctcagtatcttcatctgtgaaatggggacaagagtagcacctgattcttgaggtggttgtaaggactggatgaagtgggcactgcgcccagagcaccacgtggcagttgcaggacacagatgccatggccctcattgttggtgtagtcactgctgccgccaaggccatccagcagccttggaggctccagggcgggcctctggcctcagatgaggtttctccctggcgatggtggggcttagttttgggataataagaccttatccaaaggtggtcttactcagcagaaggcccagaatgcaaagggcttcctgtgcactctgggctatggagccccatgtgtgatgtgtgaatagaggaggtgcttgggcccatgacattggagtaggggtcaaggccttcggtagcccatgcagtgagggccgagcctggaccactggccatccctggtgctggagggctccgaggaccatgttctggctctgctcccagtagagggaggggctctccatggagtcaagagagaggagggcattggtggccacgggaggtggcatttccagcttcagacctgacttctgggctcctggtcactgagccagggggcagctgcggggctgcggctgaccacctcggggactggcagaggctctgcgtttgctcctgaaagggccaggtgctcccttggctgctgtctgctctgccacagcaactgccctctgggttccctggcaaacagccttttcacctggctggtggcctgcctcctggaggcagcgatggggaagtgcctctggagaaggggccgcgtgtcccgcccttcctgtagcagctgtgctggtgctgcagcaggggccagctcccagggaggctacagggcctccctggctcctgcctctccatccgtcctgccctttgtaacatgcccttccctcccgcggtggccttcctggccagccgcccacccacctgcttggcctgtctggtgcattcccactgtcctgtacccctcggcctccttgagccccccagggtcctcctgacaggctggtgctttcaccttgcgggtcctgtgggacaccgtggggggggggggcggcggggctgaattcggttcccttgggcgttccccacctgatccgcgtcccccgaggggtgtgggggctcccgcggccacgcctcccacctccctgcgccattactccattgctgtgtgtgcattgtggcctccctggagagcggcgggcgggcggcagacggggccgcgctcaccgccagtctccccgcagcaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccggtgagtccgcggctgggcggggtcagggagggaagggttggccggggcggcgcgggccccagcggtggctgcggccatggggtccacggcggaggctgcagccccggccacgctgccatgtccagagccgtcggggctggggtctctgcatgccgttcacgtggggtggtgacaatcctgccttgcagggttgacctgtaaaaggcttggcagggcgtgtatgctccgtaaaaggcttggcagagtgtttgtgctccgtgaatgccagccgttatttaagaagggagggcttaagggggaattgttgcgactggcttggaaagaacaaagtggccctgggagaagagaaagttggggattgcagtggaggaaggagaggcagaagggcccaagggaagcctgagcaggccagtgggctgggcgcagagcggggtgtgggggccaggctgtgtgaccatgacagaaagaaccccagctagcccagcttgctccctggggcaggactcaccaaccccgtgagggcctggggtaacagtggtccagtggccaagaccagcagtcgccaggtacccactggccacaaaccaaccagaatacttgccgctggaggccccagcccagggtcaacccagccgccgccctgtctttgtgtgtgggtgggtcagccccatccctgcctttcggactaaagacacggaggtgtatagagtaatttaaaaaacgtacagaaggccagagtagcagagcaggtggttatggatttagttggtctgcatggaggcttaagggttttggttgataggattttgctgatgtgcattattattattattattggagacaggaccgcactgtcgcccagggtggagtgcagtggcgcaatcatggctcactgcagcctcaacttcccgggctgaagcgatcctcccacctcagccttcccagcctgaatagctgggactacatgcacgtgtcaccacgcccagctaattttttaatttttgtagagatggggtttcgccatattccccaggctggtcttgaactcctgggctcaagtgatcctcctgcctctgcctcccggtgccgggatcacaggtgtgagccactgcgccgaggcctgatgtacattcttgattgcagggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtgagtatctccctgtgccagtggggcagggcccatcttgtgcaggtccagcaacccccattccctcctgctccacagcagccactggggacccagcctacctctgtgaattgttctcctggctggagagagagtcctttgctgtcaacatctgtcccttgatgtcctgttgatttctagtgccccagagataactgaggttgagctccattctccttccttcccaaaatatttgcacgttgccaactaagtgccaggtgctgtgttagagtgctgagagcatagtaggagggagacagtcttgtcaggaagacagaccacaaaacaggcacaactcttgatggttgcacaaaagctgctggctgaggactctgtccacggccttgactggggctgagagcgaggggctgcagaggaggaggctctccactgcgtctgcccatttgttcatgggcctgtgccatccctgctctgaggctgtgctcccaggcctttatttgagctgccttctttcctccccttgctcactcacatgctcggaacagcctttccatgcctgcctgtgtgcagtccctgagggcacaggggaccaagatgtcattcctgtcttgaaacctgtctaatagggagagatctgctggttacaaatacaggccccttacgtggtggggaaggtgcatgggcgtttcatgggcatcaaggaggagccctcctttcttaagtacagagaaaaaaggggtagaagagaggccatagaaacaggactcacatgaatgccagcagaagcatttaggtcttaagcagaccagacggactcaatcaggtgccaccacatgcatgcccatgtttgcagacggatctccacacacagatgtgtgcatgtccgtgtttgcagatgcatccgcacacacagacgtgtgcgtgcccatgtttgcagacagatctccagacacacacatgtgcatgacattctctcttgctcaggtgctctcacctggggcctgtggactggcgcacaattccaggtataaccatggaagacacagcctctaactgctcagcctccccttttcctttgcttccttggaggaaagttgcccttggttcattttcttgttcacttcccatgggcacaagtgagtctgcctgcccagctccctcacctgattctctgtggatcagcttgaggatgagcctaggttccctacctggcttttatctgcaggaatccagatgtgactcctccccaggctccctatgctcttccccacacccctgttggcaaccactgattttttcactgtccctatagttttgccttttctagactgtcatagggttggaatcatacagtatgcagccttttcagattggcttctttccattagcaatatgcacttaagtttcctttgtgtctttttgtggcttgacagctcatttgttttaagcgttggattaatagtctgtcttttgggcataccacagtttatttattcacctattgaaggacatcttgttgcttccaatttttggcaattatgaataaaactgctttaaacattcatgttcaggtttttgtgtggacataagttttcaactcatttgggtaaatacttaatagcatgcttattggattatatggtaagactgtttatctttataagaaactgacaaactatcttccaaagggactgtaccattttgcattcccaccagcaatgaatgagagttcctgttgctccacatccttgccaatattcagtgttgtcagtgttttggatttgagttattctaattaagcgtgtaatgatatcttgtttattttgcaatttcctaatgacatatgacgttgagcatcttttaatgtgcttatttgccatgtgtataattttctttgatgagattcctattcaaatcttttacccactttttattctggctgtttgttttctagttgttgagttttaggagttctttgtatattttggatacaagtctttcatcagatatgtgtttttgcaagcattttctcccattttgtggcttggtttttcattctcttaatgtctggtgttttcgattgctaaaaacaactgattgtctggtccctattattacttctactagaaacagaaatctaggctattagtttttatatgttgattatgtatcctgctacttttctgaatcctcaaattgtttattagtttcactgattccccctttttttccgagatatattatcaaaacttctgcaaatatacttctaactctttctaagtcttacaccactcattattatttttttgtctgatttcactatcagataacaatggaattactgggcattaccttgtttccgcctacattaaataaaattttggtttggggcctgagggatgtgtgtgtgtgtctgtttgtgtgtgtgtaaaattatgttgtggtatccattagttcctacttcagtaagtgtttttatctggaatagatgttgaattttcttgaagaccttttcagcatccatagagatcatatatttttttctccttagatatggggatttatagtaatgaattttttgatatgaaatatctttgcaatcttagaataaatccaagtggttattatatttattttgtaatatgccattggattctctttaacattttttgtaggatttttggattgatatttttaagcgagatgtgttctgtagctttcttttgtcacatttgaggatcataaggtttaaatatcaatgacatagagttatctattgcttaacttcacagctccattcctgaaaatcaaatgttctaaaagagggtctcatttccactcccccccaaccttttttttttttttttttttttttttttgagactgagccttgctctgtcaccctggctggagtgcagtggcacggtctcggctctgcctcccaggttcaagcaattctccttcctcagcctctcgagtagctgggattacaggcgcccaccaccacacctggctaatttttgtatttttagtagagatagggtttcgccgtgttggccaggctgatcttaaactcctgacctcaagtgatccacctgtcttggcctcccgaagtgctgggattacaggcgtgagccaccgtgcctggccccattattttaaatggtaaaacattataatgtgttatgtgtccgctaaaaattcctaaccgattttgtaaaatataaagcacagataaacaatgaaaactaataaacagtcataatagaacataaaatgcttcacatattgtttcctgattaccagttaaaatagctagtaataagcaattgctttagatacctcctttattgaaacttgtacttttcaaaaacatccatacgattcccataacttactgtgaacaaaagttctctgaaaaggagtttggaggaaacaggctttattctagtgaatagtttgcaaaccaggaagatgcagccttccttgtaaaatgaaggcgcattccagaggagaaagagaagttttgacatttcctgcccaggtgcttaatcaagtccctttatgcaaatgaaggattcagacttgcttggtctgattggttgacacagctgagttctgattggtccatatagctgagctctgattggctgaggcaagtgaactctgattggttggttcaggtgagctctaaaagttcccagagttaaaaaggtgtgggttttctgggacctctattcagcatatggctgcttctctctgacttaaatgtaggctcagttagccacttgggatccatcttgaaggattagctctttcaggtttcttcacacaaccaactgaatttggaatcctgcctgagagttgttccccacattattttgttaaaaacattatattgacttttgggcatgtatacttttttttaacataaatgtcagccagaaaagtcaacaacactgtaatgaaagatatatatgttttccagaagcatgggcattataaaacttggcagtgctctattgggaaatactatccaaggatatattctgtaggatattcccgttattggttcataaaaataattagaatgtcttcttgtgctcaagggtagctcatgtagtataggaattatgtggtctttaaatatttgatagaattatcttgtgaaattgttgatgtctggtctctttttgtaggacagttcctttgtaatacccctttttttgtatggatgttggtctgcttaaacattgttgcctcttgagatgagtttggtaaattatattttccttagaaattatccatttgatctaggttttcccacttacttacatagccttaagagtggcttaaagttttaaaaatttccctctgtttcagtgtttttcctccttgtcatttctgatcctgtgtttttttgtgtttttcttttccttttttttttttttttttccagacagggtctcgctctgtcgcccaggctggagtgcagtggtgccatctcggctcactgcaaccaccatctcccgggttcaaagtgattctcgttcaaagtgattcctgagtagctgggattacaggcacgcaccaccacacatggctaatttttttgtatttttaatagagatggggtttcaccatgttggccaggctggtttcgaactcctgacctcaagtgatctgcctttctcagcctcccgaagtgttgggattgcaggtgtgagccactgtgcccagcccattttcatcaaatttcaaaattaactatgtaattttggcttatatttgtgctaggtgtgtgtttgtagattctttgggattttccagagagtataaggcatctgcaaatgaacagttttagttttttcctttctgacatacatgccttttatttccctgtcttcccttattgcactgtctgtgacttccagtactattttgaatagctgtggcaagaactgacatctttcctggagggaggattttgtctttcatcatttagtatgatattagctgtaaggtttttgggtttgtttggttgttttttgttttgttttgttttttggtagatgttctttatcaagttgagaaagttcccgttcattgcttttttttttaaagaatttttgtggtgagtggatgaatattgtcaaatgattttctgcatcaattgatattatcgtgtgtgttttttctgttatatggtattttatattgatttattttcaaatattaaactggcctttatcattatgaataaccctactggtgtataattatttctctatgttgctgaattctatttgctaatattttgttaaggagttttgcgtctgtattcatgagggatgttgctctgtagttttattttttgtgctgtctctgtctggttttggtatcagagtaatattggattcataaaatgttttgaattgaatggattgtccctcttctattttctagaggagattatgttgaactgatattaattctcctttaaatgtttgggaaattttgccaatgaagcatttcttttttggaatttttaaattacaaatataatttccttaatagatacagtgttatctatttcatattggatgagttgtagtagtttgtgctttatgaggaattagtcccttttatttaagtgtatacagttgtttgtgatgtttccttattatccctttgatgtctgcataatctgtagtggtaacttgtgtctcatttcttatattggtaatttgctgtcttctctcttttttctttgtgagtcttacgaggagtttgtataattttattgatgttttcaaagaaccaaattattgttacattgattttccctattatttttctgttttcaatttcttttgatttctgctgtttattatttccttctttctgtttgctttgggcttcttttgctcttcttttctagtttcttggggtaggagcttagattgttgatttgagtctttccttcttttctgctgcaaacatttagctctgtaagtttccctcttggcagctgcattccacaggttttcatattgtatattttttcagtcccgtttaaaaaatttcctttgagaagactcatggactgtttagaagtgtgttgtttagtttccaaacatttggagatttgcctatttctctgttattaacttctagtttgattactttatggtcagagaacatgttctgtattatttcagttcttttaagtttgttaaggttcgtggcccaggatgtgggatatcttgatgtatgttctgtgagcctttgaagggaacatgcattctgtgttgttgatgtgcattcctataagcattgtttagatcctgttggttgatgatgttattgagtatctttgtctacattcggattttctgtctagatatgtcaattgttgagaaaaggatattcagtctccagctgtaaatgtggatttatctttgctcctttcagtactgtaagtttttgcgtcatgtgtttgcagttctgtttttgggcacatacacatttaggatttctatgtctttttggtggactggccctttaattgttgtgtaacgtccttctctgtacctggtaatcttctttgctctgcagtctactttatcttatgtagatatgttcagtcctgccttcttttgattaatatgtgcatggtatatattttttcaaccttttgctttcaacctaactatatagttatatttgaagtaaatttcttgtagatagtattcatgttttcaatccactctgtcaattctgtcttttattttgcatatttagattgtttacacttagcataattattgatatattagggcttaagtctgttattttatttcttattttgtttttctctttctgtttttcatttctctggtttcctttttctcccttcctgtgggttacttgaatgtactttagaattccttttatctgtagtatttttgagtatatctcttctataggttttttaagacctcgtataggtttttttagtggttgccctgtgtattacattatatatacataacttactccagtttcttcatgtagtcattttaccagttcatgtgaaatatagaagctttacctctctttatatcgctttttcctcttccatttgtaatgtaattgtcttaaatagctcttctatgtacttttagaaccacatcagagtatgttataatttttgcttcaactgtcacacataatttagaaaactcgaaaggagaggaaaagtgtgttgtatttacctgtatttttactcctgttattctttcgtccttcctgatattccaatatttcttctttcataatttactttctgtttaggggaacttccttaggcattcttttgtggtaggtctgcgggtgacaaattctcttagttttccttcatctgagaatgtcttgattttcccttcattcctgaagggtattttcagtgggtatagaattttgggttgacagttctttttttttcagcacttgaaaaaaacgtgtgcctcttccttctgacctccatggtttctgatgagaaatccactgtcattcgaattgttttcttcctataggtaagatgttgtttatctcttgctgctttcaagatttttttccttgtctttatatttcagaagtttgattacagtgtgctttgatgtgagttcctttaagtttatcttgtttggggtttgctcaatttcttgaatttgtaggtttatatcttttgccaaatttggaaatttttcatcctttatgtctttaaatacttctttagttctgcctctttctcttttctttccaggactctgatgacatgaatattagatcttttgttatagtcccaaaggcccctgagctctgttcacttttttaagtctactttctctctgttgctcagattggatcatttctattattctatcttccagttcactgactctttcctctgtgccttccattctgctgtggagcccatctattgattttctaatttcagtcactgtatttttcagttctgaagtttccatttggttcgttatatcttctttttctttcctgagactttatttctttgctgataattttatatttttcatttgttttaagtgtgttttaaattatctgttgagcatttttataatgggtgtttttaaaatctttgtcagataattctaacatctgtatcatcttggtgtctgttgattgtgttttctcattcaagttgagatttcctggttcttggtgtgataagtgaattttggttgaaacctagactctcagtggtattgtgttatgagccctaagtcttatttacatcttcagttttagcttgtctactgtgatgccacgccagcaagtagtggggcatattagtcctttctcacactgctatgaagaaatacctgagaccaggtaatttataaaggaaagaggtttaattgactcatagtttcacattgctgaggaggcctcaggaaacttaaaatcatggcggtaggcaaaggagaagcaggcaccttcttcacagggtggcaggacagagtgagcgcaagacacttaataagaccatcctatctcgtgagactcactatcacgagaacagcataggggaaaccacccccatgatccaattacctccatctggtctctcccttgacacgtggggattatagggattacaatttgaggtgagatttgggtggggacacaccaaaccatattacaggggttgtagagagttgccccattattgacagatgggaatagaagtatggattcttcacttgagttccactgacattctaggggagaaggattactcattactgctaggctgggctgggagttttagctccccactaggcttccattcataccggcctgactgggagagataggagtatcttgttactgttccccagctggctggccttgacacagtggagatagaccttatcacctccaggtagcagtagaagtcctgactttccactagggcttgctccattgagtaagaggaagagattgtctcattcctgctgggtgagacgtgacgtctaggctccccgtgtgatctctactggcattgtgtgtattgggggtcttgttaccactagatagggatgaaagtccctgctcccacttggctctctctcagaccaccctagcaggggctttgggatggtggtgagggtggaagtctaggctccccacccagtttctgctggtataagtggaagtagggtcatagttttttttttttttttggcttgtgtgtgtagtttggctattgtttagtgattattgtctataagttttatatctcggtaggctgcccctttcctagtcctttcactagggagagctgggtttattgagcctttaaaaaatctgtgcctattggcatttctgggttgttgggttcactagtaccaaatctaggatatatatgaggcataaaagaaaactcaaataagaaacttattgttgtgtcattcctcaggtcccaaggtccctagccaatattttctttcttccttctacctgttagaatcttatatttgccttatatatgatgtgcaaggatcttgtagtccccccttatccatggttttactttccccactttctgttatctgaggtccactgtggtctgaaaatatttattacataactactctcgcactttggggccattattaagtaaaataagggttacttgaacataattactgcaataccatggcagccaacctcataacccagatggctgctaagtgactaatgcagtccaggtgggacagagcagaacggtgtggggtttcatcatggtacttagaacagctagcaacttaaaacttatgaattacttctggaattttccacctgcatcacaatgcctgtgtcattcacctcagttcgtctcatcatgtaggcatttcattatcttatagcatctcaagaaaaagatgaccgctggccgggcacagtggctcatgcctgtaatcccagcactttgggaggccaaggctggtggatcacttgaggtcggaagtttgagaccagcctggccaacatggtgaaaccccatctctactaaaagtacaaaaattagctgggtgtggtgatgggtgcctgtaatcctagcaacttgggaggctgaggcaagagaatctcttgaacccaggaggtggagactgcagtgagccgtgagctgtgatcgtgccactgcacttcagcctgggcaacagcgagactgtctcaaaaaaaaagaaagaaaagaaaaagatgactgccagtatctgtagaaactagtttcttattattttttaagtttctgatggattggtagttgtggccacttttatatttctgatagccttccctccctccctccttccctccttcccttgataagcccttttttccctgaagttttgtccacttaaatggtttatcaatgccccagtctttgtctttcttgatcttctctgttgtatttttgttttctgtttcaccagtttctgttcttatttattatttcctttcttctactttgtgtatgtgtactgtaatattctttctccaatttattagttggatactcagctcatgacattgagcttttctactttgctaatgtgtttaaaactttaagtttctctctgagagttattttagttatatattgaaagtttaaattttttgtttcaaatattttttccaagtgtgattaagaattcttgtttgattcatgagtttttaaagtaagtaggattttaaatttctaattgacagagatttctctatcttgttctcttttcctatgttttgcagttgattctgttattccttttcatatttcatcactccttatatttcggatcatccattgggtttctttcccccccgccccttctgcctgaagaacagctttcctaatttttttttttgtttttgagacggagtctcgctctgtcgcccaggctggagtgcagtggcgcaatcttggctcactgcaacctccgcctcctgagttcatgccattctcctgcctcagcctcccgagtagctgggactacaggcgcccgccaccacgcctggcttattttttatatttttagtagagatggcgtttcactgtgttagccaagatggtctcgatctcctgacctcgtgatctgcctgcctcggcctcccaaagtgctgggattacaggcgtgagccaccgctcccggccttcccctaatttcttttagtgaggtttgatggtggtaaattctcttggcttgcctgaacagtctttattttgccattgtttgtgagacgtggttttacatcgtagaaaattctcatttgttatctttatttcaacatattgagactgctccactgtcttctgccttctgttgtttctgttgagaagccagtcattcgtctaaattttttttcctatgtatgactgtcttctctctggggctgcttaaataaaatcaattttattgtggaaaattgaaacatacgggaaagtggagaaaatgcggtgaactcctgtgctccgtctccacccacattttgccaatgttgtttcacttacgcttcttcttgctttcttgtgtatcattttaggtgtaatacgccaataagcatgtctgacaattaaggatttatcatagctgtagagcattattacacttagcaatgttgacaataattccttaatattatctaacacctattccaagttcaaattttactagttatttcaaaaataactttttacggttggtttgagtcaggattcaaatgaggtttactcatttgggtttgcttaatctgtctaagtctcttttactttaaaagagttttcctctgcttattcatgccatttatttgttggggagaacatatggtttgtcccgtagaatttctcagtttggttgtttgcatcatggtgttgtttggtacagtcctctgtcctcagtgtattctgttacctggtaattagatccggaacagggcttctcagccttggagctgttgaagctctattgtggaccgtggcctctgcattttaggatgcctagcagcatccctggcctctgccttctcaatgccaggagcacccactagttgtgacaaccaaaggatgtctagagaccgttgtgaaagaatccaggccgggctcagtggctcacatgtgtaatcccagcactttgggaggccaaggtgggaggatcacctgaggtcaggcattcgagaccaacctggcaaacatggtgaaaccccatctgtactaaaaatacaaaaattagccaggtgtggtggcaagcgcctgtaattccagctattcaggaggctgagccaggagaatcgcttgaacacgagaggcggaggttgcagtgagctgagatcgcgccatttcactccagcctgggcaacagagcgagactctgtctcaaaaaaaacaaacaaaaaaaaaaagagagaaaaaatccagttcccttcttttggaaggcttccaggtggtggtgtacacttcctgccatatggtatcaggagctctgtcatgtctgatgtctctttgggtgatactaacatggagcagtgggttcagcctgatctgccattgtgaagttctccactggtctttccctaaatggttctagtgacattgatgattgttacccagatctgtgagttcagtgagggtcgcaaaatggtgaatttataatttcatgattctttctgtgtttgttattttgactttttctgtaagaaagatcttacctcattaactgcttggttaccctgaaattcagtttgtatgtgtattaaacaaggtacttggttcattctgtccctttatttataagttttcaaaataatgaatcaatgccctattaacaaataggaccagtgagagctagaagaaaattattcttgtaaaattttgaattttaacgtgtttgacgtatttcagttctttgcaatcactattacttttggtgcttaaattgtcctatcttggccaatgttcaccctttcaagttgatcgttctgcccttctcacaggcctggagtagagtttgacagttatctggttttcgtctatgacagcatgttccaggatcgttgtgcacacttcctgtccccgatctggaattgctcatttctccaagaagcagcacacgctggacactgccgtgattcctgtggattccacccccccacccctgtactctggtggcctttgcctccaggggcttcctcttcagctcctcttcagagacttcccttggactacaggaaccacgggaagtgcatgggagtttgcatcccccaaggtggcacttagccagtgaagggaaagtgcaggtgcaggagagccagctctctggcttcagtcagtacaaccttctggttcagatgagagcccagagtgtccctgtgggagcctaagccacctttgcaggacctggtctgaagtgcacccttgctcggcttctttacctccctgtcttgcttttgtcttcccgtctggaagcccgtctcacctcacggtgtgcttctgtagaacctgactggagatgccctggctactttgatgagatagagtatttagagacagtcatctgtggtcattgcttctgggtttttattgctttcaggctttttggtgggctttttaaaaagagaaaagtggctggatgcagtggctcactcctgtaatcccagcactttgggaggccaatgtgggtggatcacctggtgtcaggagttcgagaccagcctggccaacatggcaaaaccccgtctctgctgggaaaaaaaaaagtgtataaaaattagccgggtgtagtggggcgtgcctgtaatcccagctactcaggaggctgagacaggagaatcgcttgaacccaggaggcagaggttgtagtgagccaagatctcgccactgcactccagcctgggcgatagggcaagactccgtctcaaaaaaaataaaaaataaaaaaaaaaagagaaaaatatgtcattaattccgtggcatttgtaattcaaatagaagattgtaggattttaatctcacttttgtatttatctcttttcttctatcctgaaactgtctttttgtctttttaccttgcttattctgttttttaaaatggtattgtttaaaagttttttctttcctaattatttgcttctactgcatagaaataataagcagtttcgtctgttggttctgtgttcagccacagaattatcaaacaaactctcgttactctaagtaattttctgtagattattttgtttttttaggacacagttgtaccatctgtgaatatatcatttttgacccatgaattctttagtctttttttcagtttccaaatgtaaaattttaattttaattaatctgtttgtttctggtttctgccttaatttctaacttaagttagaacttaagttagattaggagaacatgatctgtatgatagttttctttgaaattcatttgcatttgctctgtgccttggctttatggtcagcttttttcatggtcggcttttgttcttgttctatatgtgcttccgagggatatgttttctctaattttgtgagctctgagttttttatatttgtatgctaaatcaggtttgttagttgtattactcaaatattctttatattcattaatattttgcttgattgatctgtcaataattttgttttatttttatagagttagtggggacaaatgcagttttgttacattagatctattgtgtagtggtgacatctgggcttttcacgtagccatcacctgggctcaggccatcctcccacctcagcctctgcagtagttggaccacaggcgcacaccaccatacccagctaattttttatatttattgtagacatggagtttctccatgttgcccaggctggtcttgaactcctgggctcaagtgatccacctgccttggcctccaaagtgctgggattacggttgtgagccactgcgcctggcctatatttacttactttatgtatctcatctaagaattcctgtatctgaagtctttaggggtgtgagtgcactcattgtttctgttgtgtctttcagtaatggtgaccttgtttcatggtgtgtttggtgatattgcttgagttcatatatgactgatcttaatcctttgtattagtcagggttctcttagagagacagaactaataggatatatatcctatatatatatgtatctcctatatatcatatatatatatataaatgatatatgtatgggagtttattaagtattaacttacatgatcacaaggtcccacaataggccgtctgcaagctgaggagcaaggagagccagcccgagtctcaaagctgaacttggagtccgatgttcgagggcaggaagcgtccagcacgggagaaagatataggctgggaggtgaggcccgttgtctccttttcacatttgtctggttgacattcgctggcagctgattagatggtgcccaccagaggaagggtgggtctgccttccgcagcccactgactcaaatgttaatctcttttggcagcatgctcacagacacacccagcatcaatactttgtatccttcaatccaatcaagttgacgctcagtattaaacatcacatcctccttttctcaactaaggttttgtgagctaattaagccctacagaaaatgaattaacaacgttttcagttttctcaaggatggaacatagcttgtacctctccagatatgtaggagagaaatcctttctcttgggatatctttagatatcttgggaaacaatagcttaaattatctccaaattccccctaacctgtggggactctgtaggccaactgaggaaggtttttgtcagagaggatttgcatttgttgtttccagaagcctgaggtgctgccagtccaggcttactttagccccgctttggggatgattcctattcagcttccccaccttgaagcgaacccaaggcttgggactcctacctgtgcactggaaagagcggttcctcagttcagcctcagtttcttaatctggaaaggggaacctgtgccatcgcatgctgttagggggagtaaagcacctgggccgtgtctggcatgtggctgtttttagtgaaagctctcttcctttctgtattcccctccaaagctcgctgttttgcttcattgtctcctatttcagggatttaatttttttaactattaagtctttttaaaaatagcctttctcctagcctttctccaacaatgactttagtctgttgcagttttcatttttatcctttccgttctttcttctgctttgactcaattgacatttttttcctatgattgatgactttcatatgattttccatgttgtagtaaatcgatttcagagaaatagttccatccgagccctggcatctttgtcctgtttatttcgagcagcagaagtcttcattgaagccagactgattcttttttccttaatttacttaagttaattaattatttatttattttagagacaatctcattctgtcacccagactggagtacagtggtgccattgtagctcactgtaaccttgaactcctgacctcaagtgatcctcctgcttcagcctctggagtcgctggaactgtatgcacgcgccaacacaccctaattttttaattttaaatttttttgtagaaacagggtctgtcaccatcttgcccaggatggtctcgttgcttgagactcctggactcaagggatccctcccaccttggcctcccaacgtgctgggattacaggcatgagccaccacacacagctgtggcatgtttaatatccatagtatggtgcttcttttaaatattgcatattttacttagtcagtttatggttgtgcattttataatttttgttattgtaaaaaaacttacaacacacgcctgtaagcccagcagtttgggaggccaagaagggcggatcatttgaggtcagaagtttgagaccagcctggccaacatggtgaaaccctgtctgtactaaaaatacaaaaattagctgggtgtgttggcgtgcgcctgtaatcccagctactcgggatgcggaggcaggagaatcacttgaactcaggaggcagaggttgcaggatggtaccactgtacttcagcctgggcaacaagagcgaaactgtgtctcctgtctcaaattaaacaaaaacaaaaaaaaaacttgcaacaaaacttttgggaatacatatttttgtgggcatgcttcatttccttagtaggtaatgtctaataaattaatagaattttttggggcttcaagtaagttttgccagattgctttctcagattacataatttttgttttcaacagggaagtttgatggtgcccatttcaaaagtggtcgctttaaactgcttgtgctcgtgggcaggggctggttatcttggctctggagccagcatcctcggtggtatagaccccactgctgtggccttcgctgttttcatgctcacctcgaagctttttttctctggcacagcccttctctgcaggacctcaaagtggccagcagtcaaggcctccacagcgggctctggggattagcaccttcactttgttgcttcttaaactcctatttgcttttatgtttctttaaagaactcaaaatgagttgcagcagtgggaggcggctccaagtcactgcacgtcttccttggtgtccctgaggtctcaagagctctgtcatctataagaattgaaatatacaataggatagttgaaaatgaagaattattgtgagaaaaacactgggcagggacaacaaaatttacctaaaaaaacaaggtggcggccatattagccctggggagtttgatttgtgggagcacagctggggtgtggtggggtgctgagcggtagaggatgggccctcggggaaggaggcgacgagtcggggcctggcgagggagcagggcctgagcagaggctgggtccccctgggaagggcgtccttccaagctccatggcctcacaggaccctctcctgggatctcgaggaagaaaatcccaggtcaagggagactggacaacgaggtacagggagcctctgtgggtttgtggatcgggggctggcccctgctcctccctgtgctgcgggttcgaggtcccagcagaggcagtgggaaggtctcaccaggctctgggcttctcagcgcatcgaggcccctcagcgcggcagaggggtccacagccacgggtgctgggctcggtgttgttgccaacgttggtgcagcaagaggtgaggaagggtccgttagcgtctctgcggcagatggtggtcctggctgtcgtgcgccacggtcatgtacgtgaagcactgttcttagctgcttgcccatccctggtgggcctgtgaggacctgacgcaagtgccgggggcatgggagctgggagggagccacgcaacgtgggcttcatgtgcactacaccccttactcgggggccctgtgtccttgtaggtggtaacgtggacctggaaagccaagcagaggggaagaaggaggtggaagcggatgacgtgatgaggagcggcccccggcctatcgtcccatacagctccatgttctgtttaagccccaccaacctgtgagtctccttgcctgctggtgtgtgtggccgcccactcacccatgcatcatgacccgtgggatctcagtagccagcgtgcactgattctgcgcacttatgtagagaaacggctctaaatcccatggcagaccccagaggcacgtgcccgtgtgacctcattctgcagaagaggacacgggcacaggaggcagcctcagcggagctggggtgagctccaggcctgggctcctcacctcctctgtggtgtgcgtgtgtctctgcacacagggacgccgtctgccctgtgtcgcaaacacacttccatccatctgccttcccatcacacctggcacctgtgttgcctgcgtgtgtgcactgtgtttatttgcatgtctatccgtgtgtccacgcctgtgcttttcatgcattcatcatccactcttcagtccagggcttccattagtccagccagtgtttctgtggcagacagcactctaggtcctgggaatagttaggaatgaacaaaacaggtgagaacccctgtccttgctaagcctgtgtgctggtgggagaggcggacgacagacacgacaaataagtaaaagacataagatgcagatagtgttaagtactaggaggaaacacaaagcaaggcatggagatgcggaccattgggtgctaaaacttagatgagaaggtcaggtggggcttctggggtgagactggagcagagcttgaggaggaggaggcagagggagaggcagacaggggtggaaccacacaagagcttgcccggccagagcaggggctgggcaggtggacgggagggcagagggcagcaaggctgcatggacgtacccctgttcgttaccgatctgcccatccccttcttctttcaccacccaaccgtctttctaccaagccctgcattaccccgctccctgcctcctccccccagtcactcttttatccaacacacatgtcttgggagcttaccctgctacgctgcggttaggagtaaagcggtaatggagacagacgtggaccctgccatgtcaggactgacagtgcagtggcaggtgaggggtggtaacccggtgtggaaatggaaacacaggaaggcactggcattctgggagcaggtgatagaaggccagggaggttttctggtggaagtgacatcttggttgaaacctgaaggatgaataagagttaaggtgaagaggggagaggggaggaactagcggagcattcacagtagcccagaagtagaagccagcagttggcacacagccaaggacagaactgggtcagaacacaaaagggtaggcagagctggctggttgttctgttgtggggttggggggttgcaccatcccggagcacactgagaagcgtgggacgtgtgcacagtgggggtactcggattgcagcccagcagggcccttttatggggagactacagatggaggccactgagtagatggtaagggtttcaggcagagagagtggtggtttgaccagggtactcatagtgttgaggtttggaagtcaggtgcgtatggaggaattttagaggcagaatctacagaatttggtgataaattagatgtggaaggggaaggagacatcgaggatgtctgactgaaacccagtttctgcctgacagtggcggaaggcactgcgttcactgagaccagcagtgctgctggggtcccgcctgcagaccctgcaaagcctggggtggctggggatgtctcatggccaggtggacttaggatctgagctgggggctagagctgagtgccagaaacccagacacaagttggagtggatgacggctgaattagaaggaaaggcaggggaagtggcaagggttgaggcagcagcaggctggcggtgggccagggatgaacagctctgtggacacaggggcaggagctagatggctgagttcccttcaaggaagagggagatgtgggcagccgcttaagatgaatggcccttgggggttcgcaggtgtgggtgagaggaagagcttagaggggctgggggcggtggacacgcctgcgaggcaggggaggcatctccagagcacagccctcgtgatgggggccgtctgccccacctgctccgtccacggctgcctcttctggtcccccacccgtagatgggcttcccagcctcctggttactgtgcactctcacgttgtggctctgccagtagcagggaggcccctgcttgttgatttcctcgctgcttcctggtgttttgactgctgaatggagcttcatcaggcctgttctggtcacccctgtgtcccccagtgtccagcacatgcctggcagggtaggtgctcagtaatgttgaacaagcgagtcgggcaaatgggactggagcaaaaggcgagcacgtggcagtgtgtggagtgtgtccccgtgcagcgtgttcacgtggagcgtgttcacatgcaccctgggagcctggacagggcacacaccccgcacaggccccagagaactttcctagggcaagagaggcctgctctccgtgagaatgttgacgctgaaattcttcctctctgagcaactccctccctgctgcccacagctgacctcttctgtgaaagggctgggtagttgatgctgttggctttggactgctgttggctgcatggacagttggtagtgaatggatgtagctgtactccagtgaagttttattcacacaaacaggtctccctatctggcctgtgagctttggtttgttgacccctgccatgaggttctgcagccttccccaccccccgtcccgggaggccctctcaggaatctcagccactgtccgtcacctggctgccaccaccaaccacagggaccattagcaaagcgaagctctggggccacagcttcctgaggcagcccagagccctttctgcgggacgggctgagcctgccctgtggcaaggggtggcgcgcccggctggggggccttgtggtgatccgtgccttccctcacaggctccgccgcttctgccactacatcgtgaccatgaggtacttcgaggtggtcattctcgtggtcatcgccttgagcagcatcgccctggctgctgaggacccagtgcgcacagactcgcccaggaacaacgtgagtggcccggatggccgggtccccgccaggctgtggcgggggagctgggtgccttcccaggggcccaaggggctggggtggggctgaggtcctgtcgtctcacagggcacccctccttcctctgtctgtgtgcctggcagtgcacgaccaaaggtctggagacaggaagacagggtgcggcagagggggcctgttcccagacggtgcttgtcagagacccccttcccagaaccgttttccacaggcttcctggctccctggctgactgctcagaggcctggaggaaaaactcggagccaccgagggcaccctggctcagatttcagcccagcctttgagaataaccttccttttggtttcaggctctgaaatacctggattacattttcactggtgtctttacctttgagatggtgataaaggtgagatatgtggctgcccttgtgaccccagtgttttgctctccctccctcatgattgagatgggaccagggcagtggttgaaccacaatttctataaactcttaagacatatggtaggtgtgtgcgtactgggtgtgtgctcagcacatgaacatgtgcacacaaagaggctttgtcgttcactgagaaaattacttcccgcgctgggagtgctccccagtgtcgtgcctgggcctccacctgctctggtttcttgaacacatgagctacatacagtctgtctccaatgtgcacatgtgggcggaggcccttcttcttaggacagcaaaggaggagggctgcatggcattggctgggggaggaggagacctgggagagagagggtgttagaagattgttggaagtgggtgctgaagacttgaatttaggagggcatttgtcttatgatagattgagtccttcactgtctgcctctaagtgttgacacgaggtcccccatatcactgactagtgtggcccttgtgtgtttatgcaggtgtgccttcagtgtggttgagtgtgcacacacctgcacgtccatgacttccgtgcagcttagggtatgtgtgagccggcatgcgtgcacacaggacagcgtgtgcatatggagcactgacagcagatgcatgaacacgttacctctgctatttcactcttgcaaaattctgtggggtgtgtgtcatcatccccattttacagatgaggaagctgacccttagcgaggttatgttaccggcctagaatcacagcagcaggagtgacagagccaggatgtgagtgaaggtctgcgtaactgcagtcctgctgctctgagcttgcctgcaggggatctgggcgagctctgagctccctggggccatgtgtacctacagcccagtgatggaggagcagatggagatggagacctcagtctcattcaggctgcagggaatttaggagcccaggcaggatctcagccggtcacaagccatgtagggatatttgggtccatggcattgaggtccaaaggcccactgaggcccttcggggtgtgacctgggccgtgtctccctactctgacagggcatgtaaaggtgtctctaaggtgcactgatgtcacaggtgtgcacataacgtgtgcactcagccacactgagccttccatggggacctagagctatattcctcccccatgactctggaaccaagccctgtagctctgcctatctttctaggtttgttttggtttggttttttgagacagggtctcactcttgtcatccaggctggagtatggtggcgtgatctcagctcactgcagtctctgtgtcctgggttcaagcaattctcatgcctcagcctctcaagtaactgggattacaggtgtgcaacaccacacccggctaatttttgtatgtttagtagagatggggtttcaccttgttgtccaggctggtcttgaactccagagctcaggtgatccacccgcctcagcctcccaaagtgctgggatttcaggcataagccaccatgtctggccatgttttattttttttcttaagagacaggatttcaccatgttgccctggctggtgtccaactcccgggcttaagcagtctgcctgcctcagcctccccaagtgctgagattacaggcatgagcctctgcacctggcctctgcctgtcttttctggactatgacgtatctaacgtgtgtttctccctcctagatgatcgacttgggactgctgcttcaccctggagcctatttccgggacttgtggaacattctggacttcattgtggtcagtggcgccctggtggcgtttgctttctcgtaagtaacgttcgctctgctctggctagggagagcccccagaatcacgatgggcgtgagggtgagggaataaggaagaggccctcttgtgggcttccctgggctgcctgtggctctgttgctgtccatgtgggactgtccctgcctgcttggggcggggctgcgtggggttaggagggcatgaggtctgtctgtggctctcaaactaggtagggccctggtgtggcctgtggccctgggaccatccccgcctgcctggaggggtgggtgctatgtggggctgggaggccctggtgcggccggtggctctgggaccgggcggcacagcctctggtgtgtccagcgtttgcctcccagggtccttggaggcaacttcaccttgacctgctctgaggcaagtctgctcctgacccagggagacctctggtgctttcgcccaaggcagaactggtggtcgccttccccttttggggcattagacgtctcctctgactcctgagccagtggcacttggccctgctgtggctggaaatggagttggcttcctcagataactgcatggagggcattgtcgggggctcagctacagctggggatgggaatacggcggggagttgtggggtgagatccagagacaaggaagacccctagtggacgacagacatgagggagggtccacatctctctgagcggctgggagggctgctcctggtgccactgactctgttctctttgtcttcctcttgctggactcggcaggagcttcgtggggtaatgccttctctcccccacacgctgcccctgacatcacagcattccagcagcccctcttgggtcatttcatctccagcctcaccccccgcccatccactttcaccccatcggggctgcatgctgccgggagccaagtccccggccaggggttcctgccatgcctctgggagcggggcggggagctgggctggagctgggcatggtcagcccttggtgaggagcttgctggtgagcaggctgtcaccagcgagggctggaggctggggccattggcctggagggcagcaagggctccgggagggaactgccacctgtggccacagcccgaggaccggggacatcgcgaggcgctcccggtgcagctcctctctggaagagcggcattctttcctctgtttcctctccactccagccccctgcagttcccactatttcctctttctgtgataaaggaatgagagctttgccaaagcatcagcttaggccttgggagtgggaacactgcagccaggggtcccccagtcaggaggaggggaaggggttgggcccatccaggcggcttcagagcaggagaaaaggagcaggccccagatggacgctcccccagaaagcctcatttactgggtgacaaaacagtatcccctccctcctgctcctgtcccctcttccctcagctggcggaggagctggtttgagagtgggtgtcgggagcactggggtgatggagacaggaggctgggttcttcccacctggaagcgtttcagggggagtttgatctgattctggagtgtagcctacagtcaggggagaagaaggggaccagggtgcctgagacgtgtagctcactctccctgctcagccccaagtgttgctggagccccaggaagagcacagggggcagggccacccctagaagcaggccttccccagggagcgtggtgggacgtggcctctgagcagggtgggaagggttccatgtgtgagtgaatcccactcagtcctgagtcctcagctcccaccctcacctcccaccaagtagagtggctttgcttctgagaacgggggccgccttaggaggaaatctctcctagacactgctggcccggcctcagtagggtcgtgggaggtccagtccccagaacctgctaattcctgcgtccctgacaggtagaggcagctgcctgggtctgtcctggctttttcttggaggggccctgattgaggccctctggttctgtacttctgcttgcttctgtgcctggaattttctttccccgacttcctgccttgccgtccctgctctgcatgagttttcctgtctgctgctttctgggtagcattgatatgtctgtctctatggctctccctccctccctccctccctccttccctccctctccccttgtttgtcttagtccaccatgcctcttgcattgcctctgtattcgtccgactttttctctttcttactctccttcccctcttctgtcttcccgctgtcggtttcacgtcagcgggaggaatgttaggacggctgaggagatctgtagggcagaggccagacaggtcccctttacctccctctagccagcccaaaaagcaaggaaaaaagcccttccagaagattctcgccctagaaacgtgcttgtgggctcccacttctgggtctgcagtcctcgtgcgggtctcttctgtcctcttaatcctggaatctggggtgggaggggtgtcaggggtgatggttcttctccttgtgcaccagatgctgctgccctagccccagctcctgtccttagatgaggcccgggccaggcagcccctgggaagagtcatggtggcctgtggcacctgcagggcaaggcctctctgctcctgggtcctccaccctggagtctgagacaaaatgcacaggggagcaggactcagaccctggggggccacgtgggagctgggcacacccatgcctcctgcctgtctgcatctgtggcttctcccttctagaggatccaaagggaaagacatcaataccatcaagtctctgagagtccttcgtgtcctgcggcccctcaagaccatcaaacggctgcccaagctcaaggttagagcctggagttggggcttgagggatgtgctgtgtgtgtgtgcgtgtgtgtgtgtgcgtgtgtgtgtgtgtatgcatgcagtgcatgagtgtgtgtgtgttcacatcacacccctgtgtgagggggttgggctcactcagctgtaagcccccattacccaagtagaccttgttcccagcagcctcctgtgagaatcctcctccttagcccagcaggaccaggcggcacagggtttttcttcagcagctgcagtgcagtgcgggaaaggctgccgggacaggtgcagggtggtggagggagatgctggaggtgaggggcttgggacattggctgctgagagggggacaggcatgggctgagcttctggataaagacagagaataaactcaaactcatagggccacgctgaaacctagtaattgtgagcttgtgctaggccctgtgcgaattgcttcatgtgcttcagctcacttaatctcccaaacctttatgcagcagattcttttactggaaattcaagccattgagacctgaggcaatggggacttagagaagaaagtttgtttagaacctgtatgtgaaggagtgggctggcaggcagctggggaaggcgtcggaggcccactgggtccagggaggagtggcacctgccctggcaccgagtggcgctgtgcagtggtcatccacagtgtgccaggctgctttgtgggagacggttgtggccccaccttcccgtcacagctagatcagagcagcctgtgaggtgtcttcccagctctgagagcagcattgtgtgcacagggaatgctgagcttccaggttgggagggacccaagagaaagcctcaggtggtgatggctgatgacagggcggcctcgggccacagagcacacgtgttcctgtcctggagcctactgctttatcctcagtttgcccaaattgcttccctgatgggcagggtgcaagtgcagggcagagcctggctgcatcctctctgcacaagcccagcacctgctggtgcagctgggtctggactcttggtcattcccgtttctgtggctgaactctgacctgtaaggtcggccctcctaggcatccagctgctgcctctagcacctcctgcccctccatccgggccaagatgcctcccctcacaagagacacagcaccagtcttgtgtgtcaaggaagctggcggtggagcctctctgtggtcaggggcctgagggccttgcagggccctggaatgcctgggggccacctgggcctcagtggtcctcaggtttccatcccgtaggtgccctgcctggtcctctctcctggctcccttcacatcctttcctgcttccggcccctccctgtggctccacctcttgtcatggctccactcctcccctcatggccccaccccccaccatggctccacccctctcatcatggcaccacccttcccctcatggccccaccctcccaccatggctccacccctttcctcatggccccacccattcccttacggccatgccctcccaccttggcttcaccccctcatcgtggctccacccctccccgtgaccctacccttccccctcatggccccactctcccaccatgattccaccccctcatcatggctccacccctcctcctgcaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggtaaactgaggcagggtgcaaggtgggacacacagccccatgatgcagacaacactgggagttcccttgggaccaggtggagctggtcacacggcgtgggagactccactgcagagcatcacggaccctgcctgagggccgaggaggggcttgcttgagaagggctagagtcaccacagaagacaggatgcatcccctccccagcaccacaccagggacccccagcacttcctcctcagcagagtcaggaaccaggcatgttctgagggacacagacatccagggagctcaaggtgcccactgggcaaggctttctctaagccctagagatcttggctgggctgtaaggtcagaggggctgcccgatggctggagctgctgtcactgtccacatgaggcctcagagcttcctgtgcccagcgctgcctccaaagtagacaggagaggggcccttggggaagagctgggggaaagctggttagctgcctgtgtggaccccgggcaaggcagtacccacagtgtcttcctgcccacgcggcagcgtcccagctgcttctgtgtgaatatcatgcagcttcctcctgtgccgtgtgactgatgggcacttggctgtttgcagctgggaatgctgcacgtgcacacgtccgccagggagcagtagcagtttggggaggtgtatctgtctggtagtggaattgccgggtcctgggtgtgcgtgtactcagccttagtagatgctgccaggcccttgtgtaaaattacactctctccagcgtagatgagagccccacatcctagctaaatcttggtgttttctttctcgcctttctgggtgtagtggtcattcaccgtggtttaattttgcacttgtgtgatgaccaatgagattgagccccctttgctagggggattggccgcttaggtgttcttttctggaagtgtctgcctgtggtcctgtgtctgctgtctgcctctttcctgtcggttactaggaatcatgtaatgttctggacaggaaccctttgtcatatgtatggatcgcagacgtcttctcctcctctgaatggtgctttctactcttttaatggtgtcttttaaaaaacaaagttcttttttctttttctttttttttttttttgagacaggatctcacacttttgcccaggctggagtgcagtgctgctattgcagcttaatgcagcctcgaactgtcaggcccaagtgatcctccctcctcaacctcctgagtagcttagacaactacaggcacgtgccaccatgcttggctaatttttaaaattttttgtggagatgaggtcttgctatgttgccaagctggtctcgagctcctgggctcaagcagtcctcttgcctcggcctcctagagtgctgggattacaggtgtgagccactgtacccaaccatagttcttgattttaatagagtccaactgatcttttttattcttttatgctgagtactctttatatcctgtttaagaaatctatcccaaggccagggatgttttcttgtgttttcttctgaaaagtgttatttttgcctttcacattaagatctgcagtttacttggaagttgatttttatgtgttacataaggtatgggttaagatacgttttctgacgatagatatccaattcacccagcatcgtttatttgaaaagatcattcttacccagtgtaatggattttttaaaaaacaaaaacaaaacagctttaggccaggcgcggtggctcacgcctgtaatcccagcactttgggaggctgaggtgggtggatcatgaggtcaggagttggagaccagcctggtcaaaatagtgaaaccctgtctctactaaaactacaaaaaattagctgggtatggtggccagcacctgtaatcccagctgctcaggaggctgaggcaggcgaatcgcttgaacctggaaggcggaggttgcagtgagccaagattgtgccactgcactccagcccgggcgacagtgtaagactctgtctcaaaaaaaaaacaaaaacagaaacaaaaaaacagctttattgagatgtaactaacacattatactgcttgttcataacaatccacttacagtgtgcaattaagtggcttttagtctatttacaggtacatgcaagcatcgccacagtcaattttagaacacattttcagcacctcaaaaaaaaagaaaaacccgcaccgtttaactatcatcccctacatccctgtcccacccctagccaactatgaatctgtttttaatctctgtaaacctctctgttctggacactttttgtaaattgaatgatacaatatgtggtcttttgtgagtagcttctttcgtgtgatgttttcaggtttgtccacgcagtggcttgtgtcagagccttgttccttgttacggctgaatatgtgttctgtgctgtgccacattttccttattctttcatttgctgatgaacattgggttgtttctaccttgtggctgttataaatgatgctgttgtatacatttatgtccacatttttgtgtgggtctgtttttgcttctcatgggtgtgtacctaaaagtggaattaatgagtgattgggtaactctgtgtttaactgtttgaggaaatgccagactgtttccaaagtggctaaagcattgtatattcccaccagcaatgcatgagggttctgaattccccatatccttgccaacacttgtggttttccatctttttagttttggtattttttaaactacagccatcatcatgggcatgaagtggtgtctcgtggtggtttttatttgcctttccctgatgatgagtggtgttgagcagcgtttcatgtgcttaatagccatttgtatatcttctttggaggagtgtctattcagatcctttacccattttttatttgggttttttttttttttttttttgagacggagtctcgctctgttgcccaggctggagtgcagtggcgcgatctcggctcactgcaggctccacctcccgggttcacgccattctcctgcctcagcctcccgagtagctgggactataggcgcccgccaccacgcccggctaattatttttgtatttttagtagagacgggggttcaccatgttagccaggatggtctccatctcctgacctcgtgatccgcccgcctcggcctcccaaagtgctgggattacaggcgtgagccaccgcgcccggccttttttatttattagaatagttatttacatattctaaatacaactcccttatcagacagaggattaggaaataagtatttttcccattctgtggatttgtctctttacgttctcggcgtcctctgagcacagaagtgtccgatttgatgcggcctgatttatctgtattttttattctgttgctcatgattttggtgtcacatctaaggctccattcccagattcgaggtcacgaagttttgcccccgttttcctctaagtgttttatagttttagctccttacacttaggtctggaatccatcatgagttaatttttgtctatggagtaaagtagggtcacattcattcttctgcatgtggacatccagttttcccagcacagtctgttggagaggccattctttccccacggaatggtttcaacactcttgataggtgggtttatttggatcttttgtctttgccctctaacctcccatgttctcattcctaggggtcagtatttggattatgagaaggaggaagtggaagctcagcccaggcagtggaagaaatacgactttcactacgacaatgtgctctgggctctgctgacgctgttcacagtgtccacgggagaaggctggcccatgtgagtgctcatcctgctctccgtagctggggcaggcagcccctgagctcggcctcccttcctccctctatccctgggctcaggcatggaagcagacccacccttgtggtgcaggtcttgagttcttagggctgtctcctttgggggttcccctgacacttgctctcctctttgcccagggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgaggtaggtggacgctctgtggagtcttgcagtggacagcgtgggcagcgccatcaggcttccctcctgcacacaaatcactcacagctgggtcagctttggctgccaccgtctgccaacacaggggcaggtcctcctttctcctgcagagggaccggatttggctggttgaggcctgcttggagaaggtctgggctgcttcaatttgtcttctgttgtcagggctccctgtgaggcctggcgagacagggctgggtgcagtagatgccgtcgggtaggttttctgcttctgagtctctgtgctcctttctccccttacagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaaggtgtgtggggctcagcgcagaggggcagctggcgctgctagggattgggatctaaccctgaggctgagtggagagtcagccttcttcctccctgcatgagccaaagcagtagtggccttgcatcctggccagcatgggatgcctgtggaatcctgtttccctttgttgtctgtgggctgggacagtggggaggttctgggaggactcggggagagcaggaaggggtgtcccaggcctaggcaggcatcgagttctgtctgcccgctttgcttggtcatagtggtcccagatggggtgtcttggggctgccaaacccatggccaacagtgcctattccccgggcagttctatgatgcaccctatgagtacgagctgatgctgaaatgcctgaacatcgtgttcacatccatgttctccatggaatgcgtgctgaagatcatcgcctttggggtgctggtacgtgctttggtccctgctttgccttttgacaacctatattctggttccccatctgtagggcgacctttgggggctcacaatttggagctgggaattctccgagtacccagagtatatgtaatgctacaggggccctggggaaggggctgttctgagactcttggctacataagctctgcccccagcctaggtcctgggagggaggcagggctgggttcttcctctttggacacatggctcttagtcctgcctctgcccaggcccagaggtatctgtgtccctggctttgacatctgcttacctctggccttgtgctgtgccccctggggtggcctgtctgccctgtgctcagggtctatcaccctcaccgctttcttaatcagggccaccacctatatatacctctttgccaacagagccctcatcagccgctggcactaactgctcttctttttctctagaactatttcagagatgcctggaatgtctttgactttgtcactgtgttgggaagtattactgatattttagtaacagagattgcggtaagtagcatttctgtccctccttcagggtccccaggtggtttccttctagagcctgctcccctcagtgcatctccaggccctgtgttagcctcttcctgggttccgcagaaccccctggacatgtggaggcttcgctccaggggtggagtttagggattgggtgttacctcagcagatgttctttcttgaataagaaagtggttctcaaagatcttttgggctgctggcctgagagttacctggagctccatggtaacaactaatcaagaagatgtgaatcttaaatttgtatctgtataatatgtatctaacaaggtggtatcaaaaatatataaactgaaaccagtaaggatttatatttcaaaatattgccccccaccgtctctctatctctctctatatatatctggaaatactcattcttaccaaacatatgtggattatgtcttaaaattgaccagtgctgggatataaacttgtctcaacaaatttcaaagcatctgaatcataaagcaacattctttgagtacaacacattacactggaaatcaatggcagaaaatctcatttgtttggtcttaggttgaattctcgagaagcagacgcagacacgagcactcatgtgaaatttatttcttaagttatgttcccagtagaaaccagcagaggggcatggggaaatgggtgggaagagaaggaccagaaatcctgcgtcccaagccaagtcctggtgggtcagtgtgggtcatctcccaagggacttctggcagcagcgtaggtcgcacctcagagctatccctgctggaaagggagctgcaacgtgtttgcctctgcaccctccgcacggcattaggctgagggctgcacctggggtgtcaattctcagatgcttccagctccctgagtgtgccacgagtgctgcacccaagctgttagggctgaagggacgtctgacaccatcagaggagaacctgctggagcaccaggctccttcctgttctgcccacacttcacattgggttcactgtgctcattctttaggatggtgctggtcatggtctctgggagacagagcggagctccgtctgctgtgctggtccaagcagagctggtgttcatcatcccgttccccccaccctttctagagcccctgagctgatgttcatcatcccgtccccaccaccctttctagagcccctgtcctgtggccagccttctgctgcactggttgctggcctggtgggatgacccagaccctcagccctgcgcatcccaagtccctacttgttgccgttctttttccaaccctggctgccgtggtaatccagtcgcagtgaagactgcgcacaggagcgtgttcataggagcatggagaaaggcccagtgaagcccctgattcccagaattatgcagtggcagctctgcccttcacagtaatgagggtcagatgatctggctggcatggaaactctttgtgatgcctgctggccttctggcacgagcagccccaagtgaccaggtggccaccatggctttggtgttgtgtggtagaagccttctccacctgtttgaaccagggcctctagatttgccagacctaaaattggggaagatgagcgcagagttcatactgggtttctggagcgatggtgagacaggccccttcttctttcaccatttcctccatccatacattttactgattgggcacccagtaccatcgattggccgttggttcatcttgaaatatggcaccccaaccccatgaagtgtatcaccaagccggcattttatctctgcctttaaggtcagggcagcgtctcctaagtggtgttgcgttagatgatccagtggaccccgcggtcacctggctcacatgcatcccctgcgtgtgctccaagctgatgttatatggaatcctgtgttggtaaatctctgagatgttagtgccggcacggtactgcacaaggaaaggcaaacccacacctgggatgtgggtggatcccagatgagacaaatcactgccctttccaggagagggtgttctgatataatcagcttaccactaggtggctggttgacagccccaaggcatggcaccagatggaagcccagtgttgctgtctgttcattcccggtagataatcgtcagtggtcatgactggatcatgctgctgagaggctcttggccacgatggtcaccctatccagaggtctgctgtgtggacactggggctggtgaggacagaggctagccaatatctgttggtcgacttatcccagtgcttggtttttagtgccccatggtgagcattggtttgcaaaacaaaggcctgtaccccatgcctgttcccaaggcccatctgtctgcctctcacctagaccttgttccctccaggatcctgaccagccgtttgtgcctgcctaggaccctgttatcctcagcacaggcaacttgttttcccccccacacagagctgaccagataccctgcccagggctctgctccacctctgtctttcaggctgttcctatgtgaggctgtagtgaggcctgcaccagtataccaagcaacccatccacaaatcaggtctgcgtttccccctaagttgtagtgaatccccatgaagtgatggcgggagtgaggtgaggacgtcattggtcaacagaggtgcgtgtcatgggggattgggccacatgttgtgtgctgtgtcctctagacatgcttgggttcggtcgtagaggtaccccttccattgttcactgggcctgtggtgggtctgacagcacatcactatggggagatgctttggtgtcatagacagcgatgtctcttggtgacacacacagctgccaccagggccaggaagtaggttggcccctctcattatgcttccgttctgtagatggcatggcctgctcccaaatgctgggtgtctgcactgacttctctgtggaggctttcccaggactttacccagtatccttacctaccacatacacatcaaggaccctgggggttgctgggttttgtggcccaagtggcagggccactgctatcacatcctgggtctgttggagacctcacttgtgctctgaaacctctcaagcatggcagcgtcttgagtcacagcagtatttcctaagtggcctatgccatctccaaaacgcaaagcagcctacccgcagtagaagtgtgaggtgcaatcactaacttgtctcttaccttggagtccttgtcctggcatagcccagaccactggacccctaaaaacttcactgacgtggaaggtccatgaatccttgtaagatttatcacctgtgctctggagtgcgtcagggcatctgatctaagtaacataacatcatcagtgtggtggaccagtgtggtgttctgaagaatgtcttggcaggcacagtggccacacctgtgatctcagggctttgggaggccaaggcagggaacgtcttgggcaggcacagtggccacacctgtgatctcagggatttgggaggccaaggtagaaagatcacttcagcctaggagttggagactagcctaggcaagacggcgagaccctgtctctgtaaaaaatttaaaaatttagccaggcatagtggcacacgcccgtagtcccagctacccaggaggctgaggcaggagaatcacttgagcccaggaagtcaaggctgcagtgagctatgatcgcaccactgcactccagcctgggccacaaagtgagtccctgtctctaaaaaataaaaataagaattccaaatgattaagagtacctttggaccatgttgtgacatagggtcagactgtgaatgtctgctgtggatacaaactgcttctgaccctgcttagcagtgactgctgaagagtgtgctcaccaggttggcacctgtgtgccaagtcccagaggctgagtagatctgttctattaaagataccaaatctcccacagcagtgggtactgagcctgggttatctggggagtagtccagtgtcatccattgtgatccagttttcttgcacagtccatactggtgaattaaatgggaatgaggtgtagaccaaccacccctttatcttttaattattcgaggtggcactaacctctccattccatactggatgcagtgttataatgtaccgttttggctggggggtgtcggtgttgaggactttcctattgttatgtctacttcacatgtcgaggagccagtgtggtgggttcggccagttagttaggactagccaaatgaacaccagctgtgcctgggcacacgagaccactgagagatgggcctgggccagggattcattggtgtcctggcccctgcgcacactctgagatggagccgcaatctcattttagttccttggtatcaatgttatcttggaccttgtatccaacagccttcaaaacctccgggtattctttctccagtgtgcaatttctcaagtaaacgaaccagatctccttggggaggggcagagaaatggttgctgtctggatccagtgtgcaatttctcaagtaaacgagcccgatctccttggggagggcagagaaatggctgctgtctggactccttcttgtgttgtaggattcttctgcaagggggcccagtctctcctctaagctgtggaccctggatctgaaaactgactggttgagagactcgggagggagcatgtttgtccatggtggtggctgttatcagccttctgctcacttactttcattcttttgaattctatatttacatatgttaatctcaagcagcatccttgttggcgctgcccctctgtcctgcctctaggaatgccatggccgattagccgaagcagcatccttgttggcaatgcccctttgtcctgccaatgccatggctgattagccaccactgtggacctttgcaggtcagggctcttggttgccattgaggcctcgctgcccactgtggtggttccaggcaaccagccatggaagggagccagcctcatgtgattgtgtgctgccatggagcctctgcagctccagagccttctcttcttcccaaaggaatccctgctccatgacagcatctcctcccgtcaaccctggcctgcagaagagaaccaccagtggccttgtgcgtgatgccagtgccctcctcccaaaacgctctgagaagctggttggctcgtgggcacttggatcgtacatgataggttctttctagcatgcctacctctctgagccttttggtcctatgctcagcatctgccaaggcagttctggcaccctcacctcatttaatgtgggctatgaggttttccaagctcctgggagtcatcccagcagcctgttagcacctgcttcaggtgccctcgccagggtattggatcctgagtcatgggagaaagctcccctacattaaaaatagttttttatcctgcctgtcttccagccatcctcatccagtccctcccaccttgctcctgccacacatacccgttatatcacacagcccttcactgggcagcctttttttctcactcagcaggaccaccgcttcccaagtcaggctgtatgaaaactcgagttgtgggtctagtggccggcattggaagtgaggtggaacttggggagggtgagtaccatcgtggaaagcatccacctcagctgagactcctgcaggtattcaggcaagacaaagtgaggtcctgcagcagggagggggacgctcctgcaggcccaggcagtcccggggcatctgagagctctgtgttgggggcatgcccacactggtgttcctcctctgcgtggcagagcctgcccttcctttctgggtgctgacgttggagcatgagagacttgtggagtcctctctagagccctggtcctcccttgagtcccaggctggtcagcacaatccgaaacacagaccacatttgggttatgcttggagttgctaattgacaacttgtaatgttttcttccccagagtaattggtggcacttagccatggttcaccagctctaccatccttacagcgcccattcctgacagcctgtggatgctaatgatatcttgcggtatcgttattgcacccctttcaaccctttacagatttgcccaagatgaaggtttcagcagttttaatgctacagcacaccaggagttaccgtcacctcacttaccacccaccaacagaggagaatctgtccagtgagccactccccaaggtctccatccttagagtcggcttccaaggaaccacccctggtgtcacctgtctttggatcagaacgtgtgatccaaatgtgatttactggaatcacagtttccaggaatagttggtgaggatgggggcagttggataaggaagagatccagtttcaatcaattccatgtaatttgggctccttcctgcaggggagctctgagggtagtgtggatgccacatcagagttgtcccagtgaggggcaagagagtgcagcatgggctccacctgcaaagcaggttctggcagcctgtgggaatccctgcatcaagagacccaagagggcggggcacgctggctcacgcctgtactcccagaactttgggaggctgaggtgggagcatcgcttgaacccaggagttcgaggctgcagtgagttatgattgtaccactgcactccagtctgggcaacagagcaaaacgctaaaaaaataagagagagagagagagaggcagggaggcaggaggagagagacagagggggaaggagagagacaagtgctgctgtggggcgtgaaagtgcattgggagccagtgtggacagaagcagagcgatcacagggcctgtgtggctgagacactaacagtaccttctccacttttaaggaaatgaacttctgaataagtcatgggtaaaagatgaaatgatggaaattagaaaatataaataacagaaaaacaatgaaaatactgtatattaaagctcatgagataacagctgaagcagtactcagaaagaaatttacagccttaatgtttatattagaaaaagaaaacggtgtaaaaattaatgagtttagcatctaactttaaaagttagaaaaagaacaacagaataagctcaataaagtagaagaaaagtataagaatagaaattaagaaagtggaaaacaaagactagagagaatcaataaagtctaaacttagttctttaaagacttaaaaattgacacacttctggcaagattaatcaaagaaaaataagaaggtaaaatacacgatgtaaggcaggggagaggggtcatgatggtaggtacaggagagagtaacgtgaataacgtgaaggagaatattgtgaatagtttatgccagtacgtttgaaaacctaggtaagtgaacacattactagaaaaatataaatgactgaatgtgacaaaagaagagagaaaaaccctaaatggttctttattaaagcattaaagaagttgagtcaataaacaatcttcctataaagaaaacaccagattctagtggtcttatacattaggtttctacttaaaatataaggaaagatcattccactcttaaacagatttttctagagaacagaaaaagagtgaacattctctaactaactagactagtataatgttgacattaaaatttttttaaaagaagagaaggctgggtgcaatggcccaggcctataatcctagcactttgggaggctgaggtgggcagatcacctgaggtcagaagttcgagacgagtggataacattgtgaagccccgtctttactaaaaatacaaaagttagccaggcatgatggcgcacgcctgtaattctagctacttgggaggctgaggcacaagaatcgcttgaacccaggaggtggaggtcacagggagccaagattgcgccactgcattctagcctgggcaacagagtaagactctttcaaaacatataaataaccagaactctggcactgctggtgggcgtgccagccagcacagcatctgggagggctcagcagcccctcgaaagttggacatgtgcatacaactcagcaactgtactcctaggcaggtgtcccagagggtgcctgcacagataacccccagaggcattttcacacaagtgttcctggcaccagcgttctgccgaccaaacagaggcatctgagtgcccatcggtaacagaatgtgccagttgttagggtctctgctaacgtagtgaaaatacgcaaatgatgtgaaattgaaacacagctttggggggtttctgtgtgtgcacccctttccagtgacatcagcacagtgtggatgcttctcagaaacagtttttggtcagagcataggtgtgcgcaagtcaaagaagcctgcgggcagcctgatcccacaacaaaggccagggacaggcaaacatagaatgcatttccagagtttctggtaaagctgaaaagacaagccatgattaacaagaagggaaggtagtggctgcatctgcagaggaggaagggagacccgagacggcttcggaagtgatggtgatgtgccgttcgtaaagctgggtgatgaatatatatagatacttggttttacttttctttaaaatatttatgcgtaatcttttatgtgatatgctttacgatttaaaaaagttaatgatctgagtaatccaagcaaaaaagctgaaacctgccatttaatcagaaaaatcagaaaagttgagtccccctagcactggtgttgtgtttcccagtggctgcctcctccctgtgcgtctcgcccggaagcatttagtcccagtgcgctttccgagaggcacaggtgggctgcattgctgattcctaagggcctcctccttggaaacagaaatctttattcatcaaatacagtgatggaaacattgagctcccagctgtaaggacacagcttggtggggaggggtggtttctgcgtgtgtgtgcctcctttccaagaggggcgggaactgctgactgctgagagggcacaaagtggagggtgcctggctgacgtcagagatgtgcagagagccccagtgcccagccgggctctagggaaacctccccacaccccaaagaggccctggtgtagggcagaggccttgatacaaggcagattcctgctgcagtgcaggcagccagactgacccacactccgtccctcagctgcgagacagtcgaggccgggctgtttgtggtcgtgtcagaccctggctcaagcaagccctccttggcagcccctgccaaccctggacacccagcaggttgggggcctgagagctgctggttggaaagctcagctgtcccctggccactcttgctcctggagcccaggtcatctcctgttctgcctggaggagaaaagatgaagggaaagccatcgtgtggactggtggtgctttgttttgtttgtgtgtctgtttttcatttggagccacttcatatgtttactttgtgaatgcacttttttttcttaggcaaaaatatgagtgtcagttcccatccccaacttaaaaatcaaaatagagttttagcaagggcacccagagagagggctccaagcaagcatgaaactgacattgatttctttgcctggaaataaaaataaataaataagtgtctgtgagtcatctttggatttgcattacaaacaagaatgcaaatgaatgccaccttgtctgcataacctacagacttcaaaaatatgttttgatctgatatattttaagaaaaataatgcagtttaccaaaatcctaattttctagttaagtaatcagagtttgagtttttgcttgtgttgatgactcattttctcttttgttttctgtttttgttcttgatttaccttaacctacctgctgactcacgccatccaaccaacatacaatgcgaaaacccatgtctccgtctgtatgttgtgcacctgctgctcaaacctccccaatttgtaaataatatgcaaatatccatccatgaaaacatcacatgtaggaaacggttggtttcacgactctgaacggttcttgcaagtccttgctttgctcgctctgctcctctcctgctctctggttcctgggactccagcccactgccctctaggcgtgtggttggatgcggctgcatccactcacctctggcctcctggacttgctccctcggctctgggcattcagcagggcttctgagggccctcctggcagcgatttgattctgggaactggccgtgggcagggcttccctgagacctgcccaaggagagggaggtggggtttctggagtgggtaagtgtctagggtagtttttcctgttgggactggctcagatttggggaggctttgcaggacatgagtttgtccctgatccctgcgagtccatggttcctgttgcgcagccatctcccacctgctgtgtccccatcaagccaatcaagaaggccccgctttgcccaggtggcctctgcagactcccctgtagcttccgtccttcctggactgaccgtgccttggagtgggcagggtcaggcctggggttcagggctcgggggcagggcttacagtctttgtcttcatgattcaggagggttcttgtagggctgagtagaagaagggggctctgcccctagaggcagtggagccgaagctcccccattcgcatgtcactgaattgtgtatgtgctcggtcagcaagctcatttggagtgcaggtccaaccggagcttcctgctgggtcttcaggaattttagagcaaagatatttggtaactgacccaactttagctgtgactgtggaaattaatataaagtagaagatatttgagagtcgtgtaaaagtgaatgtttgtgatacagcgattcacaattggagcagaagagctagcgttttgagaaaataccatttaatgctgcagaaacacccaggcaatgtcatctgcacgcatccagctcgtgccagtcaggcctctgctcagcgtcacctcctcagagagcccttccccacattgtctgtcccctgtcctctttctccaccacacatccacacctgacatgttactcatgcacatgcatgtctctttcccgtcttcaattgtcagtctcattagaatgaaagggagccacagagcagtttttctgcacctgctgggccttgtcctctggtgtggtagctggcccacatcggggcccacagatcggggtggggtgcccagctgacactcgggacaagccctcacttccctgtgactctggccagaggccgtggtggtcttggatacaggggatgctggtcttggtccagagtcagtgggtcactgtcatggcacggtgtcctgcagtgctaagagcaattttaaatcccttttctcaagtactcctcacctcctggactgggtgtccccgtgtttctttgtggatgagaaagctgaggattgaagggttagggaccgttgtcccatcaaggtgagtcagccaccatgttgagggcacaatgctgtgcctttggggtgccacagaccttttccaactcaggtagaagtaaggaagggcctggccttgaagtaggtgtggctgcaacagaagccatggactcagtgaggttggggcaggctgtgtctgcctccgaggggctggcggaggccagaggtgatggtgcaggtgcacggcgtggcgctgcgtgtgcttctgtcccttgctctcctgcatgcagctggcatggtgctcggcctgccacgctgtgctcgaacatctgtggctgccgtcaccgtctgtcttcacagctctccagggcgcccgtctcctgcccccagcctctcctgagtacccacaggagccccgagagaagccaggaggaaggggggagtgtgggtctccacaaaaacagaaagtgatggtggctgaggttggcattcatgcattaagtaatttggacaaactgttactctccacgcacctctcgcctgccctgttgtcttccagtccttccttcttacctggcagcctttattttccccagtgtcttcagggaatcttgtctgtgccactgcctgactgtgctttgagccagtgggtgctgtgttgccccagtccctgcccctccagaccccctgagcacaaggtttcagagtgggagcctccaacccccggctctgcttcatcatcttacataagggtctcttgacacgggactgcggccctccacccctgcacccatgtttctaagatggctggcttctctgtgggtcctcgtggcccagagttcttggccatcttgtctaccgtggagattttctttccctggcacaagcagattacggagctacaggtacacttgtgctgccctctggggtcacaccctgaggtctactgctgccgccttgctgatttggatcatagcccgtccttgtgcccactggccatggatatcattcaaaaccagtcctgctcccacagttgcagcatcccgcctgagagccagtacctcgagttgaatcctcagccaccctgcccctgccagtggaagtggcagacctaggcagaggtgtcctcagtacgggttgggccactgtccctggaaggaagagtgaggcccacccctccactgacacctcattcccacctaacggtagccctggagagtcgggatgctctgccaggccctcaccgcctctgcgcctgcacgtgctcctgctgctgctgtctcatttgacatctgtgttctctttatttgatgactgaatctgacaacacgaacgtgtctctgagcctgagctgcttgcatattttaaaatgctgcagtggcaggaagctgctctcaggctgtgtgtgggcacctgacctctaggtagacagagggcagaaagcctcctgggtccacaagcacccccatctgtgcacggacacctccccagagcctgcttccctgaaagggatgtgccagtacagtaattcaagtgccctggggccacgtggaggctttactgccaggtaatctgtggagtcccaggtttatccatttatcattgtgcttgattttgagccccttggatgagggagctccactagacagcctgggctctctagagcagaggcctgtttgaccgtgaattgcagaggtggcttccgtggtgtgagcagcagaacacctgtaccttccataacttgtctgcacacgcctggagcagcctcagaggaagtgtttgcccctctgccaggtcccagcgagggtcccaggcaagcgagggctttgctgactgagccagggaggaaagggcatagccgtgaagcctgggcgggggtcccttccggggtgctgggtggagaagcagtcatgcccagcacgtggccagcttgaccgtgtcctgcaagaggtggtcactgctggaggcccagccacaggtgatctcccagctcacctggcagcagagagatgcctgggagaacttttctttctgttgctcacggttgggggtggggaggggccttagagccaaggaggttttctctgatttgctgcatgagaagtgatttgcaaggacaagctttacttctggaagattttctggtggccgattgctgcttagactgtgaagcagagacctttgattttaatctttttaaccacttttctttggggccacagggatgtgggaagaggttgtagggtggcagcagcttgcctgcgctttcggggcttctgaaggtcagagaacaattcctcttctctgcagaacaatttcatcaacctcagcttcctccgcctctttcgagctgcgcggctgatcaagctgctccgccagggctacaccatccgcatcctgctgtggacctttgtccagtccttcaaggtgggccaggcggggggcctccatgctttctgtccccttcctccgtcttgcttcccctgcccccaccacagtggcccctcctttgggaggctgggagagggtatggcatgcaggtttcgtggttgtatgcattgtcctgttgtcatttataaagacgttttaagtcatctgtaggttcccttggtcatgctcacaagaaccctgaggtgggtttcatgactccgagttagagataaagaaactggggcatcacttggtggaggggcttggtggccagtgggatggagcttgagtaggctgaggtctgtgtgacctcaaaggcccagccaccgtagcaggaggcctgggcgtggtggctgggaggtgcctgtagctgaccggcccctgtctccgcaggccctgccctacgtgtgtctgctcattgccatgctgttcttcatctacgccatcatcggcatgcaggtgggtgctcccctttgggacagagcgtggttccggcctcccgtgccctggagcagaggggcactgatcatgattgtcaaatcatcgtcataatcagttgatccttagtgaacattctctgtgagccagatcctgctttgagcacttgctgaacttacgtaatcctcttttcttactcttttttttttttttgagacagagtctggctttgtcaccccggctggagtgcaatggtgtgatcttggctcactgcaacctctgcctgctaggttcaagcgattctcctgcttcagcctcccaagtagctgggattatagatgtgtgccaccacgcccggctaatttttgtatttttagtagagacagggtttcaccatgttggccaggctggtattgaactcctgacctcaagtgatccacctgccttggcctcccaaagtgctgggattacaggtgtgagccaccgcgcctggcctaaacttacgtaaccctcagaaagactgttttgcggaggaggacatggaggcaccacaagattgggctgcttgcccagggccatcctggtgtggggcagctctggccctcggcccattgccacctcaacaggtggatgcaccgtggtgttcttgagggctgcatgggctcccgcccagtgatggtagggtgtcggggcacaggtcagaatgggtgctggctgtgtggtggaggcgcgttggagcacagctgtgtttgccgagtggcttgcacagtggcggtcggttatcctgttagtctggcagccgcgctgaaggacaggcctgacccgcggcgggggttacatgctactggggaaaactgcctgagaatgtgagcaggagcgcatcggatccttgcgctgggcaaacttggcttgcataatttagattttctttattttagaaagaacacattgtcagctatttgggaaaaagcatttaaaaaaacataaagcagtgtcccagttataaatctttggcatctgaccacttttccaacagcagggacggaagagggacccgagtgttaatttgttatcgaaggtgccggtgtttcaaaggttcacggaaaactgatttctaaactctatttcagggattgaagagttctcttgctttaaaatttgcagagatctgatgctgtttaaataaatacatctttttttcctgctttggtctgtggatgtacaagagcacatacgttactgatctttgtggatgtgtcatagttcataaatttgcagccagattccagattttgggctgagtacaattactgacccatttgcatttcttactgtggaaaagtcagttaaaatggctaaaaagcccgttgtactattgcatatgttttaagaagacattttcccatgatctgtcagacctgttaccaacataatgcctgctttggagtcgctgatgatcccacttgaaaacacttcctgtgttacgtgtggcagaggcctcacaaacttagctcggggccgttcttgtgagtgtttcggacttgcatctgtggacaggttcagagctggagccggcacatgtgtagctacggagagggcgtctatactgggaatgcacactggcctctcccgggtgggagttctctggtgtggggcagtcgcccatctcacgtggggtccttgtacggctcgcacgccctctctggctcggtccacctggcgcggctcctgcagacccagcagggtccgtgccattgctcttctccattgcaggtgtttgggaatattgccctggatgatgacaccagcatcaaccgccacaacaacttccggacgtttttgcaagccctgatgctgctgttcaggtgtgttgttcggtcagcccaggccaatgtctgctcttccgtcgggggctgctttactcaggatgaagaaggctgggtgtcaaccgtggagaccacccacttctaattccccgaccccactggcttcccctcagcaggcctttctggttcttcccctctctctgctcctcttttccaaaggctcttgatatctgccccagtctcagaacaggctgaagggaagccctgagggagatcatcctgggagccctgggccaggccggcctctgctgcctcgtctgtgctccctggcgacagcttgggagcctccggtgaggctccaggcagaggtctgggaggacagaggtgcctagcaggggctctcttgaagtgcgggcctccagctttccacctgcgcccttgttgattacagggattggtgggatcgagggcagtagggcaacagggggaactgaccagcagagtttgtagctactcagtggcccaaggaacccaactgaccagaactgccgatctgaacacacctttattttccaccatctctcatgggagctgccgttccctgggctcctggatccagccaagccaagtaacaggcagaacctggaggggccaagaggccatggcacaagcttcggggccttctgagatctcctggtggagatgtgccaggagaggcctcagcatcagctgctgttcctgggcgcggaacaggagctatgggccatcctggtttgagagtgaacttgggagcagaagggaggtgggtgaacatgttttcctgcctcctgagtctcccacagtttatcactcacgagcctaggacagaaggaaggagctcttttagggatttgccatttcagtccatgtgtgcaaatgcactgggctgctgtacagcccaccctgcctgcagatgcgcgctggggcgagctcagacccagacctgctttgctgagctgcctggagagacctcttagactcttgtttctttgcataacataagcaagcacccttaggctgacactgtccccagatgatgttgtttggctgggctttagctgctgcgttaattttatctcatcatttattactattctgcctcatgccgcggaagacttaaggcaaacctatgaagtcagccttagttttgaggcctttggtctcacagctttctgtttctccctgaacttcgtgttccctgggaacacccttatcagtcaggcccagcacaggttgaagcagcagccctgcaggaacccccctgcctccggctgtcatcagtgaggagtgggcccagcttacgcctggggctgcgcacacagacacacggaggtggggacccaggcctctgacccacttgtaccctgcaagcccccggtgctggctgtgtccaggaacagactccgtgcaggagcatccagggtggctgctcagggcagggtgctcttgaggtgttcaaggaccagcagaggccagggtgcttggagtggactgagctggaaccgagatgggggtgaagtcagggaaagagtgggcagcaggtcccacagtgctatgggcagtcatgtggattttggcatttctgatgagcgaggcaagtcatcggagggttttgagaggaggaagaatgtgatctgacctgtgcttagtggacctgcttcctgccgtgtagggcagagtgagaagataggctcagaagcttccatagcacagggcaggtcatggtcgcttggcctaggacagtgaggagtggtgagagcctggctgtgttttgaaggcagatgatctgatgaacaggatatggagagagagaggaggcaaagatgacccccacagttttggttggagcagctggaaggagagtcaccatttctggaaatgaagaccaagatggcgtgtgtctgggaggaggtcaggagtacaactggggcctgtggtgtccacaaagaagtgctcgccctggcgctggcccctggtgccgtagataatttttagtaagcagtggtttcccaattaatgctcagtttggaaatctagtgccagaagtttcctttgaagaaacagcatctgtgacccaggcctggcacatgtgtgagctgtctgtgggaaggagcccaaaggagtgggcacgcttggtagccccacagggctcgggctccctcaagggcctctgtgggcctcacaactctgcccttcttctcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctggtgagtcctgggcactgtgcccctcccagtgccacgtcttgtctcggtacagctcaggcttctcccacatctcctgctgatccctgactctgatccaggccatgtcagaagctgagtccatgctgatggcccttgtttccccagagatggcgactttgttagccagagaaagggccgacatggtaacgggctcctgtgggcccttccttgacatccgtggaaaagggttacatttccaggggcaactgttccttaacttccagcttctagaaggtcatccactgtggtgatgggatgtgaaggaacagcatcccagccagtgtacggggaaagcagctggactgggtggggaggtcggcagggcaggccccagaggtgtggattttatttcacatccatggaagcctctgggggcctcacagcatctgcttgacgttttacagcttggctctggcttctgtgtgagtagtgaggacgtggctgcagagcgagtgaggagacgactgggggcaacagtggcctggagaaaggagaggcaagggagtgaggtgggattaggctgcattttaaaagtagagctggcacgattgatgatgagagatgggcatgcgaagaggaaaaagcaggctgcatcctggggttttctggggccacagggtgagcagttcttctgagatgggagtactggggagctgagattagtttagggttggaggcagcagagatgcccagcgacctctgggctggatggaaacgagttgtcgttagtgttcggtgtgttcgtggggctgcatgctatttgctggatccctgttaatgcgaagcttagtgcagtgacctgcgtccaaagcagtgcctgagtgcctgttagacatacagattcccaggccactcccgagactgcatcagggtgtcttggagatggatccaggaatctgagttttaacaagctctcaaggtgactctgtgtgtgttgaactttggtgagcactgacgtaggggaagaacagtgttcagaagaaggctgaagactctaccccaagggcattgaggaggcagaaaggagcactagatccagaaactgaggtggagcagtccaggaggcaggtggagaaccaggagtgggcggagagaggaagtaaccagccatgcaccatattgacggaaggtgatgcaagatgatgaccaagaattgttaactgggccgggcgtggtggctcacacctgtaatcccagcactttgggaagcccaggcggacagatcacctaaggccaggagctcaagaccagcctggccaacgtggtgaaaccccatctctactaaaaatacaaaaattagctagacgtggtggcaggtacctgtaatcccagccacctggggagctgaggcaagagaatcgcttgaacctgggaggtggaggctgcagtgagccgagatcgcgccattgtactccagcctgggcaacagagccagactccatctcaaaaaaaaaaaaaaaaaaaaaaagagggaggctgagacaggagactcgctagaacccgggaggtggaggttgcagtgagccaaaattgcgccactatactccagcctgggcaacagagcaagactctgtctcaaaaaaaaaaaaaaaaaatgttgtttattggatgtggaaaggcagaggccgttagcacccttggcacatcgttcctccgtcagcgtagtgggagtgaaggccttgttgccacaagtttgagagccggtaagaggagaggagcacagccgggacagagatgctcttgacagtgagcagcactgaggaaacacctcaagcctgtggccctgactccaaggaggaacagctggcatggctgtgcttttctctagccacattcactcctcagtacaagggtagaaaagtggattatccagattcgggatttcccagacaagtgcaaggagggagagaagggtgtgtataagagtgtggttattgtgctggacgtgggatcaaagctggggacagaggagggtgaggggcaatgccactggattggaggttctcgtgaggacatgttttgggatgcaggtatttgaaaaagggagccggaaaagtaggcgatgtgagcagagtgggatgtgtgaggtggagactcgggaggcagtgagtgatgccatcggtaaacatcattgccgtcattacattatcattgcaagatcattacattaacattagcatgatcactgttgataagcatgtttagtgtgatttgtggaacaaggagatgagctgatgggtgagaaggttcaggaagggagagggcaggcagcggtcgtcccatctctgtggatcttaaaagcaacaagaatgataacaagaatagaagtggagacaaaaacagcaagccaggtgctaagtttttcatgaaggaaggggaaacttaatagatgatgtgagccccagagaacaggtttttaaagaagagaccagaggggacatccatcctcttagatgtttgagccagagcaagaacaagtggagagcactcaggggagatggagatataaggacttgtgctgatggcggactgtgagctttgcagggtgcagtaggaggttgaggtggttgggaatgatgtgcacttgagacaggtgagcttacacttagatagagaaatacagaagaacctacaaaactgtgtttcactacttgctagaaaccaagggaaggatttccatgtttgagtcatctcctgatccctccgaagaccccttgtgggcagcagggagggtgggctttttggagaatcactttcctgaggcattggtctctatactgttcaaagacatctggtgctgtaagaaccagcacacctgtgggcacaaagccaaacctactagcctgaccttaccatgcacctggccgcagagatggggttccacagaaagccacattcatgataccacaccacgtacagggccagcactcactagacatgtccaggatgagtcgaggaatccttgggtttagctatcactcctgtgcagagaagagggtatttcgtggccactgtcctttgttcttgtccccatggacctcagtcatggttcttggctaaccctggtgtctccttactgaaactgtaatcctaatccttctggcacttccctcacagattggacatgctgggcaactcatgctttgaaacacttggatgtggtttggtctgatagagaagtgacatggaaaaaatgggactgtgaatttgggatgggtggcaggacttcgttaggttgggatttggttccattaattggaatagagggtgctgatggaagaatagggaatgaggttgttcatgacagcctgctgataatcactgagtcaggcactatgcagggtcttatgaatacattaagtattttagtctctgtgacagtcctgagattggtattattattattacaatgaagaaatggaggtctagagatgttaaatatcttagcctgagtttagaacctaagcttttgaaatggacaaattcctagaaagacacaaattatcataactgactgaattaagtagaaaatatgaatagacctgtaacgagtaagaagattgaatcagtaatcgaaaacttcccaataaagagaagcccaaaaccatataatggcaaagggacactctttgctgggaaaacgggacatccacatacaaaagagtggagttggactcctaccttataccatatacaaagattaacataaaattaaataactaaatgtaagagctataactataaagctcttagaagaaaacatagtgggtaaatctttatgacgttttacttagtaacagagtcttagatttgacaccagaatcacaataaaagaaaaaataaatttgtctactcaaaattaaaaactttttagaatcaaaggacactatcaacagaatgaaaaggcaactcaaggaattggagaaaatatttgtaaattacatttctgataaagggttaatatcagaattgttgaaagaaaatctttagccaaattaaatttaacagagtttaattgagcaaagaatgattcgcaagttgtgcagcctcctgagtctgagtaggctcagagactccaacacagccacatggcagaagaggatttacggacagaaaaaggaatatgatgtacagaaaatggaagtgaggtacagaaacagttgattggttacagcttagcgtttgccttatttgaacacagaacagttagctccctttgattggccaaaacttgatgattggcgtgataataggttacaaagtctgtttacacttccatttaggttatagttcactaggtacagagaagcctctaggctgaacttaaaatatataaggaggcagctttaggctaaacttgatttaacaaaatgtataaagaacttctacaactcaacaacaaaaataaaacaacccaattaagaaatgagaggtaacgtcagcaagatggctgaccttccacctagtgcttgtccttctcaaaaagacagaacaatgaacaaaaaattacattttaatgaaaataactgagggagagtctcggagtacatcagaggtgtaacagagacactggtgagcacagaaacttgggatggccacttagagaatggaatgaaacaccaagcaaacaccaccaccccatcccacaactaggatcagctgggacctaggagagcttttccctttggtgaggaggtaagcaagaggatcccagcagcccccatcaccatctcggacacctgcagaccctaccactcgggtcccctgcagtcctcaaggcactaagcctagctgagggagctgcctggggtccacacacctgtgctccctccagagacaaagccaacactgctcagcccctgtggcccacgtggctactgtgttccactacctaggagttggaactagagcgggagtgtgacttgctcctggagtagccgcagcttccctttatccttgaggcaaaactgccatcaaactaaccaagactggtggccgacatccccaagctgagctgcaagcagctgttacacccttccctgaggggccacgtggaggtggagctgcttcacctacccttcccctccatgcccataggccagagctgaagtggtaccctgcctcctgggaaaacagtaccttggccactcagagcggtcacacctccccagtgtcttaagttgaagcagttccctgcatcccaggaaatggtgcgttggccacccagagcagtcacatcccccaagcctgagctgaagtggcacattgtccccaccccccacccctgggaatcagtgccctggatgaactgagggctgtgcatcccagggctgaactgacatggtaccctgccatcccagataaatagagcattggctcagctgagacacccagccccataggccaaatagctctattgccctgctttcctggagctagacttgccccctggagtctgagctgctgagacagacctggggagtggagttccctgcctccccagggctcaaatgagagcggtgctctgccattctagggtacttgctgctgctacacctgttctcacagaacctgggatactgccaagccctaccatcccagggtctagagtaaccactacatggtgccttttcccctgggacccaagatgccactaacccctattggttcaggttcctgaattgcagctgtatccaacttctcaggcccaaaactccagagcaccccttcttcctgaattggaccagtgctatgccctgcccccaccccgcccaggagtagaatcacagctataatctcgccccctgggcctgagctgctagggaatggcttagaatcagatcctggcactgtgggcaacgtacacccaactctgccccagggagcaaacctgtaccccaacacccaggtgccacaataagttcatgagattctaagtataggacaccagctccacagccactctgagcacctgcacctggaacccagtggtgctgcagctgattgcaggccattagacctgataccaagaggtgtcccctcagctaagtcttcccattgtggggaaaacaaaaataacaggaccccaaaagcccttgacactgaggacatttacagcctacactgccacttctgctgccacaaacttctacaccctggacaactgaagtgcccacaattactgctaatgttgaatgcagctaaagaagttgtagggagactataccactgcacctggaaacagagtaactatgcccttcccagctggcacactaaaacccaactgtactgtacaaagtttggaagaggtgatttgttttaccagatgtacagacattaagggacacaagacacttgaaaaagcaaggaaatcaccaggtgtggtggctcacgcctgtaatcccagcactttgggaggccgaggagggtggatcatgaggtcaggagatcaagaccatcctggctaacacggtgaaaccccgtctctactaaaaatacaaaaaaattagccgggcgcggtggtgggcgcctgtagtcccagctactcgggaggctgaggcaagagaatggcatgaacctgggaggcggagcttgtagtgagccgagatcacgccactgcactccagcctgggtgacagagcgagactccatctcaaagaaaaaaaaaaaaaagcaaggaaatctgacatcacccaaggaacataactctttagtagtagaccctagtaaaaactaaatttaaaaactgacagaaaagggattcaaaataatgttcttaaagaagtgcaacaagatacaagaaaatacagatagacaatgcaatgaaatcagaaatgcaattgacaatatgaatgaaaaattcaacaaagagataggaatcataaaaaaagaaccaagcagatatcctgcagctgacaaattgaatgaatgaaattaaaaataaaaactaacaatagagagcttcagcagtgagtctgatcaagcagaagaaaaaagaaatctctgaacttgaagataggtcatttgaaattagtaagagggaaagaaaagaaataattaaaaagagtgaagaaaagccttcaagaattatggagcatgattaagcaaaaaaatattttatgggtgtctagaaggaaaagagaagggaaaaggtatagaaaatctatttaataaagtaatagctggaaaattcccaagtctggggagagatgtggacatccaaatccaagaagctcaacagtcccccaatagattcaaccaaaaaggttctccccgggacatgttatggtcaaactgtcaaaagtcaaagagaagagaaaattctaaaaacagcaagagaaaagcatcaagtcacatataacagaatcccccgttagactgaaagcagatttctctgcagaaattttatagaccaggagagaatggaatggaatggtatattcagagtggtaaaaggaaaacaaaaaacaaactgtcagtcaagaatactatacccagcaaagctatccttcagaaatgagggagaaataaagtctttcccagacaagcaagaagtgagggaattcatcaccactagaccagccttacaagaaatacacaagggagtcctacatctggaagcaaagacatgataattactatcgtgaaaacacacaaaaatataaaactcgctggtagagtgagtttcacaaaagagaaagagaaaataatcaaaccttactattacagaaaaccactaaaccgtaatgataaataatgagaggaagaaaggaagaaaagatatacaaaacaaccagaaaacaattaacaaaatgacagaagtaagtcctacctataaatgataaccttaaatgtaaatggattaaattccctcacttaaagtatataaactggctgaatagattttttaaatgacccaactatatactgcctacaagaagctcacatcatctataaggacacatatagagtgaaagtaaagggatgaaaaacatactccacgtaaacagaaaccaaattgagcaggagtgctatacttacatcagacaaagcaggctttaagtcaaaaactctgaaaagaagcccagtgtggtggtgcatacttgtagtcccagcaacttgggaggctgaggtggaaagattgcttgagtccaggagttcaaggtggtagtgtgctgtgattacacctgtgagtagccactacactccagcctgggcaacataccaagaccccatctctttaagaaaaaaaattttagggcaaggaatgtcattatataatgataaaggaatcaattcagcaagaaaatacaacaattgtcaatatatatggacccaacagtagagcacccagacatacaaaacaaatattattagatccaaaaagagagatagattccagcacagtgtcatttgcggatttccgtaccctatgctccgcattgaacagatcatctagacagaaaatcaacaacaaaaaacccacattggctttaaagtgccttttagtccaaatggacctaacagacatttccagaacttttcatccaaccattgcatggtacacattagctgcttcatcacatggaagataatctaggagagatcagatgttaggccacaaaacaagtctcaacaaatgtaaaataattgaaattgtatcaagtattttttctaacaataataaaataaaactagaaatcagtaacaaggggagcttttgaaattgtacaaattcatgaaaattaacattctcctgaaagacaaatgggccaaggaagaaattaagaaggcagttttacaatttggcctggcacagtagctcacgcctgtaatcccagcactttgggaggctgaagcgggcagatcatttgaggtcaggagttcgagaccagcctggctaacatggtgaaaccctgtctctacttaaaacataaaaattagcgggcatggtggtgggtgcctgtaatcccaggtactcaggaggctgaggcaggagaatcacttgaacctgggaggcagagtttgcagtgagccaagattgcaccactgcactccagtctgggtgacagagtaagactctgtctcaaaaaaaaaaaaaaaaaaagaaaaagaaaaaaaagaaaagagaaaaagaagcctgggcacagtggctcacgcctgtagtcccagcactttgggaggccgaggtgggtggatcacgaggtcaagagatcgacaccatcctggccaacatggtgaaaccccgtctctactaaaaatacaaaaattagccgtgtgtggtagcacgcgcctgtagtcccagctacttgggaggcggaggcaggagaattgcttgaacccaggaggcggaggttgcagtgagccgagatcataccactgcactccagcctggtgacagagtgagactccgtctcaaaaaaaaaaaaaaaaaaaaaaaaaagacagaaaaagagaagaaaaaaatattgaaacaataaaaatagaaacacatgtcatgataacttgaaccaggggcagggtaggtggagaagaaacatagcatgccaaaacttatgggatacagtaaaagcagtatgaaatgggaattttatagcaataaaagcctacatcagaaacacacaaagatttcaaataaatgacttaatgatgcatctcaaggaactaggaataaaacccaaaccaggccgaaaattagtagaggaacaaaaataataaagatcagaacaagagcaaaaagaaacaatattgagatgaaaacattacaaaagatcaacgaaatgaaaatatagccaggtgcggtggctcacacctgtaatcccagcactttgggaggccgtggcaagtggatcacttgaggttaggagttcaagaccagcctggccaacatggtgaaaccccatctctactaaaagtataaaaattagccagttatgttggcgggcacctgtaagcccatctacttgggaggctgaggcaggagaattgcttgaacccaggaggcggaagttgcagtgagccgagattatgccactgcactccagcctgggtgacaaagccagactctgtctcaaaaaaaaaaaaattgtttttttgaaaagataattgacaaaccattagctagattaagcaagaaaatatgcaaataaataattcagaagtaaaaaaggagacattacaactaatatcatagaaatacaaaggatcattagtgactattatgaacaactgtacaccaacacattagaaaacctagcggaaatggataaattcctggatgcatggaacccaccaagattgaaccaaggagaaaagaaaacctgaacagaccaattactgtaatgagattgaatctgtaatttaaaaatctcccatcggccgggcatggtggcttacgtttgtaatcccagcgctttgtgaggtcaaggcaggcagatcatgaggtcaggagatcgagaccatcctggccaacatagtgaaaccccgtctctactaaaatacaaaaaaaaaaaattagccaggcgtggtggtgcacgcctgtggtcccaagtactcaggaggctgaggcaggggactttcttgaacctgggaggcagaggttgtagtgaccggagatcgcgccattgcactccagcctggacaacaagagcaaaactccgtctcaaaaaaaaaaaaaaaaaaaaaaaaaaaaaaaaaaatcccatcaaagaaaagcccagggtgcttcactagagaattctgccaaacatttaaagaagaactaacacctgttcttctcaagctcttctagaaaattgaagaggagggaattcttctaaactcattctacaagactagcattaccctaatataaaaaccagagaaggacacagcagaaacagaaacaaaaacaaaaaacactagaaagaaaaaggaaactataggccaatatttctgatgatcgtagatggaaaaattctcaagaaaaatagtattttgtagtaattagtagtaactgaatccagcagcacattttaattcactgtgatcaaatgggatttattcctgggatgtaaggatggttcaacataagtaaaccagtaatcaacataatacattacatcaacagaatgaaggacaaaaacaatattatcatctcaatagacacagaaaaaaatatttgataaaattcaacatcccttcatagtgaaaactcaacaagttaggttggaagatacctcaacacaataaaggttgtatatgacaaacccacagccaacatcatactgaatggggaaaagatctacaacaagaaaggatacccactttcacaacttttattcaacatagtactggaagttctagccagagcagttatgtaagaaaaaaaataagccgcatccaaactggaaagaaggaagtcaaattgttcctgtttgcagacaacatgtcttatatatagaaaaccctaaaagctccaccaaaaaatccttagaactcataaagtaattcagtaaaatcaatgtacaaaaatcagtagtgtgtctgtataccaacaacaaactagcagaaaagaaatcagtctcatttacaatagttacaaaagaaataactaaggaagtgaaagatctctacaaagaaaactataaaacattgatgaaagatactgaagaggacacacaaaaaatagaaagacatttgatgctcatggattggaagaattaatattgtgaaaaggaccatgcagatttaatgcaatccctatcaaaataccaatgacattcttcatagaaatataaaaaaaatcctaaaattaatacagaaccacaaaagaccctggatagcttaaataatcttgagcaacaagaagaaagctggaggcatcacactaccaaactttgaaacagcatggtactggcataaaaacagaaacatagaccaatggaatagaatagagaactcagaaataagtatttgtatttacagccaactgatttttaacaaaagcaccaagaacatttattggagcaggacagtctcttcaataaacgatggtagggaaactagatatccacatgcagaaaaatgcagctcaacccctatctctcgctatttacaaaagccaactcaaaatggatcaaagacttaaatgtaagactcaaaaccatgaatctactagaataaaatacagggaaaacacttcaggatattggtctgggcaaaaattgtatggagaagacctcaagagcacaggcaaccaaagcacaaatagacaaatggggttgcatttcagtaaaaagcttctgcacagccaatgaaataatcaacagagtgacaacttgcagaatcagagaaaatattgcaaactatttatctgacaagctattaatatccaaaatatacaaggtgaaactcaacccatcagcaaaaaaaaaaaaaaaaaaaaaaaaaaaaaaaaatcagattaataaatgggcaaatgaactgaatagacatctctcaaaagaagacatacaaatggccagctggtataagaaaaagtgctcaacatctctaatcatcagggaaatgcaaatcaaaaccacagtgagataccatctcaccccagttagaatggctgttatcaaaaacacacaaaaaaaataacaaatactcatgagaatggagagaaaggagaactcttatacactcttggtaggaagcctcctcaaaaaactgaaaatagaactactgtgtgtgatctagcaattccactactgggtatatatccaaacggagggaaatcaattatgtcagagatatctgggctctcatgtttattgccatactattcacagtagccaagatatggaatcaacttaagtgtccatccacacatgaatggatttttaaaatattttccttatacacaatggaatactatttagccataaaaagaatgaaattctgccgcttgtggcaacatggatgagcttggaggtcattatgttaaggtaaataagtcaggcacagaaagataaatattgcatgttctcactcatatgtggaagctaaaaaaaaattgctctcatagaagtggagagtggaatagtggttactagaggcagggaaggttaggaggatgggggatagccaaaggttggtgaacggatacaaaagtacagctagacaggtgaaataagtttgagtcttctgtatcactgtagggtgactataattaacaacagtttgttgaatattttcaaatatttcaaatattttcaaataggagagcaaattttgaatgctcccaacacagaaataagtgtttgaggtgatggatatgctaattactgtgatttgatcattacacatttgtatacatgtatcaaaatattatactgtaccccataaatatatgcaattattacatgtcaattaaaaaaataatgaaagcaaaacaaaaatttataagaaagaaatgggcaaagggattgaatttaaaaaaaggaactgaataagtaaaaataagtaaatagctcctatggggggaaccagcccccagtatttcaacataggttcttttctatttttcctaagtgtcggctggtctgagaaataaagagaaagagtacaaaagagagaaattttacagctgggcctccgggggtgacatcacctattggtaggttctgtgatgccccttgaactgcaaaaccagcaagtttttattagggatttcaaaaggggagaggggtacaaacagggagtaagacacaaagagcacatgcttcaaagggcaataaaagatcacaagggcagagaggcagagcaagatcacaaggccagggtgaaattagaattactgatgaggttccatgtcccactaggcactcattgtcttgataaacatcttaacaggaaacctggtttgagagcagacaaccggtctgactagaatttgccaggctgaagtttcctaatcccagcaagcctgagggcactgcaggagaccagggcgtatttcatccctggtcgtcaaccacataaggcacacaatcccagagcagcagtctgtaggcctacccctgggaatgcattcctttcccagggttattccttgctgggaaaagaattcagcaatatttctcctattcgctttctgcaagaagagaaatatggctctgttctgcccagccctgcaggcagtcggaccttatagttatctcccttgttccctgaaaatcgctgttatcctgttcttttttaggatgaccagatttcatatcgttcaaacacacatgttttactaacaatttgtacagataacgcaatcatcacagggtcctgaggtgacatacatcctcagcttacgaagatgacaggattaagagattaaagtaaagacaggcataggaaattataagagtattgattggggaagtgataaatgtccatgaaatcgtcacaatttatgttcagagattgcagtaaagacaggcataagaaattataaaagtattaatttggggaactaacaaatgtccatgaaatcttcacaatttatgttcttctgccgtggcttcagccggtccctccgttcagggtccctgacttcctgcaacaagctcctgcacagccagtgaaataatcaacagagtgacaagacaacttgcagaatcagagaaaatattgcaaactattcatctgacaagtgattaatatccatttctccaaatacaatgaccaataagcacatgaaaaaatattcaacatcactaataattagggaaatgcaaatcaaaaccacagtgaaataccacttcacacccagtagaattggtattactaaagaaaaaaagatagaaaaagaaaagagaataggccaggtgcagtagctcacacctataatctcaacacttttggaggccgaggtagacagatcacctaagttcaggagttcaagaccagcttggccaacatggcaaaaccctgtctctactaaaaatacaaaaattagctgggcctggtggtacatgtctaatcccagctactcaggaggctgaggcatgagaatcgcttgaacccaggagatggaagttgcagtgagccgagatcatgcctgggctacagagtgagactctgtctcaaaaaaaaaaaaaaaaaaaaaaaaagaagaagaagacagaaaagaaaagaaaatagaccaggtgcagtagctcaggcctgtaatcccagcactttgggagtccaaggcaggcagatcagttgaggccaggagtttgagactagcctggccaacatggtgaaattctggctctactaaaaatacaaaaattagctgggtgtggtctcatacacttgtaatcccaggtactcaggaggctaaggcagagaatcacttgaacctgggaggtggaggctgcagtgacctgagatcacgccactgcactccagcctgggagacagagcaagactccatctcaaaaaaaaaactaataaattaattaaattaattaataaatattggcaaaaatgtggagaaatttcaacccttgtgcactggtgggtatgactgtaaaatggtggtgtggaaaatagtatgatagttcctcaaaatagtagtaaaagtgaattacagaatgatccagtaattgtactcttggtatagacccaaaagaaatcaaatcagggacttcaacagatatatgtccacacatgctcatagcagtgttactcacaatagccaaaaggagaaaggaacaccagtttccatcaacagatgaatgggtaaacaatgtatgaacattcaatggactataattattcagccttaaaaaggaagagcgttctgacacattctacaatgtgaataaaccttgaagacgttatgttaggtgaaataagctagtcacaaaaggacagacactgtatgattccacttatataagttacctatagtagtcaaattcatcgagacagtaagtagaatggtggtttccaggggaggatggatgaggaattattgtttcatggatacagagtttcagtttgggaatacgaagaaaattttggagacggatggtattcatggttgcacaacagtgtgaatatacttaatgccactgacctctacacttaaaaattgttaaaatggaaatttttttgttatgtatctttactacagtaaaaaaaaaaaaaaaaagaagaagaagaagaaagtgaacactcaaacttctcccaaatatacaagaggaggaaacacttcctaacacattctgtgaggccagcattgcccttatatcatggtcaaatatgccacaagaaaagaaaactgcagacttatatcccttatgaatattgatccaaagatcatcaacaaaaatactagcaaactaattccaacaacacatttcccaatttcaaaatgtactagaaagctacagttatcaaaacaatgtggtactggcataaagatagatacataggccaattaagtagaattgaaagtccagcaataaactcaaatatctgtgttcaattgacttttgacagttgtgctaatgggggaaagaattgtctttctttccatgataattcagtgagggagagaataatcttttcaacaaataatatggagaaaactggatatccacatgcaaaagaatgaggttggacctctacctcactcaatatacaaaattatctcagtcaatcaaaaacctaatagaatagcaaaaattatgaaactattagaagaatacataaaggataaatcttcaggacctcagaattggtgatggattcttagatttgacaccaaaatcataagcaaccaaagaaaaaatagataaattagactacatcaaaatttaaaatttttgtacgtcaaaggacattatcaaatatgtggaaatacaatgtacagaacaaaatacttgcaaatcacatatttaataaggggttaatattcagcatatataaagaactcctacacctcaacaacaaaaaaccaaacagctcaattttttaaatggcaggggataagagtaggcatttctctaaaaaagatatgcaaatggcaaacaatcacatgaaaagatattcaacatctttggtcatcaaggaaatgcaaatcaaaactacaatgagatacctctttacatccaccatgacagctataacaataatttttctaaaaattgaaaataacaagtgtcgacaaggatgtggagaaggaggaactgttgtacattgccagtaggaatgtaaaatgcaccagctgctatggaagaagtttggcagttcctaaaaaaaaatgaagcatagaattaccatatgacccagtaatttcactcctaggtatatacccaagagaaatgaaaagatgtatctgcatagaaacttgtacatgaatgtttatggcaacatgaatcataatagtcaaaaggcagaaacaacccaaatgcctatcagtgaatgaatgtggtgtattaccactggaatgttattcagccataaaaagaagtgaagtactaatagatactacaatatggatgaaccttgaaaacattaagctaagtgaaagaagccagacatcaaatcatattgtgtgattcctttatgtgaaattccagaatagacaaagccatagaaacagaaaggagattggtggttgccagggggttgggggggcggggattggggtggtgattacccaatgtgtatgaggtattcttcgggaacgacgaaaaaagttttgaaacgagagagatggttgcacaatattgtgaatacactaaatgcccctgaactgtacattttaaaatgggtaattgtatgttgtgggactttaaacttaattttaaaataagaacccaaattgttggcccgtagagtccaaactgttaactgcacgtcacggatttcatggaaggccagtctgagagggaaagacaatgtgatcacagagaggaagggagggagggtcatggacaggaaactccggggcctgaaatagggcaagacactagcatgtggattccagaaccccgtgaaggcaggaagtcttggaagtcccatggggagagcagatcgggcatgtgctggtcaaatcagagtgacccctgctatcctgagagcttcacacacactggagagtggtggggggcggcggggagggcaggctgaggtctctctccgtcacctgttctccttcctgtcctgcagatgttgaacctctttgtggctgtgatcatggacaattttgagtacctcacgcgggactcttccatcctaggtcctcaccacttggatgagttcatccgggtctgggctgaatacgacccggctgcgtggtaagtgagccgtggtgctctgtggtccttgggggtggtccatgcccatagatcttgggatgggcctggtggcttcagacatgtttcaagtgagcaccccctcaggttttggtttggggcctagggatctgtcctgtttcgtgtagagcagcagtgatgtcccctccgagcagcacctcccttttccatctcgtgtgccttcgcgcagtggcccggactgcataaagtgataagggtcttttgagaccttgagttcagttccttgggaggtaccaggagtcatggaaggttttcaaggggcttgtgagactcaggtcttctgctgaaatttactgtcttctttcaaggcctgtcatgtgagggctcatggagggcttgtgggagggtgtgtggagacagcacagccatagcgtccttgtgagactcgatgtagggttttaggacattctccctaaggggctcaggagtctccctctgctctttcttttggggacaggggccaacatgcacctctgtgtccccagcccaggctgcatatagtgtgggtgcttggtgaacttttttgacagatgagctaccaggaaggctgtagtgtgtttaagacccttgtctatcatctgtcatcgtgggaaaggtttacttgtttcaaaggcgaggggtggtgcctttccagacagaggaggagtcgcatgaagggcatggtttgggtcagaaggtgaagctgtttgagatcaggatccatgggggtcccgtacagcatggcatctcagcagggctgagagctcattcgggaaggaagacaggtcaggcagcatggcttctccatctttctgtttgtccattccttccatcactcgttcctcatttacttgctcgctcactcactcaagcaatgtctactgtgggctgctccctgcaaggccactaggcctgctagcacctcactcacagcgtgtgcccgggaaatgatcgtggatgagcagctctcagtgagtgcgtagacatccaccactccccgtgccctagggggatgagggaaccgtgggtgccaccgaggcctgccttctctctctgagctcctcagcctgcccaggccccctcgcactcctctgcccccagtgcccttactgggggagggccggcaggacgtggtcagacccctcatggtgaggtcctactgcccacagagctcctgggttctgcctggttttgcttaaactgcagctcagcagagggagccctccacagacacaaaaggcctgggagcccgactagacttccccaccctcctttccactcagcctccccggagcacccccaccttcctagtgaggatccagagggtgctgcacgggcccttcccagtctggacaaggtccagagccactggcagcatcgggggccctgggatggggcctctcctgtccaggctcttccaggcacacagcatctctgtgggtgtttttcatttgagtcggaaatatacagtttttacgcagtgcaaaacagacgtagagattgtctgtgtttcacagtgtatatgacaatttccgtggcttgcgagaaccctgtcatgtccgatgcagcaatatgtttgccctgtgatacttacttcatgctgggagggacaggctcaggcacattcacacaggacctgtggtcaagtaagcccagtcgacctgggggagactgaccacattgaagacctagaccttgttaggcaaagggcaggagagactccagccgaggcaggatttaggtgaattctaggcaggtcaccctgaatgtgtggtttagagagtcgctgctttttctgggtgtattttttctggaggagactgtgttgcagaaaacagagatactttatagcatgtagttagtactgaagggcaaaggcagatcaacaaaggcctgtgagaggatgacaacattccccaatctttatgagctacgcccgggccttccacagtcagccgccggcaagagcagaggcaggaagaacgggaagtggacttgggccagatggcagcttggttaccatgcacagtggtaccataccaaagccagagtctcagagcaggggtccttagaagacataggcagtcggggatgtgagaagtgcttactgaagagtaaacaacagaatacaggcctcaccccagagatagcacgcacaaaataacacacaaaacctgcgggccttgagatagcacagacgtgacctgtgagcaacacatgattctgcccccacgagcagcctgggctcaccctacgtagtccaagatggccaggacaggccgaggggcccagcagaggcagctgagcagattgggcctggatcctgtgtcctgagcagagcacagggcaccttgagcctttttggtagcctctgtgacaaacgcagtgatgtagtcatttcccaggggaccactctatggctcctcgttctttgggagaaactttgaaacaacaacaaaattttatgagatttcctgagttgtgtgtgcacatgtgtggtgcacaaacaggacatgtgtgcatgtacatggctgtgttgtgtgcgtgtttgcacagtgtgaccacatgtgcactctgtgcatgtgtacatgtgtgttgtgcacgcatgcacacagatgtctacatgtgtgttttgtgcacatgtgcatgcacaaggcgcgcacgtgtgtgcatgttgacgtttgtgtgtgcacatatgattgtatatatgtgtgcctgtgtgtatatgtgtgcaagtgaactgaatgtgcgtgcatgcctgtgtggttgtatgtggatgtgtgtatgaatgacatgtgcacctgtgtgtgcatatgcccatgtgtgcatgtgtgtgcctgtggatgtgcacatgcccgtgtgtgcctgtggtgtgcacgtgtctgtggtgtgcacgtgcctgtgtgtgcatgtgcctttgtgtgtgtgccaccgtggtgcgtatgtgcctgtgtgtgcctgtgggtgtgcacgtgcctgtggtgtactcgtgcctgtggtgtgcatgtgcctgtggtgtgcatgtgcctgtggtgcgcatgtgcctgtgtgggtgtgcatgtgtgtgcctgtgggtgtgcacatgtctgtggtgtacacgtgcctgtggtgcgcatgtgcctgtgtcggtggattctgaaggcacgaaactgttcaccctggtgctgcttttcccagccttcctattgttgttgcttcaaccctgtggtgtgaagcctggtgacttgagaggagaattgcagtcacacttcttgcagcaatctggctgctcatttctgtgtccacccatctgtctaataacatctcctgggcatctgccatgtgctggggcaggggcccaaaggtgaaacaggcacatgctgtcagaacactcagccaggcttggcagtgagaccacatggtgactgtagctcaaggccagggcatttctgaggaaggagaggccatgtctggcctgaagaatgagaggaggtgccatttgagctgaacttaaaggaataggaaggattgagcactagagaaataggatggattgagctggggatgggaggtggggcagagggaagagggaggccaggtggcttctgtcaggctggagaggagagtgcattgcagaggggctgcaaggaaggctgagaccgtttgagaaaggcattgaaattggttgaacaagtcgctttgattttgcgttgtagacagtgggctcagtccttgcatcgaggagtgatggtgtcaggcccacactttccacctgggcttgatgggcagggacagctggggagggtggggggtctcacgtgtgtccagccccccgtggtggtcccttggctgccacaaccttagcaaacatctttggtgaggccgaggtggggcttcctgtttcttcccttttacagaaggaaattcaacatgatttggagctgattggaccgagggggctacactgtaggagagaggagcattggtggtgatccaaggatgccagcctacgatgagaggaggtccttagctggaccagggcttccaggggaggacacagagtgttcagggagacagggtcagtcaggaggcaaatgggtatgggcctctgaggttgctgtgatagagaagcagacctgccttgctgtggtggtgagaaagccaggcgtcagagggtttggctgacctgggaggcccagggagcatcgtcactcagggagtgagaggaagagctgaccgagagggaggggcagggcagtgttctgtgtggagcggctcctgcacacatcgggctccggaaatttcgctggggttgccacacctcccggggagctccaagccccagtaccccggcgaggtgccacctgtccagtgcacccctcacctccgccgccacgcctgcgcgaggtcggtcttcccatcacaggctgggcgggcgggagggtcgggctccatcctgcctttgttgccataacctgtgacatttcctttccagttgccggattcattataaggatatgtacagtttgttgcgttgtattgcgccacccgttggcttagggaagaactgccctcgtaggttggcctacaaggtttgcaacttcagagcctccatccaacatacttccctgcccgaaacgcacacagcacacactccctgcctggtttgggaatgacgacgcctcacctttctttcctcctgtcctgccccgcactccagcctcctggacgctttggttccctgtctaatctcccctgacccttctagctggctggggacaggcagccttttgagagtgcacagaaagctttctggttgggatcagctagctgggtgggagatgggggctaggtccctcctgcatcaaggaagcagccgacttgcccggtttttcctccgagctctcgagagtgagctgatggtcaggccaaaggccgagggccccagaggaagggagcacgggcacaggcctcccaggagcagccgtcctctgggttggaagagcccagtaacccagtggctctccagtccctgggggaggaaagggcagaggcagagtgggggccaaagacaagccgtcctgctttgcctctggagtgatgcgctcagctcagccaaggagcccctggtctggaaccgtgggaggagggcaaggccccagggcagatccatctgccaggaagaggctgtcccctttctctcctgggccacctgaatctggctgtgtctctaggaccccaagcccacaggcaggtgtcccagggttggaggtaggccccaggcctcgtggcctctctacttgggaagactctgtcatcggagcctttaggttcctagatcctgcaacctgcccctttgctgtcagagctggtgcaaggtggccccaggccatgtcctgccagctcctcccccctcccgcagtctcccatttcccacccagccctgagccccagcagcagccctgccctgggctggcctcgggcgtctctgggcttgaagcaggacttgccccaaggttaggttttggctgtacagcttcagggctccctgtttagttttctggtttgtttcagatcttctccacctttttagcctctagcctcacttggaagcaaatctgaccgtgaggaaagctgatgtctctgccgtggttctcagccactgcctcatctgccacctgaccccgcctgccagctcttctggcagggtggaccagctcttttctgattggcattcactgtgatttttaaaagagtaaaatcagaaattatcaacccaaagccgccccgatgcagcccttcctcacccctccatgttcattagctcagacgccacccccgcccactgccccgcgtggggctggagtgaggaggtgaggctcgggggtggggggccaggagggggtcaagccaagcagagaaatccctcattttatttattttgattttgggctttgaatccgacactttgattaactggctctgttttcttgtctgcttcctccctgcccctaccccgctcccctccccgctcccctcctgctgccgctcctcctgtggaccaccccactgtgccctggcctcgctgggacgggtttccagtgggcgcatcagttacaatgacatgtttgagatgctgaaacacatgtccccgcctctggggctggggaagaaatgccctgctcgagttgcttacaaggtagaccctgaccctgcaacccgccccccaggaggctgtgtgtgcttgctgaggggtgcttgctggctctcccagctcctctccctttcagggtgcccggctgtctgtctgccgctctgctgtgcgcccccggctgcctcactgtgtctttctcttcagccccatcccagcttccttcccagacagagggatgtggccaccatgatgtctcactggcctcttgtccccacaacctgagctgccccctttgagagccccctggaggctcaggaagacagaactagaccctcctccctgccttttctccctcccttcctttcctaggaatgaggggacagaccacttgtttgacagagattgtttttgttctgggctcagaacaaagccctaagcccctggtatggatggagctgtccagccctctgggtctggccctgggggcaggtggggcctgcagggcctctggtgcttctgtacaaccccctccccagctcagcaagtgcagaggctctctgggcccaggctgcagtctccagggactttctaggctccatggtggggaagaggcactgtggcactgagaaggaaaggggtgctggggagaggcatcttgctattattcctggggcctcagagggctgctggaggatggggatggcctcggggcccaggagtcatgggatgctgagttgccaagaagggggtaaatcgagggatgcctccaggcctccctcctgggtgggcaagcagatcacatggcccagccctaaaactgttccatctgcccagctgtccccagtcccacctcataccctccatgtgtaagcaccttcgttcccccagcacccacccacctactcaagagccctcctgaggcccccactgctctccggcaaacggcctgtggttcagccaacacgtgcctagagcttttctgatcctccctgaggaagactttcctgagtctgtctgaggaagcttcctgccagagctttcctctctggtgctgtggacagctgttgtccacactggctctgtgccctgactctaggtctttgtcacccgactcagtgcagcctgtgggagccaagtggctcctccaagccatcctcagcccctgccctgcccctgcattgtgcctgcctgggggttctgcatgcaaggctgtagctttgtccccaagaaggagagctctgtccacacttggcgccggggcaagcaggcagggccatgatggagcagcctttggagccccacccagctgtgctggctgactccaaggttctgggcatggagagaccaagggaggcctcagggtgggggcagaagggccagatgagctgaggagggtccaggagatgcccagagcactgcaccttggagggcccagggcagagacacctgtttgtttgccctggccttgcctcttggcttcttcctgagattcttggccctttggggcctggagtgggctgatggcacccctggggagggcagccctccagtgccctgggcggagctcttccttcttgtaaatcacctgcctgctctgccctcactgctatccccaacgccccccaacgcctgccctgtgggagaggaattccttggcctctcacaccgccattcatgctggtctgcagggatgccattctccgggaagccgtttactcctgttgtgctgcacacacatgctgtgcaaagccctgggactaggactggacgtggcaagtggggctttgccagcattcggggccagagtcaggctcatgtctccagcccggcttgcatccacaccccactagctattaggctgaggactctggatttggggccatgatgctaggggcagggctgtatggccctccctagagaagaggctgccctgccacaggttgcaggcttgggcaaggacaggcagaccctggggaggagctcctgtctctagctggacagtgctcctggggctccacttggccagctccttgctccccacgctcaaaatattccaggcacacttgagatgcatttcctccttggggcctcttcagttcttagagcctgggtctctgggcagcactggctggggccagaggactgtggtgcagacacgagctcgtctccagctgttctgtccctgaaaactggcaacaggctgtccacctgagagggagacggagcagagctgcaggacactgccccagcccactctgaagtgtagcagcctcagcctgcagccctgggaagtcccatctgttcctgtccttccagcagcaggagctgccttgcgcagagatgggctctgccttttagtgacatcgagcatctctcccaggcctcatgctgggtggtgagaggcagaagcctcactggacctgagctaaaaccaggatgtcacctgtaggggcccccactgggagctgggccccagagaggcaccctggaccacctactccttgtccagatgatcgaagtggtgggaggagaagatgggggtgggcagagcaatgagcacagggacctcttctgtctgtggctgctgctcctcctccccagccaaggctacactcctacattcagccacaggcaggggtccctcagggtgaggaggtggctgtgctttcagagggatcaaggctccagtctttacctggagttctacttttctgcagccaggagggtcctcagctagatttgtggggcggggagtccaggggagagtgtgaatgctggcaaaactcccacccgccccacctcactcaggcctaggcacctgcaggcaccaccactgggatgcccagcccagcatccagggaccccatcattgcgtagtcttggggtggggggtgaccccagcaggcctggccctgaccggccctgcttgtccctagcgcctggttcgcatgaacatgcccatctccaacgaggacatgactgttcacttcacgtccacgctgatggccctcatccggacggcactggagatcaagctggccccaggtgagcaaggcagcctcggaaggagggccctggacccagggatgtgcacctccgccctcagtgtcagccccaggaggacacgcagggaggagggtgaggggccagctgtgtctggaggggtctgaggacagctgcacaggatacccaccctggggcactggctttttcgcctggtaaccgtctgcacattagcactgcaatgatcccattttcaggtaaggaaactgaggcatggtgagatttcataaattgcccaggtaattcagagccagctggtggtggaaccaggacacagcctggtcaagcctcaccacagccagcgccctccctggggacgagcctgcatgcccttggccccctcccatagtgagcccatccggtctttccctgatctgatggacagtaccacagagcgatgccaaagcaaggagagaaggagcctgtagtgtgttcttccccacgtccaccttccccaccacagaggagattacagccccagagggccctgccccagccccacccccctgcgtctgccccatctcctgctttgtgtgccaagcctcacttacgtctccccaagggtgccgtagtggcaatgccatactgtttcttgccctgtctactgggttatttgtgtcagcatataaacacccgattatttcctccatcttcaaaaagttcgctgggcgcggtggctcatgcctgtaatcccagcactttgggaggccgaggtgggcggatcacgaggtcaggagatggacaccatcctggccaacatggtgaaaccccatctctactaaaaatacaaaaattaggtgggcgtggtggtggcacgtgcctgtattcctagctattcaggaggctgaggcaggcttgaacctgggaggcggaggttgcagtgagctgagattgtaccacggcactccagcctggtgacagagcaagactccgtctcgaaaacaaccaaaaaagttatcttcccctctgtcgacttccctattctctcctttctaatgccctgctcttgagaggttgtctctgatttccctttcccacatgctgggggctcttcccagcttcaccagagctgcccttggggtctccaggcctccacgttgctcgactcaaaggctgaggcacatccccagctcatgggctgtccatggccgtttctccatttgcattttcttctctttgaaccttttttatctgtttctccgatcccacaaactttgggtgtgcctttgtgccatggaatgttctctctacactcactcctttatcatctcacctattcccatggctttaaataacattaatctcctgacttctctcctgaacttcaaattttcccccacagccttccctatctcagtcaatgcttaagccgaaaccttagaaatcatcttattttatttatttatttatttatttatttatttatttatttatttatttatatagggtctcactgtgtcacccaggctggagtgcagtggtgcagtcacggctcactgcagcctccacctcccaggctcaagtgatcctcctgcctcggcctcccaaagtgctgggattgcaggcaccactcctccatactagtttttgtatattttttagagatgggggttcgctgtgttgcacaggctgaggatcatccttttctcctccttccttatcccatttctgattcatgccttctctttcatattttcttgactctgtctttaaaatatatccaaaatgtggccactcctctcccttaccccattgccgcctcctctggctctcagctgttgctgcagcagcttctaattcatccacttctgcccttggccccttctgtctgccttcaacacaacagccagagtgatcaggttaaaaaaaagactaatggccgggcgcagtggctcacgtctgtagtcctagcactttgggaggccaaggcaggcagattgcctgagctcagaagttcaagtccagcctggacaacacagtgaaaccccgtctctactaaaatacaaaaaattagccgggcatggtggcgggcgcctgtagtcccagctactcgggaggctgaggcaggagaatggcgtgaacccaggaggcagagcttgcagtgagccgagattgcgccactgcactccagtctgggtgacagagtgagactctgtctcaaaaaaaaaagaatagataaccttcagtttcaacaccagaggacaaaaaaaaaaaaaaaagagataaccaggccaggtgccctggcttatgcctgtaatcccagcagtttttgaggttgagggaggaggatcacttgagctcaggagtttgagaccagtccgggcaacacagggagcccctggctctacaaaatattaaaaaattagctgaatgtggtggtgaacgcctgtgctcccagctgcttggggaggctgaggtaggaggaatgagctgtgatggtgccactgcactatagcctgggcaacagagtgaaaccccatctcaaaaaaaaaaaaaaaaaaaaaagcaaaagcttcataataccatatatattaaataaattaagtttagagtggaaaaaccttccaagaaagacaatcccaggtccaaatggcttctttattgaagtctaccaactgtttagggaagaaataatgccaattctgtatagactcttccaaaaagtggaaaaagggaatattttccaacttattttattttcagaggccagctttgctctgataccaaaactagacaaagacatgaccagaaaagaaaactacagacgaatatcccttataaacatagatttttttaaatcttcaacataatctttaagcaaactgaattttttttttttttgagatggagtctcactctgttgcccaggctggagtgcagtggcacgatcttggctcactacaagctctgcctcctgggttcacgccattctcctgcctcagcctcccgagtagctgggactacaggtgcacgccaccacgcctggctaacttttttgtatttttagtagagacagggtttcaccgtgttagccaggatggtctccatctcctgacctcgtgatccgcccgtctcagcctcctcccaaagtgctgggattacaggcgtgagccactgcacccggccaaactgaatatattttaaaagataatatatgatgacacaagtggggtttaccccaggataagttaggttcagtgtttgaaaatccagtttactgtatcaaagaaggaaaagtatatgattatctcaataggtatagaaaaagcatttgacaaaattcaacatccattcatgatttttaaaattttacataaagtaggaattaaggaaagcttcatcaatcatgtatcatagactcacttatacggtcaattgatttttaacaaacttggaaaggcaattaatggagaaaagatcatcttttctacaaatgatgctggagaaatttagacaatcctatacaaaaagagacattcttgacatgccgttttagcttgctcgggctgccccaagaaaatatcacagcttagacaaaagaaatgtatttctcacagttctggaagccagaagtccaagagtttgtgtttgtgaggtgggtgtcactcttaggcctcttctcttggctggtaaacagccatggtcctgctgtgtcctcaaacagacttgcctctgtgtgtgcagggagagaaaaagagcaagtggatttccaggtgtctcctatgagaccactgattctgtggatcagggccccacaggaactccttgaactgatcacctccttacaggccccgtcaccaaatacagtcacatctggggcttagggcttctacatgtggactggagttggggacagcttgatccatagcacataccttttaccctgtacaaaaaataacttgaaatggattgtagacagaaacgtaaaatctaaaattatgaaacctgtatagaaaacacaaggccaggcgttggtggctcacgcctgtaattccaacactttgggaggccaaagcaggcggattacctgaggtcatgagtttgagaccaacttggccaacatggtgaaacccgtccctactaaaaaaagctgggcctgctggtgtgcacctgtagtccctgggaggctgaggcaggaaaattgcttgaacctgggagtcggaggttgcagtgagccaagatagtgccactgtactccagccttggtgacagaccgagattccatctcaaatggaaaaaatcgataaattgaactacagcaaaacttttgctatatgatatatatatatatacatatatatatatatttgagacagtcttgctctgttgcccaggctgcagtgcagtggtgcaatctcagctcactgcagtctctgcctcctgggttcaaacgattcctctgcctcagcctcccaagtagctgggattacaggcacatttcaacacacacaactaatttttgtatttttagtagagacggggtttcaccatgttggccaggctggtcttgaactcctgacctcaaatgatccacttgccttggcctcccatagtgctggaattacgggagtgagccactgtgccccaccacaaaagatatttttaaaaatgaggccaagtgcagtggcttgtacctgcaatcccagctttgattaactttgagagaagaggtgggaagattgctggaatccaggagttcaagaccagcctggacaacaaagtgaggctctgtctctacaaaaaataattttaaaaaatcagctgggcatggtggcgcatgcctgtggtcccagctactcaggaggctacggcggaaggattgcttgagcccaggtgttcgaggttccagtgagctgtgatcatactactgcactccagcctgggcaacagattgagaccctgtctcaaaacaaaacaaaaaaccagaatgaaaagacaagcctaaaattggagaacatatttgctaaacacgtatctgctataggattagtattcctaatatatgaagaactgtcacaactccctaagaaaataacccaaccaaaacagacaaaagatttgaacagaagtgtcatcaaagaagatatatggaaggcaaacaaacacatgcaaaaatgcttgatgtcattaatcattagacaaatccagaatttaaaaaaaaaaaaaccacaacgagattacactccagtctactggagttgccaaaatgcttttcagaatgacaatacttagtgctgagagggcagagcaactggaattctacatgttcccagtcggaaaagaaaatggtgcagccccttagacagtttgccgttacttctatggtccagccattgcacttaggaaatgaaaacatacatccacacaatctatgtgcagatgtttacagctttattcaaaattgccccaaactgtaaacaactcatatgtccatcaattggcaatggataaacaaatggtgcattcatacaattaaagaatactcaggagtaaaaggaaacacgctacagttgcgtgtggcaatgtgtatgactctcacatgcaccacactgtgtgaaagaagccagattcaaaggccagtgtgctgtatgatgccattggcgtgacattctggagcaaaactatagggacccaaaacacatcagtggtggcagaggctgccagtaggacgaggggtcgactcaagggagcacagaggaatttgggagtgatcagctgttgcacaccttgacggtgctgctaggcacatgggcgtatgaattcaccaaagttcatagagaatgaaaaagggtgactctcactgcatgtgaattgtaccttaataaacctgatgttcaagaaaggtgaatccaattattttattcctctgctcaaaaccctccactgccttccctaaccctcctgcccacccctccatccaccctgccccgaggcctccctggcccttcgggtgacacagcagggccagtgtactcgggggctccttttaccttcagggcacacaggcctcctcgggagactgatggccgtcctgtccacagccgcagccctgctgatattccccttccccgctctgctctccttgccttggcactttgcactctccggtacactttttttttttttttacttattactgctttattggtagactaaagcgttgtcaactccagaagggaagtttttgagagttttttggtaaatattgttgaatgaatagatgaatgcctggagtgctgccatcttcctcctaaatcctcattgcccgtcccatgcacacacgaacgtgcagtgcacatgcatgcacacacgtcggacacacacgtgtgcacatgaggtggttgccctgctcacctgcctcctcctctgggcagactcgcagcagggagggctgtgagcagcttctgcatcagcgtttgttcccactgcaccctccttccagcaccgtctgtaccccatctccgcctacaccattcatctccccacctgcaccagctctgccccattggcggctgcagggctgctcctaacatctctgtcttttccccttccccaccatcatcctggtgcagctgggacaaagcagcatcagtgtgacgcggagttgaggaaggagatttccgttgtgtgggccaatctgccccagaagactttggacttgctggtaccaccccataagcgtaagtgtgagggtgagaaatgcccccagcccccacctttactgtcccacccagagtggctggagggctgtggaggtgagggtgagggatgaagggcaggccaccttggagaggtgggctcacctcctcatgaatctgccctcagctccaaccaagagagccctgggtggcagaggagctgcagagatgagcgtgggtttgttgtgttgagctcctggtgtgtggaatttattttttttaaatccagaggaaaggcaagaggggatcccacagggatgtgagggagtgcggtgagatgcccaactccatcttgtgagagacgtgagggagcgcggggaggtgcccaactccatcttgtgagagacgtgagggagcgtggggaggtgcccaacttcatcttgcgggagacgtgagggagcacagggaagtgcccaactccatcttggagaggtgagggagcatggggaggtgcccaactgcatctcgtgggagacgtgagggagcgcagagaggtgcccaactccttcttgtgagagacgtgagggagcacggggaggtgcccaactccatcttggagacgtgagggagcacggggaggtgcccaactccatcttgtgggagacgtgagggagcacggggaggtgcccaactccatcttatgggaacgtgagggagcgcggggacgtgcacacctccttcttttgagaggcatgagggagttcggggaggtgcccaactccactgggaggtgcccaactccatcttatgggatacatgagggagcacaatgaggtgcccaactccatcttgtgggagacgtgagggagcacgaggaggtgcccaactccaacttgtgagagacgtgagggagcacggggaggtgcccaactccatcttatgggatacgtgagggaacacaatgaggtgcccaactccatcttgtgggagacgtgagggagcgcgaggaggtgcccaactccatcttgtgggagacgtgagggagcgcaggaaggtgcccaactcctccttgtgggagacgtgagggagcgcaggaaggtgcccaactgcatcttgcgggagacgtgagggagtgccgggaggtgcccaactccatcttgtgggagacgtgagggagcgcaggaaggtgcccaactcctccttgtgggagacgtgagggagcgcaggaaggtgcccaactgcatcttgcgggagacgtgagggagtgccgggaggtgcccaactcctccttgtgggagacgtgagggagcgcaggaaggtgcccaactccatcttgtgggagacgtgagggagcgccgggaggtgcccaactccatcttgtgggagacgtgagggagtgccgggaggtgcccaactccaccttgtgggagacgtgagggagcgcaggaaggtgcccaactccatcttgtgggagacgtgagggagcgccgggaggtgcccaactcctccttgtgggagacgtgagggagcgcaggaaggtgcccaactcctccttgtgggagacgtgagggagcgcaggaaggtgcccaactccatcttgctttctggggaggagacacaggaagggccctgcattaagcaggtggggatggcctcagcccggtcttgagaggcctcaggaggagtcagggcagtcaggagggccaggtcagcatctggaggagccctaggtaggccaaactcctggtggccgagccccatgttctgcctgagagccctctgtcccagtgcatttccaggagtctttgtggggggcgagggaggggcggctgtttcctcaccttacttccataccttgtttccgtggatcctctgcccccttctccgaatctcaactcctgtgttcttttccagctgatgagatgacagtggggaaggtttatgcagctctgatgatattcgacttctacaagcagaacaaaaccaccagagaccagatgcagcaggctcctggaggcctctcccaggtagctggcggccctcagttttccaggaaaactgtgatgcctccgaggctctggcatccttcggggggttgacgacgggggagatgcacaccattcttggaaaaagtatctcagaaggaagatgaaagattcttgcagctacctctctggcccccagagtcagaaactacacacagcctttatgctttccatgagctggcggtactgggcagctcctgacatagaaagtcagcactcagggccagaagttgagggctgggctgggcagtgtcatggttgttatggggtggaagagaagaagatgtgaagaccatttgaggaggattgtttggagaggtgaaaggagaactgttttcccttcacacagagagcaaagaaattcagataggtacaggatcattgtctgttctgctcttgcctttgactgagatgatttggggacccatcttcccgatgtcgtccttcccacacagccgtgtcttcggtgaccatatgtagtctgtctgctggaaaattgtctagatgtccagggcttctggggacattgacctagtcctcagatggagaatatgtggtgctcaggccacaccttccattctcacacctggggtagacatcactaatccatgcagcagtcttccccagccctgaaatctcggaattttgctcagcccaaccctaaccctaactcctaccagccaattcaaggtgatgattagatggaatattgttgccacctgtaatctggtccaatcccctagttgtgtagacagggaaactgaggttttgagaggtgacatggctttcctgaagtcactgacaggcaaggttttgaggagatgctgtaagggtcccctggcttgcttcactgttttggtcacatgctcatatttagggacatatcagggaaagtaagcggccccttgctaaggggaaagagcccttaggctgggcttgaacatgacctggcttttgccccatgccacatggtcagagcaggtcacagaggccacattgcaggcccattggagctctttcccttccctttgcctcctttgcagatgggtcctgtgtccctgttccaccctctgaaggccaccctggagcagacacagccggctgtgctccgaggagcccgggttttccttcgacagaagagttccacctccctcagcaatggcggggccatgtgagtatccagatgcaggacatagctggacaggaggaggtccaaagacagtaaagggggaagcagacatcccatttcctcaacctccctggccctcacttccactggcctctgggttcaccagcttggaggcacctgaggggcgtgtctgccatccgaccctgcacttgggcccttagcaaccctccaaggacagagagcccctaggccacatctcagttctcaggggctggctttgctacagatgcttgttgtacttgctgcctgagagcagtcaagggctcttcctttgctgggtttctgtggcagactttaaaatcgtttcctgtgacattagacaggtgcttcatcgaacccgccttcctaacagcacttagaccaccacgtcccattcccaacacacgcacctgcttccctttcagacaagaggcccctgcccctgctcctcatcggccctccgtgccagcagacgctgagattccacctccatctcccacccctttctgtcaatggccttctactgctctgatctttctaaccccgtaaggcacttttcctctcagatctccactttggtactgatttctgaagctgttatattttgtaaagaaattggtaaggttcttttgtatcacttaactcttgccacaatatttccgggtaacaaatcacccagaagcaggtgacttacaagaaccatcactttttcccactgtggcccagaaaagtgtgctcccaaatctcaggacccagatcctgggggctgactcccgagccgctggcagccccccattcccacactgctttcagcatgctgttgaaaaccttccttgcatttaaagtcctgattctgactgtatgtgcaggtgggaggagatagtgaggtgtctggggtttatctaagccaggctttcagcaggaaattgagcttctgttatttctgtgatggtagtttctacctaaatcaattacaactccaagtcagagagcacccactcagactgggtctggtgagggtatttattgagccatttagtgagcgggttgagcacacctctggccttggacgtggtgttatttcagggttagcggtgcattaggagccagctccggttctcctaaccacccctcctctcagcaccagcctgccactgcggccgctctgtgcctggtgccagcaggggctgcagtgccccagacagcatggaaggagagctgcttgcaactctcagaagacaaaggatggggcttctcagaagccccagcaaccaccagtgtgtccttctgccatctctgcgtccactgctgtggtcagggtgtggtccatttagactatcaggctccagtctgagctcagagtgatcagtgccactcaacctgcatgactaagaacgtagtcttcagtgtttcactgaatgtgagaatgagcactcacccgaacacattccacgccagttgggagataagtgatgagaaataccagtgcggaagtatctccgggtggggctgttggggcaggcgtatggggagcatgtgtggggtggcctccgccagaaggctgcaccccagcagagagccgagggatggaagggctcattgtggcttggggggggggtcagagaagtaaggaggagccaccagcaagggacccctgagggaggaagcccctagaggaggaagcccaaagagtcccgggcgaggccccctaccccccgtcccagcccgtcccctccatgacagctttgccctcatctgtcccagcctgtcctctccatgacagcttctcttgctgtctgctggcataggcaggacttcttcagctactgtcctaatgcaggctgtacacatgcggccccactccttcccaggatagtcctgtgtggcaaggacaacccctgctcccacttcacagatcagcctcttgtccagaggagcgggtgacggacccaggcccccctcagacttgagcactgtgggctgtaagctggtgctctgcatcctctctgccactctgaatcccttcttgctctgaccctgttttggatccatgtcctttgatgaggctttgcctgggtccagcgtgcacaggccacgttggggctcttgtgcccaaaggagggctcaattcagtccagaacagggtggccaaaccccctgacctctgctgcatgtgttggagacgcctggcaggttgaagcaccaggctattggtaaggcacctgcagtctctgaccctacaggaatctgtttgtcttctctgccacagacaaaaccaagagagtggcatcaaagagtctgtctcctggggcactcaaaggacccaggatgcaccccatgaggccaggccacccctggagcgtggccactccacagagatccctgtggggcggtcaggagcactggtgagcactcccgggggctagtgagactgggttgggggatgtgtgaacagggatgggggatgtttgagactggggtgggggacgtgtgaacagggatgggggattttgagactggggtggggaacatgtgagacttgggtgggggacgtgtgagactggggtgggggatgtgtgagaccagggtgggggacgtgtgagactggggtgggggatgtgtgaacagggatggggggtgtgtgagactgggatgggggattttgagactggggtgggggacgtgtgagactggggtggggaacatgtgagactagggtgggggacatgtgagacttgggtgggggatgtgtgagaccagggtgggggacgtgtgagactggggtgggggatatgtgaacagggatggggggtgtgtgagactggggtgggggacgtgtgaacagcagtgggagttaggtgagactgagatggatttgggtgagaccccagtgcctcatggagtgagtccggggtgggatcagatgagtccgcggtgccttgtgtggtgggactaggtgagtgctgtatccacaggctgtggacgttcagatgcagagcataacccggaggggccctgatggggagccccagcctgggctggagagccagggtcgagcggcctccatgccccgccttgcggccgagactcaggtaggtggtctgggagggtccaggccctgggctgggcaagtggggggtggggaagtggggctgtggctctgggcctcctgcaggtgaggagagctggggtagagaggctggggtccatgtgtggagctctttgctgaggcaggagcaggcaccccgggcagtcctgtctgggcgccgacagaggtgcagcctggacgccttcagcccctgaggcttctccagagggtgggtcaggtccggtagaggacagctgtgcctgttctcagcctcctattaggggccatggggcataggggcccccactctggctcagccacgttctgttcctcctttccggggctctactccctgagacaacccccactctcatccagaaaatttcaccgacacctcagtcccctctcccgcccgtggttctgcggaggaccctccctgctcatgggcagtccctggactacttttctacccagctccttgctgggctcgcctctttctgggacatgcacactggattcaggaagaggaagctctggccccatgtgtttcccgggggaggctccttccacaaggacactgggaggatcgcccctccgaggccaatctgggaacactgtgccccggcctccgaggcctcggaggagctgcagggcctcacctgcaacatgagcctgcttcagttggccaaaagtgaccggagcccccgtgccagccctgtccctcggccgacctgggctgtggagctgtggatctgaacctcgtccgtggctcgtctcccatcccactgctgtggccagcaaacccttttcctctcctcactgcctctcctccctcttagggttttctcctcttcccacctgtccttcctctcttgtctctttccccgcccagtggtaccctcctgggtgctgcctggtgggtgggtgcaggctgagcctccctgcagcctgtgctggggcctcctccttcacacacgtgatgcattggcggctgtgggtgagtttacctgggagggcctacccgtcccaggtgtcttcacgggtcctgattctggccgtggaagcagctcgggagccagtccaccccagacgcaccaggcagagtgatcccattgcagccagcagaggcgtctctggtttccactcagggttcttccaaccaagccagccacctctctcttcctggcacgacacatgggatggggcggggactcaggcactgtctgcccccagcctgccctcctgggctaccatttcaggcctgggtccttctgactgtgagaccaggatggggggcgtgtgggcctgctgtctggcctgctccaccacccacttccatgcctgcattcccgctgaccctggtgcctcccctaggcccactctcagtcctttgcccacagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcggtgcgtgcggaggggcccggggagtccttcggggagctatggcccgagtcagggggtccaagcggcccatgggggaccctcttcctttgtgggcctcgtgaccccataaccagccagagcagggtgggactgaggcccaggccctaaccctcaccctagcctcccctggcaccacctgaattctgtcctgctgggcccgggggtcaggggtccctgccttgggcctggccgtgctaacttcttctcttccctggccagcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacaggtaagaggaataggtggagaggtcagggcccagctgcctctcctcggcccagcacccctgtcccacaggctcctgcctctccccagggcctcgctgctgccctttgtcattcccagcaacccaagggccgggcgctcccctctgtgccctgtcccggagcccacgtctgcagcctaccccagctgtgttctcatcaagctcctgcctgggtcaccctgggacagtggttctgcgtcctatccactttcggacctgggcccccaaatacttacctctctctcggtcacttaactctccttccctgactgtggtcgttgggcttttgttctgtccttttccctggccccagcctgtcccttcccatcacctgctctccccaaccccattcctgggcctgaccctgaccatcgccctcccccgcacacaggtgcctgttgcctccctggtcaccgcagcccgttgtcccccattgcctccctctctcctcccatccccccaggcacctgtgtgtgatgtgctctgtctgttggttcggcttttttttttttttttttacctctgatttgttctggtccattttcatgtagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 2436 - DNA, 246837 bp, Homo sapiens; identical to SEQ ID NO: 2435

SEQ ID NO: 2437 - DNA, 294008 bp, Homo sapiens
atccaattaaaatgatgaaaatctttaatttttatttagttatacttgtacggacacgtgtatatacaaatacagatcgtatgggtttgtttgtgtgtgggttttttttttttacattttcttttacgtttatataatgtcagcatttcaaaacagcactcgatgagtaagtgcaaaggaactgcaaagcagggcagtacaagcacaggaccacacggagctggacttcacacccagacgcacacacaatgagtggcttcaatggggtgtcaagagtaagcatggagagcggattttgactcatgggtaacctccgacatgccagcatctattaaactgtacagacaatgggagcaagcccattgtagggagatttgtctcacatcctagcagccctggggccaatgcatgggaaaaactcagtgatgccaaaccagagacagacctgcccattcacagctctgaggggaaataaaacgtgggaggaaggcaagagacacacaaaaaataaacatactaagtaaaaggggggtggtgtaggcaaacgggggtgttggtggaggcggttttcaaaagaaaagtcagtgaccacaactctgagagcaatgaatggaaaggaggagttgaaaactgtttttctaattatttgaaaataatacaaatggctgctgccgttgctaaggcaccggagaaaaacagagtccctgaaaatccacaggtactgtgtgactcttcctttcacaacgacacagagagggaaacagccccatttaagcttcctacactgattggtttgcaaccatttccatgagtgagctgcacatgatattgataaagactcttcctgggaaaaaataaaacagtccatgaaaacaatcacaaacagaaaaccaaaccaaaccaaagtacagaactgtttctaaattccctatccttttcaaaccaacatgctggtggagaagggagggtgggccacagggctccaacatcagaccttgaaaacaccgaggacaaaatatcgatcaaaaaagtcatgttgttccaggtcccaagatgatggagtcataagattgggtgggcaatgaccacacatgagtcctgtatggagcagtgtctcagccacttgtgactctttttttcagccatggtacacattggatgtttcaaagcctcaatgcatgttttgtatcctgaaagtctattgttctcacttacaaaagacataagaatcaaattaatactttattatcaaacactatgtacaacagaggttgctaataatacagaatttaaagaacgcagttttttttttttttttaatgttttacttttctttcctctgccacccaagaaagtacagtacaaaacaatagtctaaactaacacgaactgttacctggtctattaaaggatacacggtatccactaaacagacagatccttatttccctgcttgatgttgcaaagcccttggcaaccaggggcaaaggtcactggggtttgactaactggggctgagtggcagctatgactgtccttcagatttttgagttgtttttgaaattaaaagcttctaaaagttgcatcaacatcctcctaagcccccagaggattgtaacaccaccacaaaaggccaccaacactttttaaacaaagtgaaaactgtctgacaccaatcatcttgaaaactccatggcaagtgcattagctatgatttcatcacttacaggtagagaagcttactgtctactggtgtggacactcttgctattttctttatacttaatttgcagtggcagaatggtgaagtaaaggggtctaatttcactgtgaaaaaatgaaagacaatggcagagagggccatgagtaattatttcaccatttgttagagacaaatgctaggaaaaccacagaagtcaccatttctaaaatgcatttagcactgctaacatagttatgactaactggaatcatgacaggatcatttgatttccttgtggttatagaacatgctgtattattttggttctattgatccattttagaaggtatctttctccccctacccaaatcccactggaccaacaagcctgtaactattaattaaaaaaaaaaaagtatttctgcatatgactgagagtactgcatatataaatagctaaaggaaaaaggaattgaatgccgtgaacttttgttttggtgaaatggtggctgccttctgtgataagactctgccactccagaggagttccttatgtcagaggggaataggattgattgtatctgtgaggctggcaaccccacacacatggttccatgtgagaacagactcggcagtgacatccactccaaatggatcaggtaagcccagattacatttcaacatgtgtacaactctccagggcacaatacgtttacagctgcctttccttcacatacttttctaattcagaactactcacaattctaagcaaattcccattcacgaagtctgtccataatgcgaccttctctttttttaacatatacatcttaaaaaacaaatatataaaaaattcttattttgctggaatgctttcaatttttcacattttacatgatcatcacatttatttcttatattgaaaggcatggtttctgttgacatgtcgtgcaaagccaaaaaaaaaaaaaaaaaaagggctggattgcttttcaattggtctaacacttttccttgtctaggctttggattttaaagttcatgacagccccaccaccagtagaaaccccaaggcttgcatttcctggtaatcgactggaaacgtcccctgttggccatgctaagattccttcaacagggtcatcctgcatttattctccttctgccccacccccacaatgaaacaagatagcccccatatttctaaatgtatcaagggataccactttttctcacaagtttaaataggacaagcatatatactcactctcagcataaagtatatctaaataatgtattttctattctagtggatttttaaaaaaatattttgttaaagtctttgggactccatcttgtttatctcccacagataaacacatgttccccctacgctttaggctgtgtcagaaagggaaagaatataaaatcaacacttgaatttttttactccaaactttggaattttatttccaaatttccctttagccctcccaagtagtgctgactgactctcctggtgacaggggtttgtgtccgagcccctgcggtcaaggagtgtggagcaaaacgtgggtactagggtgggaggcggggaaaggccacagcacactggcgctccagcaaagccaaatcatgtctcctctggccactgcggtcctctccttggtacatgtcatcccccagaggagtatccaaagctattccactatgcactcatcaaccctggcttgtcagccttggggaaggtcactttattcataaaaatgcctctttgagtttcttaaaaaaaaaaaaaaaaaaaaaaaaaaaaaaaaaaaaagttgtagcaccatggtgatctgtattcaaagaaaaaatatctggtgtgcactgcccagtcaccaaaaaaattagaggcactcacacatacacacccccagcaaacctgtagttttctctgttttcacacctgctctgtattagcattccacacccaacctgcctcctagaaaaaaaaaaaaggcttcttttagagagcacaagttttgctgtcaagaatgctttaagacagtcatattaaaaaaaaaaaccagtgtctcaaccttttagaagcctgttcatttacatactcctataggaaatggtgtaatatcgtatctattcttaatacctcccctccggacctgacatggtgacatgatgccctgcgcgatcatcttacagttctgaatgagaaggcataaatattgcataggagagcaaaaccctcccagccctagccagcgctggctgcatctgccactattcttccttgtccatagcccgctgacacagtgcgctaacggaggtgagttcttagaggagaatgcacaggagctgacgaaccactggtgtcactatgacaatttggcattttcatctggagtccatttaatttgggaggggtgagagaagccaagggccagggctgggggtggggcggggtggggtgagggaggcaggaacaagtttaggcccccaacctgaagttgttgcttagaattcaggctgaaagaaagaaaacaaaaatctgacatctgccaaaacccaataacaagtcccttcttaggatgagcagttaggtggatctctggtgttccaagaccctgatgttttctgtgacaagtgatgggaggagactgtgctataatgtcaaaagcatcgccaggaggaacagtaggattgccaaaaggcggctgggtatccttggtgtttgtgccgcgttctcgccgcgggatggctcggctgactcatgtacggtgtcatctgttcaaatagaaagcacacattccaatgagatttcacatccttaataactctcttgcagcagcctgctgttaacagacctcgccaccctctgcaaagtagggtaatgaaccttgtgccaccattgactttcatgtctgcataatcactcattatttacagcaaacaaagaagaggcaaagaaaattggactttctcagcaatattaatactttccttaaaaattgaggggaaaaattatgcatacaccgtaacctttggcctgtgagctgctttggttagccagcagtcagacacgccttgcacaaatttcagatatctgaatgtacctttgaaacctaagatgtcacaggcaagcaagtgacatgttggtgggggtgggggaaggggcagttatgttggcacagtagtggttaaccagaatgcgctgcccatttcccttcttttagctgtttcataggattagtgttgaatgcctggttgttggatgcctagacgaattttcaaacatgaaaaactaaatgccaaaacagcagcattttggataaactatacatcatgcctagtaaacttcaataaacgtatgcccactagtttgcctgcaattaggtgtcaattatggtgctatttctattacaaaccctgtatttctaagattaaattacttgaacttgactatttttatttttatcgggctgaagcttggcacataaattatcagcgtggatgcaaattttcctctaaataaaatagattaagtgagttaagcttcttttatttagctataaagtgttctatgaggctgcctctgactttggatagccttcctgatctgcatgattaacaggcttaacttccaaatgggaactctgaagcaattagtaccaaagagaggttggaggcttgcctaggagccaagctctgctccagggctgcctgtcttcttctttccacctgacctaacttatgcttttatttacttttaattaagttaaattaattaatatttttttagaggtaaggtcttgctctgttgctcaggctggagtacagtggcccaatcatagctcactatagtcttgacctcctgggctcaagcaatcctcctgcctcaacctcccgagtagctgggactccaggtgtgaaccacgatgcctggctaattttaagaatttttagagagacagggttttcctttgcttcccaggctagtctcaaactcagcctcaaccaacttcctcccttggcctcccaaaggattgggattatagacatgagccactatacctggccacttgtgcttttagactaaggatctctgaataacacattttgggggccaatagtgagcccctgtgcaaattttatctcagcatcagggtaacttcctgcaggtgttcagcagttgccatctgggaattgctcaagggccagacagaatggtaacaaggctctagtggttgttctcaattatactgacctcaaaggataatccctaaatacccctggatgacccacctcaaaccccttaatgggttaactaaccattattttaaactcatttgtattttcctaccacacgtgtcacaataagggtgcttttccttcactgggtagaatcacactcgctaatatttgtcctaaagtaaccacttttcaggttcacaggctgacccctgcttcagatatgctcgtttgggatggttttgtccatcacatccattcccaatgagaaaggtcttctcagtgttgagtctcctgacctggagtgctcttaccattttagcctcccctcgaataaaagctactgcatccccttgtcaaatgtgctcccctttcctggaccttagcgaatctgcatggagtgattttagcttaggagactagaaaaggttaggaagcaagatggtaagataaatggatgcagaaaaaatatatataaagtcctccacaatgtggccaagtaccttcagaccctcttctattctctgctctttttcagccttgcaagtgtattaattaaatctgtagttaataggaagtagaagtaaaggcccttaatagccctgaaattaaaatccaaatcactttcttaagagcaccaatatgttgtcaatcaaaacaatggagcacttcaggcttaactgtgaaataaccacaaaccctgaggattccagagttcatttcacaatatcacatacttaaacacctgaaattgcatcagctattggattcctctccatcttatttttactagcatattacccaatccttctccttgtatagcttgcaagtgtactgttaaaggtacccagctagcacttagatcttcggtgtgaaccccttcatcaccaccctagtcccttctaggtactcagtgagggctatccattattccaggtccactcagcacaagacacaaggaatagatcttacaaggtaatggagaggaaggcttttgtttttcatctaagtgaagtatgaggctaagtgtgactttcagtcctttaaccatacacaatctttggaattaaccttttataagcacccaacgaatatatatcttcctgccccccaaaaggaaatcagtcccattagggcatcaggatccttctcttcttcctgcaacatgctgttcctcattcaggattccacaaagcatcctttgattaaaacaggttctcaatgttggaagattctacagcccccaaatgtgaaatgagaaactggctgtcatttgggtaaatctgagcaatttcagaattctaaggaggaattcataggtaaaatctatcccaatggaaactacacctaaacatgagagaatttctaacgcttgtaacacaggcttggaagaagaaagaaaacgttcctcttcagaagtcaaatcaagttttgcctcctggctacaggattccacaacatgggggtttcaatggttaacggagagaacactagcgatattttggagcatgttatgtggcatatgtctgccctgagatcatcctgcatccctgatgataggaaactggcaggcagagtgtgcaagcaaacaaaaaagacaaatacattccaaagacaggtgaattagtacacatcgctgagatcatgcagtggaatcctttcagacttgctgggttcataaagactgggtctacacccagagctggggaaaggtaaataccctttcactcagtggctcgacacagtggtgaagaactgcaaatccaactagactttctctctcttcttagagacagaatcttgctctgtcacccaggatggagcacagtggcgtgatcatagctcactgtagcctcgaactcctgggcttaagcaatcctcccacttcagtctcccaagtaactgagactaaaggcacacacaccacatttttttttttttttttttttttttggtaaagacaaggtttcacagtgttgtccaggttggtctcaaactcttagcctcaagcaatccacccatctcagcctctcaaattgctgggattataggtgtgaggcacagtgcctcacacctgtaagaaacacatttcttattgttttcttattgccaggaattgtggttcaaccttgtctcactttgttagtgaagatactcaccagcaagcccttaaaatatagctctgactgactcaaggagcttttcctgcatgtacacctacgctctactccccagcacacgtatgcacacactgaactacattctgccaaacttttgcaaacttccagcagttatatgtccatcaattttgggccattgtgcattttaaatgcttagtgaaaaaaaaccttgtttccccaaagacagtggtatatgttcatgtatgaaagcatctcaatatcttgcattgtatcgttagtggaattcaaaggtaattttcctaatggcagaatagtcctccatgtgcctcttcattaccagagaaaaatatgcaatctgttaggtgtctaagcagcctcctatgctatagacaggcagtggagattccctggaaaaaaaaccatgggaaagatatgcctacattctgcacaatgtgtatcaagagatcataatcctgggtaatttttgtttagaacatgctggtcattcttctcgtggcttcttaacaaagacaagagacttaagtcctctttatgaacatacctctaataatggtaagagaccactactttgatactaatgttggaataggagtcagaagatctgagtattaaacctggatctacctaatcagcaatgtggcatgggtgagtctcctcagccatagaaggaagagtgtagagtctggggttgttaagggagatactgagtaacttgcagatcctctggtggcccaagtccctgagcttgtgaggactctggtaccttaagaagccaaagtcatggctccagatttccaggacacaattaaaatgccttcatgtcagcattcattccttaaaactttctaaagcagctaactgatccctggggagccactaagacctcggagagctcattgtacacacctctcatttgcgctctgggtgagatgcctgccttagaaaacaagaatgcttcagggaaaaaactctaactcttcctgtcagttttaacaggaaagctattgtatgtcctgaggcacagcatttactcagggtaagtttccctaaggttcattgactatgcagtcctggttacaatattggaggaaaaagtggaccttaatgtccgttagtttctaggaccataaggaagagaaattctacaaaaaaaaaaaaaaaaaaaaaaattctccatttacataagggggctcaaatctctccatgaagaggaaataattttatttcccttaagctttgagatgatcaagggagatgggtaaggaaaccagtgaagatctggagcaggtcggggagaagaggacaccacagaggaaggaaacacacagggcctccaggcacacccctccataagcagttggtagagggcgaccactcctctcagttaatctagttttattaaatggccagactgaattgataaccgaatggatatttacaggttcttattatccatagtatgcgacagactaatgcctcaacgagtgctttggtaggttttatttttctttagttatgggaaacattaggagtgtggaagtcaatcgtagaaaagttttatttatccttaaaacttattttgcctcggtaatcaaggatcacatttggctcaacaggctactggtacatttgtggcacaagagatgtgcgaatttgtggtggcaatgtgattatacttctccagaccaattactattgacaatagcaaaaatatttaaataaaataaagttccttaggtcagttcaatgatgcatgtaaatttctagagaaaactaagtatgttgaattagtttctattttgtgcaatagtcttattacttttatctacagatttggacataaaaaataaaattttatgaacatatacatagaaatgttttgtgtcttacatgaaaacagatcctttaatattcacagtgattcaccagcatgctctgaggatatggtaaaaggcagtgagattttagcattccgatggggcttctatattaggatactgcattagctcaaacccattccaaaaaagaaaattttattttacctaacatgcattgcacaaagatactggaggaatgaggtagaatataagtcatattagcatcgctagcaatgagcaaaagcagaacaacaactataacatgcaaacatgcagagaagaagaaaggaaaaaaatacggaagcaccagagaaatagatgcatttgttaaaagagattctctaagcatactaacctgctggttctaatgaattttctactttgtcgttaacatcgaaaacacgatcatgaacacctatagttttcatacagctatctataacaaaaatagagataacagccaaatatgttagtgaagacacccttaaactcccatttctttcttttttctttctctcctttttttctttttttatgtagattgtcttacaatcaatggcatgttccaaatgccaatattgttcccatttgctctgcatgtacaacagtctaagaaacaacaagttagcaactgctgtgtacttaagtaaaagcatcatgaagaatgagaaaaaatatgatgaaaactaaaatatgaatgttgatatacaaaacagataccacacaagatttaacagtaaaaaaaagttttaccgccgtgaaccagaccacacaataaagcatgcgcggtgaagccaccctctgaagctcattctagtgaacttacttgttggtctcacaaagactttgagctttagacaggaccttcttccattatctgggattgcagaggctgtgggtaacacagagagagagcaggaaagaaagaagagaacaacaacatattactcttcattttcacatacaaatgatgaacaataaattctttcctgacttgaacaacaggaactttctctaattcctcctccaaattaaaacaaacagtacttttcaggtctcactgctatagaaaggctactttcatatcctgagtttctcttttcaatacaataaaagaatcatgcaagaatgtgagtaatctgtgaagaaatactttggatttttatttcaaagtctcttccatttaacttgatctgttatcaattttctctaaatcgagaggataatgtgtgagccctccagctttcacagagccgctcctcctctgctgcaggaaaaggggcccaacagaggcccaaggtgaaagtgccggcaaaaaccaataacagagagttacaaggcagacttaaacgtgacctatttctgctggggaaagcagagctttgtctgtactgaaagcttgtctgtcagtgcttttgcaggtaattcaattagaggttttactcagaacttggctctgcattctatatgactaacccaagcccggtaacttccatcatgctattataagtacaatatgctattgagaaagtactatgttgcaacggtacatgtattttttttttcaatttgccacagagaaggatggaattaataaagtgggcttaccaaaacatgacagcatgtttcaagttataaatcacttgaggaagaaactttcttctccttttcaagataataagactgtaaactttccctatggttgaaagattatctcccctgtgtacacacagcaaaatgtcaaaggaatttccaagggcagtaaggcccttaacaaccacatgtatttactaatgcatcctagaaatgacaaaaattacagaaacgagcgtcgcatactttcctccctatgtgtttgcttcaagtggtttctttgttcagaaaaagcagatgacatcaatcaaatcacacatggcttacaattagtttggcaatacccaaagtgacaaagagggatcggcatttggtgtgtcttctctctcctttatttttatttttaaattattcctcatggggagctgagaacacaaaaatgcttcttttgcaggtgagaggattcaatatacaaacttccaaacaaattttacacagtctccttatgtaattctagatccaagtaaccctcctggaggagaacttctaaattcaccaactaaataatgtcaagtagtatagggtccccagtgtccctattcaacacctgttgaaaactactttaattttaaaacaaaagtgtagagaaaaagtgtttttggtcctccctatctcccctggttgctctgacaagcagttaagaagtgctaacagctggctttgctgtaggctttcattaaatcatagccagaaaaactccctctactgacatttacagtaactagtgtgttatttagggcacaatatttgcactctgcggtttgatccaggaaatggtgtccttcctgtggacctcaactgcaaatgtgcatgtcacaaatacagtacacataggtgactccaattcattaggaaaaccacgggttcctgagggagtatatgtcttattcatgagagttagtgtgaaaaaagtgacacatggatgttcacactgctgttcaatgaatttctgagctgagatgaactcacttcaagccttgtgaacttgatttgctacatgcacataactgactttacagatgatactgctagataaacaggctgaagacagaatcaaatgcttaattggtttagcgaggagcttcttggatttagtacaggtctttcagatttttctttaggagaaataaatccaggacatgaaaattattgtagggcacatggcaataactaaacagcaaacgatacgcctccaggaaaaaactggagagttctctccatgagctctcaaggagggacacagtcttagctactggatgtgctccatacttctgtgaattaaaaatatgaaatacatttgtatttaaatgacacataaaataaaaacctctcttccctaacaacctgccccactacttcctcattttctgtcaccaggaaatgtgactgatgccttgtgatactgtgactattatactctaatccttagaaaaatttgtgaacaaagaatattagcacacaatgtgatatgtgagtacacaacacagattgcatgccatggattcactcgatcatcactgcatcactggcctgagctcaaggagtaaactcctaacccttacagccaacctgagaagtgtgccttactaggtcagtataacttgggtttcttatttaacaccttgaaaaacaaacaaacaaaaaaatccaaaaagatgaaaacgttttccatgtagtagcaaaactccattttttaaatgtaacgtttaataaagttaaagtgtggctttcctctatgttatgctcaaggttctgtcaccccacacttcttggctgacaaatgtaggatgcctttataccaactaaaaaatacagataattaattattagtactatttgaagacataaggtaatataaaagtgcattactaatcacaagtaaacaaaaggcagaggactgagcactaaaaacaaaacataacagaggaattgaaacatgtaacattcccactaataaacttataaagaaaatctcaggatcaatttatgagcaatagatagagctgaggatggaaatgagggagtaaaatcttaaaacatgcctcgtttttgtcaggaggtaggtagtattaatccttatggctctagagatacatcactttgtcatggccaactttatcttagttaaaagtaaatatgtaagtattttatacataaattatatacataaatatatataaatttatatacataaattatattcactatatataacttcttgtgctgctttccttagaaaatgaatagtcgatgttgaaagttgataacgaataattataaaaatccattacatattactgcagcttcatctatcatttcaaatgcttttaaaatgcctactatgggttgggtgcagtggctcatgcctgcaatcccaacactgtgggaggccaagccggatggatcacttaaggccaggagttcgagaccagcctggccaacttggcaaaaccctgtctctacgaaaaatgcaaaaattagctgggcatggtggcacacacttgtaatcccagctactcgggaggctaatgcatgagaattgcttgagcccaggaggcagaggttgcagtgagccgagactgagctactgtactccagcttagcaacagagctagactctgtatcaaaaataaataaataaaataaaatgcctactatgcatcagcttctttattaggtgctgtgcatgcgaagatatataagatttcaaactgtccctgcccttgtgttgtggttcttcaagctgggacataaatatgaaccacagtttagcgtacctggagggatccatgtgacaactgaggtttacatgaagagccagcacagctctgggcagggagcaagagtgtgtcccagacatgtttatcagaggcttcacaggtcctccagaagctaaccagcagcaactgggacagaagacattttatccctaaatttccaaaccagagctttggcaaccaaaaagaggcagtgacttgcaaacaggtgaaaaaaaaatctagatctgaaatcttcctctaaagacacatggattttctaatagaatttttcaactaaaatgagaaatgtcttaaaacagttgtcacatcatccaaattcacacccatttactcagtttactgcttaaagtgtaagttggagtcaggaagttgggagtagggatatggggacaattaaaacaagcacaatgtcccattccattatcttaatagcaactttataaatcaatccatagagtcccttcccctgaatgagctgcaacgtaccaatcaaaaccttttaacacataatgaaatacaagctggagactctctggttctctgtgtttcgagtactctgctaataaggccatgagggccccttacttttactctgttccatgacctcagacaggggctctaacttgagccttcccaaaaatcttggtctcctggggctcaggtgagcatgactcagcacttagccaacttggtatagaaaatgacgatattcagtgcccccaaatcagtacttctaaaagttatatttagcaatgcaaatatatgtaacattcataccacaattcaccatagatctatcattcagacatagtagagaacacatcccttcgggtactgccatcatgcttgtggcgggcagcttctgacatgggtcccaggtatccccacattcctgtaggcagtcctttgtataatcccctccccttgagaggcgactgaacctattaacttgcttctaaagagtagaacatggcaaaagtgatgggatgtcattctgattgttacaaaagactgtaccttacttctagtgaacactctctcttttgctcatgaagcaaggtaccatattgtgagatttccaatggagaggaccatgtagcaagaaactaacagagacttccagccaagaggtacaaggaactgatgtcatagttcaacaacccacaaagaactgaattggctaacaatcgggtgagtgagctgcaaagtgaatccttctcactgagccttgagatgaccgttgccttgggagagactcaaaggatccagctaagctgcacctggattcctggtccacggaaactgtgaaataataaacgttgttttagccacaaaatttgggggtaatttcttaagagctgatacaatgctgtacactaacaaatctgtgtagttaaaggcttaaagctgacttcggactgaaggactaagacactctggcatgttctgctaatggccagcatgcccttgctcccacagagctgtgcactcctgattctgctgccatgcctcaacaactggatcccttactagtttacatttcaagctactgttacaagtccacttaaaatatgccttgaagagaggtaattataagctgctgttgaagaaatacaacaagacatatcaatttaaatgttctcactccagtattaaaaagtgtttttcattttccttcgcatacaacttagtttgcttttgctaatgcagccaacctgtgctgttctttgcaattagcatgatgtctcattttaactacaaattgctgggtaaaccaaaatgagttgatacaaaatgtgaacataaatcttaaggagaatgcctttcttcaaataggagaaatagaatggaaaggtggtctttaaaaatacctgaaatgaaaggattttaaaataagttaaaacttttcttactaccaaaaaactcctattagttatcttctacacaggccatcaagttaaatacaaagattatgagacttcaaacaactcaaaagttccctaatcatcaaggtaacaaccattcttcttcatgaagaaccaaagttttagcagaaaaggaaggaaatattgttttctttcacattttcaggcccaacactgtactcattagtcaaacttaacatctctgcctaaccttattcagcttcaaatcttaattctgaaagccaaaatcctccttttctgtgtcccatgtcaatctgggtactttgggaagttttatttttaagaatattcagccgctttcttctttttaaagaaatgagtgtgtgggggagcgttaaaaatgcagttttccattatgtttgccacaggcaatatttctcaattcgtgcaagtcaaaagaaaagataggctattagctgttagcacggcccagtttttttccctgtaggtttttcatgcagttcaacatacaacacaaatatatgcaaattaggcaggtgaaggtggaattaagcattaatattcctttcacaataaatgctgaaagagtaaagcccatttaaatccatggtactactggaaatatctcctagaatttgatgaatcaataaaatccagtttgtgtacatgagtggagtggggaaacagaagaagtggtgggaacagaatagagattaatcaaagccatatggacttggaaaatggttaccagatccacagaaaacttgttaaaacaaaagttaggcctcttcttagggaagaatactaaagcaacaatttgcaactggctatgtgccccttttttaaaagcattttcatacaaagcattttcatataaagaacaaaatcatgtgttatgatgaaatacatctcactcattctaacttttgggatttaaaagtcatgtgctttaatgactcgctcatggccccggtttaccaagcttgcattcatggtgccaccccaggagctactaaatttgccaacacatttcttctcttgcagcccactgcgtctcaagacttaaatcatgggcaggttaaggtcagagcccaagacgtaaaatttggaaaggaggtcactaagtaaagatagaggccttggagaaataagaatatcatgtaaatattagaaactttgatatgactctggggatgtttcttttaaaaaccagaataagaaaagggatgtgtttcccaccacataacaagagggatagaaaaacatattctgcaagttaaaacttggttttaacaccagggaactgtaacaaggaaaaaataattagagtaaacttcaggacaagggaggtaaaataagttccagctgtgcagccacacacaaaagagaaatgggaagcaccacccatcctacccactgtttgccttccctcctatctctctgcccccttaaggcaaagttctcactgctaataactaacctgagtattatttaaattccagcaggtaagtctcagtagatcaattactttttcttagccacctcaagtaaatggctgaggacaagtttccactcatttctaggaatactccaatagcacactaacatgctttttgtatatatttatctgaagtatgagcaaacttttacttgcgtttaaaagctcagtgacaacaaactttgtttctgctgcttattgaagaaggggatgatttgtctcatatagtttgatatctatttaggtatgagccaaaaataacgtggattttggagaatgattttaaaatgtccccttataagaaggatttctagttcttttttttttttttttttccgcgagacagtgtctcattctgtcgcccaggctggagtgcagtggtgtaatctcagctcactgcaacttccacctaccaggttcaagcgattctcctgtctcagcctcctgagtagctgggattacaagtgcatgccaacatgcctggctaatttttgtacttttagtagaaacggggtttcaccatgttggccaggctggtctcgaacttctgacctcaagtgatccccctgcctcagcctgccaaagtgctgagattacaggtgtgagccaccatgcctggcccatttctagttctgcctaaggaaaatttaagacagctttaaataaatctcacattctgaatgtaaacttcacctctgtcagtcatgtgagtggggaaatctagtcctcacaggcacagaaagcaagataatatttagatatcattttaattgtctaagaaatttcttaacatgaagaaatatagttcagtttcttatatattttactatttttaaaaatcaatgaacatctttgaacagttaagaaaaagttttctattatcaactagtgttctaactattctctgagacctcgccttgcctaaggccacacaatatttaagtgactttctcaggctttaaggtcagccagttctttctttcttgtttgtggttattttggtgaacttactgtactagagaggtattatctgacaaaacaaaacaagacaaaaacagcaacaaaccagataggcagaattattcacttagaaaacctcttcttcagatggaagccccataataaccataataacaacaaaaacaaaaactccaacaaaaggcagaattcctagaatcccacaagaggaactatttatattatttcttctccacaggctccctttgcccctctgtgtgataccctatgagggtggctgttaaccgttaggcaaggaaagcaaagccacaaatcccattcctcattcgtaagatattaacagaaacaatgtcattatcagacagcactaatgtagcatgacagtaaattactaataaatcatcaagttaatacaattcaaagaagctcctagaaaaaagttaatatttctgtgagcctttcaaaacccctttcattattattctccttggtgagggctcttttaagaaacattacttagcggtttgagtgtatgcataatgattctctttctccctggttcattctttttgacttattttgtggttttgagccagctgcttaacgtgcctacgcctcagttttctcattagcttcatcttctctaaaacaaattttaagtatgacctgttttagaggggcagtacaattttataatgcacttagaaactcaggtgatccctacagatctagaatattgtttcactattctacagattgatagcatcagctctgcgcttactggggcctctgcatggggatatccctaagcagggggcacccagctgagggcttctgaggttgtgagttctgagtgcaaatatggaggaggaagggctcaggtgtggatagtggtgattaaaagttacttaggagtcataagaaaaacaagggtaattaagtgtgatcttctctagcataaattttaaaaactggattctaccatagtttgacttgttattttgtgtgtgttggagggtgggggtggtgatgaagatatttatgtgaggatgtgcactgaggctgagagaatttagagaattagggtgctggaagatcctgttccttttgaaaatatgttaagatctctgagctcttttttcaatccatgttaagagtgtgagcagtgagcatgctattaggctagagggaccgtaggacaaggatgtaaatcctgcagagaggaaactaggctgggtgttgagactgcttttgcaactgtatacccagacatgacagtgatgacactaaaggaaaccagcccagaggtggctatagatcccgcaccatgcccataccagtccatggatattgtgctgctatatataaatgttctcactccactctttaatttttttttttgtatactatttgggttagcctggtgcaatgcctatagtcccaactactagggaggctgaggtaggaggatcacctgagcccaggactgaggctgcagtgagctatgattgtgccagtgcactccagccctgtcggcagggtgagaccctgtctctaataagaaaacaaaacaggctgggcgtggtggctcatgcctgtaatcccaacactttgggaggccgaggcaggtggatcactaggtctggagttcaacaccagccttgccaagatggtgaaatcccacctctactaaaaatacaaaaattggtggggcgtggtggcaggcgcctgtaatcccagctactcaggaggctgaggcagagaattgtttgaacctgggaggcgaaggttgcagtgagcaaagatcacgccactgcactctagtctgggtgacagagtgagactccatctcaaaaaaaaaaagggtgggggtaattatctattttatttacacaaatcaatgatttctttggttgtatttcttaaccagtaagccatgttctccccaatgcctatcatttctggtgatattacaagtatctagatagaaatatccattcatttaggctggaggctctccaaatggaatcctagaggcctgaacaaattaacgttctctctgtagaagatgaaattttaccaaggagggagtcgttagataccaggattgtacattttgtttcacactcaaaatgctttccatgataaggcttttatgttgattgagtggagaaaaggacagccaatctcagggactaaattctagtttactctgattgtctctgagacggattatctgcagaaaagttaatggctgtgcattcccattcgtcataccacagaacagcagccagggtttccttttccataatctggtcccaaccttattctcctttgttttgtttgtttgttttttgagacacggtctctctctgtggcccaggctggaatgcaggggtgcaatcagggcttactgcagcctcaacttcccaggctccctctttatccctcctactcttttcccttctttggcatacattcatagcttgtaccaacaatattccctcctagaatctcctggaaagtccaccttttctcatgtgacctttcctttgcctctcaaaatccctacttcctctggccacttgaggtatgtctccatttctccaacacaataaccctcttccaggttcccacagagatctgtttctgtctccttactagcacttaacccattctgttttgttttagaactggttaatacatcttatctctgctactagagttgcaaattcccccaaaggcaggagccatgccaagttgttgtgttcttgggttctaggttctggggagtctattgctttgttcctaacaggtgtttaataaagatttgaagaattattgtagggatttaaaaaaaatctgtcgaggccaggcacagtggctcacatctgtaatcccagcattcgggaaggctgagacaggaggactgcttgagcccgagagtttgagaacagcctgggcaacgtggcaagaccctgtctctatataaaaaaaaattttttttttattggccaggtgtggtgatgtgtacctatgttcccagcaacttgggaggctgaggcaggagaatggcttgagcccaggaggtcaaagctgcagtgagccgtgtctgtaccactgcactccagcctgggtgacagaatgagacactgcctcaaaaaaaaaaaaaaaaaaaaaatcttctagctgcaacgtgatttgttgacctaatatgaaccaaaatttaggattaggacacaaaagtgaagagaggggtagtggtaaatgtcaaagaaattaagaaaacaaaaaaggtccttgtccgagaactagaagtctcccctgcccacactgctggctccttcttgtagaatgatcttgggaactgatgtaataatcaggcaaagccagggatatacaaaattcaagtaggtagcatttcaatatctgtaagagtgtggggtcccaagaagtaagaaataagtgaaaggaggccaggcgtggtggctcacgcctgtaatcccagcagtttaggaggccaaggcgggcagatcacctgagggtcagaagtttgagaccagcctggccaacatggcaaaaccccatctctactaaagaaggaaggaaggaaggaaggaaacggaaaggaaaggaaaggaaaggaaaggaaaggaaaggaaaggaaaggaaggagggaggaaggaaggaaggaaagaagagagagagaaggaaggaaggagagagagagagagaaaggaatgggaacgtgggcatctttagatccaaagatatgtagaatttaatcaaatgatagcttgggtacaggttgcaggcccctcccagtgaacagagaataaaagcaaagtgagattagaatccaagtgaccatgggcttctttaagtaatgataaaaggtggctctggacaatcatgatcacaggtaagggtgacattgtccttgctgaattcctctaatcatgaagatcagagaaacctctcagcaagttaaagcacctcagatgttacatgagaacataaccccccaaactgtgctgagggatacaactatctttcaaccacagcagagcttaaaagaggcattttttaaagaatcaaaaccatagaacgagtatttcttgtgtattaaaaaatgccacctgtgaatgtggtactttaatacttttaaactgtgggataactttggccaacttgagtaaccggtcagacaagcaattctaatttaaaatatataatggaaaaatcgacttagatttgtgactaagtgaaattttagcagtgatgaaacctataatttacgtgtacagttttggaacatttaagagaactaaaggttcatcatattttaaaatttaatttattatagtaagaattactgaaataagtttttacagtcagacaactaaaatatttttaaatgatagagaataactaaatctaagttcagcttaaaatgttttaaagtctatttaattcaccaaggttttaaatgaatccaaatatttacatttgctagccttatatatagaataaaacatataagctaatctgaataggctaaatttgaaatttttagaaagatttaaaaaaatgtataacttcaataagtcaaatatcaaattttaagcgtaaaatttaaataaacattttacagataaaacccacccttctgtgtatcaaaaactcatcctgacacttcctttcaggtcctggattacatgctgcctcctcagagaagcctcctatgaccacctaatcgaaagctatctccatgtttctctggcactgcatccagctccctactagtataactgacagttatagatttgtttgtttcctggtttattgtctacttcctgatgaagctgtaagctccagaagcaggaaccattctttaatatatcacagtgtttctaaaatctaacatagtgcttggcacaaaggaggtacccaagaaacactttggtaggagtgaataagcgaatgaacagaaaactgaattagccagaaatattcaaggttatatattacaaaaaataaccaaaggcagcaaggtgttccagaaacttgagatcttcacagattgatttgctatgtttttcactctctgtgaatattaccttttatatttcctcttgctaatgcacagagcaatctcatagctagctagatgaaaactttgcctactttattactgctgcaagcttattgagagatttgtttactatttgattttcccagaaaccttagtttagcaatcagacaatgcacagatggataacaaaagattgataaattacaattataactttaacatgtagtatagtaaataaatcaatgatgcatttttaggagcttctagcatatgaaaagcctgcagaatggaaaaaaggataaccatcctttaacattttgtttctatttcttaagaaatttctgcagctaacatataaaaacaagtattctatccattagccatgatagtaataccgatgtgctacttaagttttaaggaatcatttatatttctatgctgactccacatgtcacacaaataggaagatttattgtattacttggcattttgaggaaaaaatcaatctattttgccgctgcttagtggaagaaaactcttgggtcaacttatctttttaatctaagaggtctcaattgaaattggctttgaagtttgctaattacaaaactcaacaggggttttcccttatttggtgtaactcatatttctattcattaaccccagttttaaaaagattaaaaaagtctgaatagaaacaacttaaaagtttgaagaacagcctctcccctgtgatacctttacagatacttcaagtgcaaacttcccccatactatcaaattctatttaattacaaatcttctgtggttgcaggagggggaggtaaaacacatacattttgaactttccaaccacacagggctgtaggaagatgagaaatcagtaaattcttttcactctatatattggggaaatttatgtcaacctgagttacaaggaaatcaagattctgaagggcaatcctgctagctgcttttgcagggccaagccactgggttcagatgctttcattcgggtgaaaagatcattaccaggcggctccggggaagttggccctcctgtaagtgtgctcctttgttatgaatatggaacagatggagccaaatctatctgctctgtaggaacaaaaacacttacaacccagctctctctattaaagactctacttagctcctttataccatcggctttctgtgcactgctgtgaggttttgactttatagaaaaaggcacttcataaaagcaacagttcttactcttaaaccaaagtggcctaagaactaaagaagatgaatacatggtttcaccgacaggactccttggagatatgtagatattcaattaggggtgtatgtgtgtgtaggaggaggaggaagactgtattcaattctggtaaatgtctgcattaaaacaacatgaaaatatagaaaagagcgatgaagatgtcatgtttctcattacaaggatggcatctaattgctctagcataataaaatggcaagatttaattgtgtatatatgtctgtaaggctagcgagggctgtcttgaacaaaaaatatgactatgcacaacaaaatcatgcaggtaaatatgattagtaattaggaccataccacaaaacaaaggctatatgatgcttcttcactatgaaaaataatattaattactttcagcatcatcatgccaatttgcttttacagtctgaaagatgtaaacactgcaggtaaaaccaatgcatgcatttatttatcatgccacaagaaatctacagccatccctacaacgtgctgttgccaagatatatgtgctgacagcaaggtaagtttcacaggcttccgggtgtggatacactactgtatacgcaccttccattgatagcaacagggggaaaggagtgtctgccttatttcattacatttattatactgatacatttaaagtctggctgcctcttcggagataattgaaaaaagaaattctgtggcaggatgctttgattctgactaaatcaagtcttcgggcaaatttcctcctgccagtggaagcacagcttgcctgaagtcgtaacctttgtgggaggaaaggaactggccttgaagcagatcatgaagcaaatgttttatgccaaatcagagtctggggatacgtaggctactgcaaataaaactcttcttctgtctgttcaatcatttcaattccctgcagtgtgaaatatgaacttgccaacaaatggccagcgtgctgtgcctcgcagcagggggggaagtgccacagctgtgccagagactggaaaactcaagatgcgcatgacatgttcattagttcccctgtatagccagggcctgaaccacgccagtctccagaaccatccacagggaagcagaaggagtgtttactatacccaaaagagttagacacgatttccaccaaaatgagttgcacaacttgtgatccctttgatgacccgagaaggttagtctttaaaacaagaacacatctctggacaggaatagacagaaaatattatgtctgccaatgattacagtttttttctgactttattagcagcctgctctgtgagcaataaaaaatgaaataatgaataatactttcagtatccaagcatctatgagagattgaaagaatttagatgtctcttctctttatcagaaagacagatttgtggaaaatgcctggctcacccgttgcaggcaaacataacactagttcttcctagtgtagtagccttctactgcattctacattacagtttcacaataataaaatagttatttgtctaaattaaagtaacattagactaacaaatttcaatttgatgtcctttgccgcatattgaacatacatattcacacatagctttatatctgcaaccctagatataaatatcccatattcagttctattgtgagatttttcaaaggttattcacatgctttctagtgccacattctttcaaattttaatcatgagctccctaaatagaagtcatttgcatctgtaaacattcccttgcagtagtatttagcagtgtattctctttgtgcagagctattttaaaaggaaaataaaccttaatatggaacaacaatcaagcatgagcataaagaggtaaattagaggcttgagaaaccctgtaaaccctttatgtaatttctgaaaaatgtctgaagtttctcaatcttaaaatagcccagaatcatatagcttatttcagatggtggattatagggatactattcatataatccaacttatgacctaaatcataagaacatattcaagaaatgaaatgagtttgagataatttactattctgaaatgaggccaaataagtacacatggttcaagctcgaaatgatagaccattatcacaagtgatggcgagttctcattagtctggcatttctaaatcaatgttgtagtcaataaatctgttgcagaatggttacacatgatcgtttttaggaattaataacaagacatatatttttgttttaggattcttttcactccaattactctagaatattatttcttcataatgtttatttttctctatttaacttgaccaaatacaaattagaaacattaaattatttcttaattgacatggagcttggtggaagcaaacatcatctcaggatgtacaatactattaatatttttataacagctatcaattatctactatttccatgcaccaggaactgtgccaggtttattaagtttaatcctcagcacatttcttcgaggcaggtattattatcctcattttagagatgaggaaactgaggcttagggaggataagcagttaggcgatgtcatacatagctagtgtagggtggaacggatattcaattccaagtcttcctgatgccagaactatacaacctcagtttacagtataaatcatacttttcttcctgactaccctacttcaaatatttgtttcataatttcccagaagctcttaaaggcccttccagaaaagtctgggggaggttgaaacttggtagaacttgactgtgtaatcttaagcatgtgcaacagatttcaataaaaaagctgcatggtgattttgcccgcagagacatgccctatgcatattttctaatcaggtgcatgtcaagaaaaagccttttaatattatattactgtaactgtcgtactccttttttaaaattttagtttttcaagctacagtaggactttatgatgtgctcctaagtacccacatgcactatggcaggaggaaacaggaaacaaacacagtaacctaatgttccaagaagaaaactggaagaaccggcagcgatactcgccatgaaagaagacatttcccagcctggccttgccatctctgacctcacagcatgtcccttgagatttgggcagcccttgcctgctcccactcctgtgatgcctcagccctggccggaaagagaagcaaactagctgatgatgctgtgccacgagaaccaaaaggaacatacaaatcagaaacgtctgttatccaaacccaactgagaaggctctgtctcaggaagggacctccccatttacatacagacattccagggcctttctggatgtctctgaaaagtaacagatgcagcagattcactcatttttaccttaaagtcaataaggtacaccaaaggtgactttgtatctatttttttccttctgtaatgcaagtatttaatcaatgaatgtcctatttaatggcatgtgttaacatttttctataccatctgtttgccaaaaattacttactttaacagaccgaattcacagaatctcagttagcccaagaagcaaaaaggattctgctatacttggggcaaatgggcaacagtccagagtgatcctggtggaaactaagtcagatcatgttacttctgtgttctaaactctccaatggctccaatctgactcagagtgaaatcccagatccttaccatggtctatgatgaaccgccccccatactccatagcaccaattaatatttgtatacatattctatgtatttatatacatagaatgtatacaaatacatatatttgtatacatattctatgtatttatatacatagaatgtatacaaatacatatatttgtatacatattctatgtatttatatacatagaatgtataaaaatacctatatttgtatacatattctatgtatttatatacatagaatgtataaaaatacctatatttgtatacatattctatgtatttatatacatagaatgtatacaaatacctatatttgtatacatattctatgtatttatatacatagaatgtatacaaatacatgtatttgtatacatattctatgtatttatatacatagaatgtatacaaatacatatatttgtatataatgtatacaaatattaaattaatagaatgtatacaaatattaattgtggtttttgccattacttttaaatggcaaaaaactgcaattacatttgcaccaacttaatacacattctgcacatgtctacgttcctttccctttgttcaacctatttgagccatgcaggccttcttggtgcttctccaggcccacgatctctgcagcctctggatgtttttctgttctctccacctggaaaactctcttgccaaatagacacatggattgcttcctcattttctttaggtccctcctccaatgttaactattagaaaggcctttcctgactatttcatacatacacacacacaggtatacacatacaataagtatgttttatatatatatatcacaatttccccagcttcacattctctattcttcttactttacttttccatcatagtacttaccacctacttgacatattttatatttatttatttgcttatttaatcccctcccagcctcctgtccccagtagagtgtagcttctattaaagcagggccattgcctatttttttctctgttgtattcacaaagtctaaaatacctgttgaatgaagtaagaaaggaaggaatcagtgaatgaaagacaacatcacctcaagaaaaacacttgttttctcactgatctgctctaactgcccgcagaatcacaagtttaaattagaaaaaagtgaaataaaaagtctaatcactggcatatgattaggcatatgagtttcgtgcaatttaagtaggttcttaaatcagctatcaagatgaataagtagcttatttttcaacatatactaggtttttcttcacatttgtgcaaagcaaaattagtttaaacgtacctttgaaaaaacttatactaataacttggtagttattttcaaagcattcctgcaaagggtgaaggcagatgatggcaaactatcaaccaaacattgagtctaatgcaggccctaggttattcttggtgaccttttttgcagtaatgccgagtaggagcagcagcagccctgattagcccgaaaacgtctaaggagtgacatagacctggaagacattctcattaccaccatcatcaatgaccactttcgcatcctcagaccaagcggaaagctaaaatctcggaatcacaaaactcaagtttatgggggatcatttaatttattctcttcgttttacaaatttagaaactaagcttcagcatttcagagagatcaagtggctcaccaaagttcatcttacttgggagaagaatattgaacaagatgacctgggccagggacacttatcaaaagaaaagagaagtgttcactcaaactacctaggacagaactagaataaagaaattgtccccaaagctcctcttaaatactaagaacccaatttttaggaattaaatgtttaatgaatttacattatagctagttctgctaaaatttatgaaacagtttagttgaactttttatttgctgaacatattctttagagtgcacgcaaaatcaatgtgtataatacatttatgtcccctttagagaaaagagtataattttaccattttaaataactatgaaaggttatggctactgcatctttgcctctgacatagggttggtcatagttatgatttattttttctcaaatatatggtcagagacacagtctcaattaagatattactcctgaaggaaaacgggaggcattttacaactctctgctttatgattctatttccagaaagcacaggggtgaaaagtgggagctgtctgtgatactaatttgaaaaactaatgaagtaatggaactgttatttctcctaatggctaccaggccctattctctgcacagtgtaatactgtatctacacatgtatgacttaaggccacagctactaccacaatgtgccctcagcaaaacaacgcacacacacacacacacacccatcaccatcaccatcaccatcactgctgccaccacatcttactaaggaaaaggcttataaaatttttatctcaattctcaggggccaagaattttatctcaatctcaaagaaatgttctttacactccctcacagctatcttttcaaaattttcaactacttttgctccttacaaccaatttgatcctgaaaagtatatgtaaactgaatttttagaacagaccactttttaaaatgctctagggctattgaaaagaactccatttttgtaaatggaataatcactctgcaatttatcttttgtaaaatcctaattttcttatgtcatgcttgtttaaaatgatatagacctgttcagaattcctcaaggggataaaaccaacattaattatttctttctactccatttcagttgaaaactttctctagaataaaaaacagaattttactaatacttggtagcgtctgccttgtcattctctttatattggcacagatcccttcattctagaaagcaagacttctcctggtaaggccttggtgagctctgacccttatgcaaatgttgagtgagacagccctggcctcccacacagacagaccaaaccatcttttatcgattcctccttcccttccttgtgcccctgtgtctacaataagaaagaagatatgcagtccctgctctcagggccttacactttaaagagtaaaatacaaaatttgaaaatgtcattgttctgaagaaagaagcaaaaggtttgaaggttctgtatgggatggagtggtaacaccaactattgaaccaaggggcccagtccaaggtgataaactccacatcaagcttgaacacaaagacattaaaatcttccaaggggtcaggttcaattagagcccttggcaatctggatacacttgctaatctgaagggagtaccagatgcaagacagttcaaaaagcattgactaaatacttacaccaccctaggaaatgaactcataaagacaggagtatgcctcatctttcgtctttggatcaccagcgctagaagcacctacatttccacatccagagtagcttcagaagacatcaaaatttggggaaccttttggattcagcagtcagaacccaaccattaaaagcaccaagggcatccccaaacattaagcctgtgagagattggaagggtgtatgggatgcagcaggaacaatgctctcgtgtaactatgtaggtaggataatgccttctgtcccaaagagataccagacgagaaactactgagtattgctagggattgcaaaactggctagtcattccttgcaaaaataggattctcaatgttcagaaccaacttggaaggcatatgtattagtgagtgcctgtccttctatagcccccagcttagtcataattgaggtattacttaatattttcatcaaagaatgtaagatggacttacgaataggtttataaggaaaattatttgggtgcagtaactagttattgaagccaactagttaaattgttcattaaagtggaacaaagttcaataaagacagttaaggcatgctatgagtcagaagcacagagcctatcacatgaacagaaaagccacttactaggtacaagtatgtctcaggaaaaatgaagcctacagcagactgcaaatcgaatgtgagttatgctggtctactcatcaaatctaatcagaagttttgttctcacattttggatctgcattcaaaatgggactccagaaagatgacaaaagttatataaaagacttaaaaccggtcttgtaggaacagccagaggaatttaagtgacatgattcttttttttttttttttttttttttgagacgaagtctcactctgttgcccaggctggagtgcagcggcgcgatctcggttcatgcaagctccgcttcccgggttcacaccattctcctgcctcagcctcccaagtagctgggactacaggcacccgccaccacacccggctaatttctttttgtatttttagtagagacggggtttcaccatgttagccaggatggtctcgatctcctgatcttgtgatctgcctgcctcagcctcccaataagtgacatgagtctttgaaggaagagaacactagtctgtatatgttgctcatctgaaaagaagactagaggcaaggatgtgtttttaactatacagaaagtctggttgcactgaccagatagaaaggactagatgatgaatggtattaaaatggatttttatgaccaggagaactatatacttagtatactttaaatgtgaatgggattttgtaaataatctaacctaatccatggaagtcagttccctcaaaatgctccataaaaaaagggttcccaggtctaataaatttggtgagcactgtatattgcaccactcgctttgaagaattaacaatacacagtatcatatttaaggcatcagaaagtttttcaggaaaaaaaataactttaacaaaattaacttaaatttaaacagaaattataacatcttaataattttcttgttccttgtaactgtctttggatcctcaatctagcctaactccctctcttacatttgagaaaacagactcacttatatgactggccctagatctgattagagttgggcagtggcagaaatgagacttaacccagtctattgcatgtcttatattctgttgatgccaatgaaataaagctggaaattaagaaacaggatgttttccattctttgtcgtggagtcgttgatttttcatattatatccattaaaagaaagaaaagtaattaaatttgagataaatcttaactgaaaaatataaaccacattctttaatttgttgaccacagctaaacctgcaaaagcactagaaaaatataagagtactagataaagataaaataatactgtacaacacactagaaatataagtggtaaattgacctctgcccctgttgcacttaaaggattaactgcataaatcttctctttgttttgaactattccacatattctacagtactgttcatcagtgaaatacaccctggttttggccagtggttgtttctgcctattttgcatcactacctaacttccttaggctaaaaaacaaaccaacaaaaaaaatactctgaagaactcctctttccttatctcatgcagtcttggagctgtcggtcaaagtattctctattctttccaaagcacaggcatataagccaatcaaattccttctcccaggaacttgcgtcctgagtagggtgacacaaggaattgaaaaatgttagagctaagaaaatcgaatggctgagtcttgatgaaactatctacttgtttctatatttaagatccccaccactgtcttggttcctgtccatcctgaggtcttcagttaaaataaccaaactctggaaggaaaagtctctctttttgtttgttggtatttgacacagggtctcacttggttgcccaggctggagtgcagtggtgcaatcatggctcacaccaactataggcatggccatcacgcctggctatttttaaacttttttcacagatggggtcttacattgttgcccaggctgggctcgagcgactctcctgccttggcttcctaaagcactggaattacaaggtgtgagccaacatacttggctctttttgtttaagttagctgaagttgataaatgttgtttataaatggagaaccttaatgaatataatactcatctgtggtgtactttgcaaatggatggggtattatcaaatgttcataattattacagggatcatacatttggcaatgaattattccagagtgtagacacagaaatgaaaagtaatattaatttaagtgtgatgggttaaaaaaaatagctcttaaagtcatctacaaataaggcttgccaaaattttaaaaatatagattgggtgatactaactttgggcgacttattgattaacctgtttctgatggtagaaagaattattctatcttgtgtctccgtggtgtaattttattagtgaagtgacaaaccatgcttcccagtggtgccttgaactgacttggaatgtacggtaaaatacagatttcctcaaatgaattgccaaaaccattaatctttatctaaggacccataatagtttgttctcagtagcaggtgggggagagagagaaaatgtcttccagaaagcactttggcagtcaatctggttgataataaaacttgatgaaacatctgtgattaatattaattctgattctctctttaatggataattgtgaaaaagataatttatcccatttcatttagactacagctgagtttttcaatttagaaaaagaacatttctccacgtttctcaggtatgagactatagggaaaaaaaaccaggtgcacaaaacctgccaacagacaggcaattttctagttagcccttgaaaatattttgtacacgttcaactgaccactacagatttggatgtcacccccaaatggttctctaagtgagtagactgattatttcttcatcctcaccactgtagaacactctaaatgaaccacagtgaactgaattaatactttttgaactcaattaatatatttggccatatttgattctgcaaagatggtaagaaaaatgcccttgtgagtaaatgacagtgagctatttctgaccaccagtgtatttcaaactagttgatgatagaaactatttttgacacatgcaaatgtataattaaaagtacccataaaaatttgtcatggaagctaccattaattttgacagaaactaggaaagtaactaattgcctttcaaatatcaatattaagaaaaccacttattaaactagcacttcaactcatttacacatggaaaacttgaagcatgggttgaagtctcctgcccaactctccaaacctaatgaatggtgaagccaaaacccaggcctcctcattctcatctcatctatctttcaaaacttaataatacttttaaaaggaacctatgaaataatagacttattttctaagaatcagggcatattatatggttaaaaaaatgactgttgtctaacccaatacagaagtggtaaatagtgattaagtacagatcactgttgacctttaatcataaccaaatcattgctccatttaaattgactccattttcatcagactctaactgacatcagggagagcaaaacaaactgacaagcacaaaaggcacagacaatgggcactgacttcttcagtgttccttccaaaaacctcatgtcatataaatagaatattacaggaactattcattattcatttctttctctccaggtacacattttccttcgaaactgttggtccaaaatgaatatttcttatcacttgatatcttgcctgttttctatttttatgtggctttctgattcttatcctaacacagcttgccactttgaaaaagaaatttattttatgataaaaaattttgttcaattgtacaagaaatgcaaaaaccctaaagggttctatggtttttgtttgcatcagcaaggtcaaattatgtctaatttacaggtaaagcaatgagacaatttacttggtcaggcagaaggaaggatttattatgaccattgtgaattagatgactcccagaatcttagtctattttagtctttatcttagacttagtctctccctaaccagagctccctggattataccaacattcacatcacaaagactgccatttctcaagactgatggtactgttgacatgacccttccatttaatcaaatcctctagtacccacttctttcaagtcttgaattcagacccatccattcctactttaagccaatgttctcgaagtgtggtacaacttgcaggaaaaacagctggagggcttattaaaaatagattcctacattgcaacctcataaagttgaacgaatcaaactttatggaagtgggttccaagaatttgactttttacctatcatctccagacagatcacgaaatttgggatagcgtcttaagccctgagacttaaattccaccttgtccctcaaatcaatatgttactacatctttaactgatctcttcctcctgaaatagtcgtctctctctcttttatggaaagtgctaatcttataattcactttatttctctttttgctgttattttcatgaatatatttttcccacactggattgtgagctcctagaggacaaaaatcatattgaatactttctccacactgtcccctacattggccctctaggtaaacatagctcagtaagcactgatgaactgcttgactaatgagaaaataatatgtaatactgaagtgtgtccttctatagccactgtagattttctacaaatataatgatgcacaagtaccaacagcctcaagtagagtttaataaaggggttttatagcatttggaatacaaatatttcacaaaattgccacaataaatctaaaatatactttaataataaactaacacattgtagctaaaggtcagaaattctgttatttgattaaactaataatctagcaaatgttattgatttagcaattccacttaatataaatatcataaaaactcatgcaaaaatctctatacctattgcaaaggaactaaaggcaattaaaaaaaaagagaaactcaagtaaaggatattaatatctctgagattagaatcatttctgcataagtaccagtactatttatagaataagcttttgaacactgcttttcacacatggataagagctaagggcatgaactttgaagtcagaatgcctttgctcaaatctggactcaactgtacatgaacagtgtgattctaaacaaatgatttgacctgtttgcatttcagtttttctcatttgtaaaatcggaacaataacagtgcctaacacgtacctgtgataaagtatggatgagattatatatatatatatacatatggaatggataagtgcttactacatgctagctattaatatatacccagcaagcacctagtcataaaacaaatgatttcaatgtatttatatgataagcctcaaatcagtttactctttaagaatatactactactccctattgcctgttacatatattcaaaactcttcagaacagaattaatggtgcttcataatctgacccaatctatccagtttttattttccaaatactctccactccattcagaccttttcattgatccctgagtttatgctgttctgattccttatcaggagaggcgaggccagtaagagaagaaatccacgtgagcggtgtgaagcttgttttttggagggctgctgggtgggctccctgactccggtaatcaccctcatgaaccagtgccaagatcccctctgtgtaaaatctgggtgctgcacatggctgctacaattccttaacttcattcaaaaggatttcaaatgttataaattctcagtgtctttccccttatgggagccctactcatctttcttgtgcaaagatgtatagtaactgcaagtctgtaaaacactggtggattttaaataacaatagcaacagcaagtataactaattacaataagtgaaacaataatttgcagctgctgtgctgcttaaggctagataaggtaaggcaatccctggcatggagcatcatgttaacaagctgcaatgttgagacagttgttcactaggctttgcaatatatccaccaacgcctacactgtgctattgattctgttaatgaaatttaacctctgaaaaatgactcagggcactgaagagacatatactttcaatactcttgctaatcattaaatgccttcatcacaattgaaacaggaatggtgaatgacacatttcattatgtcatcatgtctgaccccacaaaccattcaatagtactctgctttgttctataaacccatttacttcctagtatgtaaatttcaggaataagttgacatgaaatttccctatacatttcccattagctgtcttgagaacagggtctacctaagttccaaggtgaaggtagaacttagataacgacttgccaatgatgcttgaaatctgtctacttttaacgtcttttaaaatatttattatgaaataattgaataaagactctaggcttggggtcaaactacatgggttcaaatcctgaccccagtactaactacatgatctcaggcaagtcacttaacctctctgagcctcagtttcctcatctatatgatagataatgatagtaccggcctcacagatgaggattcaacaatttaaaacagatacagtgctaggtacagtgcctgccacttagtacatgcaatatatgctaaatcactctaattacaaccatcagaacaagtgttaccggaggagttattagttaaagcatgagtaaacctttagcaaaaggctaaactaaacttcatttaaatcattgcagtattcatcatactgcttcaaaactgactgaactgaactgcccccactgtatatagtaagacctctaagcaatatactaaaagtaaaaaatttgcctgttcacatttttagcctccaatttactctccttgcttacttagatttgcccattaaaaattccacctaaaatgaagcaagtatgtctgaaatcaaggttgaggaccaacagaaactgttaaagcaaaacatgcagtaaaacttaatcaattcagattttagtcagaatttgtaacaatttactggaggagaaaatgaacttttaaaaatgtctgtgaaaaaaaaaatcagacaaagcaaatttacattagaagcctgatattggaggtactaaaaattgggcaagttaaaaacaatatacattcttcttaaaaatgattcagagcacatgttatttgtttttatgggtttacatgcaaaagggaatgttaaccaaaaactaaaacttagctaacattaatgtagataaagctagttggaaatattgtatatctctaaaaatagtaaaatgaaaagatattatcattccaattcccaacaataatagacctggctggctgttctccaattcatgatattttacttttgaggctcagaatgaattaatttttttgtgaagctttaaactttaaaaccaaacccatacatagcatacatattaaagttctgttcctaatgtggattttatacaatctgacttaaaatattcgatggaaaagaagcctgttgccaaagtccacatatttcccctattaaacagaggtaagccatatccccagaaaccatatttcaagcccaaaggatactcatgaactaaaataatgaatgataatgcctcgttctctgcattaataataaagaaagagaaaacagaaaacttgatagccactatcagctttctggaccataaatctcaagttttgagaattgcttcccaaaagggtagggagcaaggatgagttgtgagagcttcggagcctagagatatttttttagcaagccagcaaagcactgacacaaatttctacatatctctggctgtgaaaagtctcatttgtggtgatttatatttccccataaagaactctgtagataatataagcctgctgtaaggctgtatgacaactttcaaaccaagagttacatgaccatttggtgaaaatagagcaagaatagatgagtgggaaagtctgtagaaatagtatttcttctgatgaaaggcccaaatgctgttcttccagcatgcacgaggttcagagagtaacctttcactctgtgtgtatgtatcttgtggataatattttggtcgtctattctagaaagtattatttttttcccaaagattgactatgcatttggtgtgtgcatgcttgtgtaatttacaagaaatgacactcagacatcatcacactgaaattcagttgccttaataagttactaagagaaacacagagaatagcatgctgacaacccaaagtcaatgaagtataaacactgttattccaagtgtcactggtgtgttatttccttttttcctggcatctgctctatgtaacactgtacacacacgtgatacagcagctcattaaactgtttcagttaactctgaaaccaaattagtgcattacatgtttataaggctgagaattactgcttccctgtgaaattacacaattaatcagttgcattatttctttaggagatgcaaccacgtttgacatttaaggataaaaagaacaatcctttaatttgtttccatttcaccattgagtctcagtagggtaaaggaagcaaaaggtgacataattcctccttttcccttaggaggtcagaactctacatgcttcctctgtctcataatagcattctgaattcttaaaagcagtacaaataaaaattattttggttttgaacttctcgtctgagtgtcacagcctttgaaaaattcagacaatgggaagggtacttaggagtcttcagtttcttatggctttataccgtgaatttccatcaagtcctgattattgagtaacttttaaggctccttttgcaaactttcaagatggtcccaatgtaaaaatctattaagcggtgatatctgctctattttcctttttcacagacctggcattaatttctctgattcttttaaacaggagttaaactagactcatcctttagtcacttaacagggcatgcatttccttttaaaatccatgctacttgatcaaataacttgtcaacaaatttaaaaatacttttcaataccctgtgttcctatgaattgcctcctccacctttgatttcactcaaactatgtgaagtgtgctaggcgaagccattaccagaaggcagaggtacaggtctagctccaacagcacctgagctgatgctgcgtatgcatgctcagaaggttaagagggcacctggcagtaaataactgttttcataagaggaaattacaattaacagaataatttccacaagtccctaaatatcctctttcatgttctttatttaaccttcatttaagagcccttgaaattcattcatgctttcctaaaaaatgactagggacaacttgaaacagacacaattccctaaactcattctttaaataaaaaggtgcattattgcagcttcactaaagacctgtgggagtatacaaagcgaatagaaggactattttcaaatagagacccgatataattcttaaaaaatatgctggctttcaaggggagaaaattgttccattctattttcaaaataacacaaaacttacaaagaaaaactaaatagtttttggtgactaagatgtactttgcatctatatctgggtacttactatctgatttttgtgccatatgtattctcttccctttagaaaacgttaaaatttgtcggtttcccaacactgcccttccactcttctgtattaatacaagtgtgtcttaaaacaccatgtgctagtacacatacttgaaaaactagaggaggtgcaccagtatttgaccacagtcctacagaacatttcagttataaacctcttcaatcttagagaagttgatgctacagtaaataatgctaaaataagacttcagtaatcaaaaacatttttcaataacaaaagtaaaatgcacacacacacactgaagcaaatatcgagtgtttcattgtcagaaagtacattgtacttacaagtcatttcccctgcaagagtaaaagacaatgaacagtgaaaaagactacctcctgctttgataattgtgccattttgacactcttctatttcaataagaaaaactatgtaaaaaaggtgattggtgtgaactgtccagagcaaaacaattcttaatgtagatgactaaagtaaggcactgaaaaatcagacatcaagaggaatgaagaattccttatgcatagtaatcctagcataatgctccttaagaatataggaaatggtcttaaaacttaatctttatgcatttatgaaattttttactgaactaaaatatcaatctgggatattcaagttgccttaacttttcaaaaaatgcaaaactttttggacttggattactgaagttgttattttggcaatcaactggttccttaaacaatatttcatcgagactcaaaaatcagaaaagagttgtgattattacacccattttacagatgaaggaattgaagctcagtgaagttaagcacattgcccaagttcccacagctagtaagagcacagaaagaggattcagacccaaagctacacttaaccagagtctgtgcttttaaaaaaaaaaaaaaaaaagaaaaaaaaaaaagaaaaaaaacacacgcaaacaacaacaaccatgttccactctctgctttgatgttatgtattcctagcatattatttttttaaagtactaaaatacgagggaactgctggagagggtgcagtaaaacttgagccctgtaatttatctgcttttctaaaaaacaaaattagaaatttaaaaaattaattggttttttgccatatgtggtttattatggcatttatccatgcaataaatatttcctgagtaactcttctagatgctgctttctgcaatttttctttgaaatatatagcttttcatcaatattatggctaagcagattatccatattatggaaaacttgcacttctacgaaaaactatattctgaattctaaacaactcacctgcaaataaggttttgaaacacatcgatagttaaatgaggactttcttcaaattagttctgttttactagttttactgaatattcttatacttttaaaaggttagccaataactgtattgtacaatcaaatgatttctgaagctgatcttgatcattttaataagatagcccttaggaacttaggttactttgttttaaaaattgtacagtgaatattaaaattgcctcatggcttaagataaaactgtaaacttttaatctaaatacctaaagctgagaattagcagttaaccacatacatttaagcatctacagactatagatttaaaaatgatgtccatagtaacacagaatgtcctagtaataactcagatataacaaatgctggaaaaattctcttttagtatcattttcagaaaatgacaattgtcttctttattatagatctctcattaaaacatactaattcctgaatcaagtgtgcaatcgtaattcagtctggatggtgaatattcaggacatttaaggagaatttcttagaaaatgcaacttttctggtttctgaagttatctgagttaaaaaggtcaacgctttgggaagatacagttgaaatatcttctggagatggaaaagtatcctttggagaggaaaaaatgcagaaatatgtttaaaatttatctttctaccatctgattcggggttcctaggaagtgtttataaagtagaattctctaaacagtagatgatgtcagagtgagtgctatttgtttctaatctgtttttaaaaaatataaagtgtattttttcaagtataatagaccccaggactttatctcctcatttctttctttctttttttttttttagacagagtttcgctcttgttgcccaggctggagtgcaatggagcgatcccagctcactgcaacctccgcctcccaggttcaagcaattctcctgcctcagcttcctgagtagctggggttacaggcatgagctaccacgcccgtctaattttgcatttttagtagagatggggtttctccatgttggtcaggctggtcttgaactcacagcctcaggtgatccacttgccttggcctcccaaagtgctgggattacaggcatgagccactgcgcccggccctcttcttttagttgcttactcacttaacttcctcccagatcagctagttctcatctgtgtgaacctttttcaagttacctaacttttctgggcctcagtttcttcacctgtaaatagggaaaaagaatagttcttcgtagtgctgttttcagatggcgcctggaacacagtacatgctatataaattctagttatccttacttattaaacatctgcatgtgccaagcaatgtaatacagggcagaaagcaggaacagctgtgaacaacctaccataaatatataatgtcagggatgataagtgcctgaggaaaaataaagcacagtaaaagtatagagaatgcagagaacaaggtgttatttttatatagagaggtcagagtcgctgcctcttggataaagacattgtttgaacacagacctaaagaaagtgagagcaaggcacgtgaatgcctggggcaatgggaagcccaggtagagggacaataaagtccccaggtcccgatgtaggagtgtactggataggagagggaggagggctggcagctgagtagccagaatcaggcagacggtggtagcagaagtcagaggccgagggaatcagggaaaggagttcaaccatggaggaccttgctggccaggttagagactgtggacttttgtctgggtgagacaggaagtcactggagggctgtgacagagctctgaggctgtgaggcactgctctgtcagtgccatgagtggggaaaacaggagcttgctgcactggtagagaccacagataatgatgacttggacagagcagctgggagagaactagttcaataaccctaacacgcctctccattctgcattttccctaaaaatgtacctttaactaggatttattgaacatctactaagcaaggtattgacctggaccactgtacggatgttatcttttaccctaatgctgcagaccctcagataaaatataataaaattaggatattaaagctccaagaatttctgaagtcaattataattacattattttacagatgtagagttcaaactccagatggatgaaatgattctctcaagatcatacagctagttaggtcaagaaaaggacctgggactcagttttccttactttataaaagcatatattcaaatcagtgttttatggaattacaaagataacttattaaaaggatttccctttaccccttctgatgtaaaaataactgcaaaacttctatcaaacatattctcattaggttaatatttaagagtatcatttctaaattgagtattttttaagtttctaaaaggagtattaaaaaaaaaaaaaagacagggttttgctatgttgcccaggctggtcttgatttttttggctcaaacaatcctcctacctcagcctcccaaacagctgggactacaggcatgtgctaccatatccagctaaaatgagtatttttgaattttttaaaattactgtttcctttaggaagtctatataaacaactattgtcttaatcaattgactggcagttctgcaaatctatcattgatataaataccgccaactttctgtaattactttagtatgccaatctcttaccaaaataactcctgtagattaaaaacagtatttgtcagattcagagatggccccagtctacctcagcaataatcagcaattataacaacttaatatactgtctgttcccaaggaaaggagaatatagcatagttattcttgggagttaaaataaagggactagaactgcaaagcatgttttatttttaaagtaaattggaaacttcatttaggatattttcaactaccacattttcttaattttataaaactcaaagacattaagaaaaaaagaaatctggttgaggataaggcaaatgttgataagaatcttctgactcatgtcctctctaagtaatgaggtgaatagcttgttatgaaatccttgtcttcccttcctccaaatctgtgtttgtatctgaattttggcactccacagtcttcactatacttaagcctactcctagcaccataaagcaggatggccaaaaagctatagctttcttttttctttctttcattttttttttttttttttttttttttgagacggagtctcactctgtcacccaggctggagtgcagtggctcaatctcggctcactgcaacctctgccaccctggttcaagtgattctcctgcctcagcctcccaagtagctgagattacaggctcctgccaccatgcccagctaatttttgtattttttttttttttttagtagcgatggggtttcactctcttggccaggctggtcttgaattcctgacctcatgatccacccgcctcggcctcccaaagtgctaggattacagatgtgagccactgtgcacagccagctttcttttttctagggaaagtaagaagagattttaaggctatgaggagctaagaggtactgctgtcctagcaagaacattctgtaaaattgactggtgggcagtgaagcttgttcctgagatcagcaatagagcatcttgtaacgtagtaagtgtgaaaatagctatttcccaatcatcttgttcattccacacacattagggaagaggaaaattcaactgagggccaattctcccctaagaatcctttagtttaattatgaccacagtacattaaacgtctgtaagacaaccatgttagctctgctgctcctgactgcagtggtggaagagaagaaaccctttcattactaaaaagacagggaaggatgcctttgcgggtcgaaaacatggttgaaaattcaatttaactgaacaccaagccactgtgcttcttgttaatgaacatctttttgctgctaattttgtgctattttacctttcattaaaaaaagtaattcaagttaaactcagctgaacagcaaaaagctcttcatattttgaagcattttggaacaattactttgacggaagcccttgacagttaaatgactccgttaaatgaatgttatagaagtcacataatgatttttagtgaaatattgaatttaaccacaaatgaggaaaaaccagtcataagcgctatgggtatatttgaataataacatcttgcttatgaagctgaatgaattctataatttctaataatcaggcaatcaactagttagttagtgggtatgttcctcatcttggtgctctctattcatttttgatttttgcttttgctgttgtttttttaatctgagaagccagtaagaaaatttcaaaactagcaagaattttctcttacattggtatagtattttacagtgagacaactaatgagttgctgtcccacaaatgaagtcctcctctttcctttttctcatatgctgaatgagattctttcacaaagtaaaaaagcaataaaagtcaagaacatgctgcctgagaagtgtgaattcactgtatgccagtgcttcctgcatctgtgggactcaatattccttttcttgttttatggatcaaatgtgagatagtatcaaggcttttgcatgttttctcatgactaatgactgaaatatgtactgaaataataaaactggtactgttcaatttcctttttaaattcaattccaatataagtgacagttatcattgtgatggtgaaatctgacttattataaaattctgttttctggagaaggagaggagctagaaatccctgtagacttaaaccgtgtaagttgtgagtgggtagggacatttggactgaagaaatgagtcagaaaaaagaatgttcttgtttgtctggcaagctggggtgaaagtcgatgctaagcatactgagtggtataacttggatctctacccactgtgtgtggttgcatttcctgattcttccaagcaggtgaggcacaactttctccatgttctcactactccctgaatttatcttcatcatcagcaattgtcgacttatactttaattgcctatttacatgtctgctccccagtgaaaggtcactccctaagaacagggaatatcttttcatcttgcatcccccagcatttctcagctcagattaagctgtccaataaatgtattttttaacaagtaaacttttaacctcttcagttgacagtgagaatacatgggaaaggccagatagtttaaatataaatactagttaaagtccagatacacaacaagctgcttaaagtagctaccacctataatcttgctactcaaagtgtggtccacagttcagtagcagcagcagcatctgggagcttcatacatccagaatttcaggccctgccttaagacctcctgagtcagaatgcattacaagatccccagataacactatgcacggtgaagtttgagaagcatttacctataacatatgatagtaggaggtatgaagaagtgatgggtatataatggagaagaaacaaggccaggcattctgattaatacagaagtctactgagaaagttttagagctctcccaggacagagtcactcaatgctcacaggtcggaaactcgctcataccagttaccttggaaccccttctagacacttcttcacaagtctttcctgtttaaagacagagctactcttaataattatcttttctccttgctgcaaagagagtatttatcgtcaacatgctgacatgtccaggagttttggcttcctccactgaaaatgtggaagattgaaaggatattgctgacacctgaataagaaatccaatgactccaagctatgtaaatttaattatttcctttaatttttttttcaggagtctttttttcttttcctgagctttggagaagtcctggcaattttcatttaaaaaaaatacaagtcagcagtggttcagtgaacaggctgacacgtaatttcatagggggagacgcgctctgtctttaatctaatttgtgctctcaattcccagctaatgtatctagggatcctgatgtacgcatttacaaggagatatctgtaatgcagagtccagctctctgcaattctctgaaacatgggtaaaaaattagtctgggttcttgcagctgccctacaacacgataaatctctatatactcacagatgtagaaatattctcggcctggcctgaattcaaatcctagagaaaagggagtgaagagctggaatttttcagagaacttcagcggtccatttggagagtgaggccggttacattcccatctcttgaaccctttggaagtgtggtcgcaggcactgtagccatcaaagttcaccatgtagaggacatagcgctcagtcttatcttctgggacggagtcctcatagtgagggcagaaaacatccaggtagtcattgatacagacatcaatatggtagtcacccctctggaatctgttagaaaaagaaaaaaaaatgtgataattcatagagaaagggctttctgcttggaatcagtggttaagccattcaataattttggagctaaagcatctagtatagtaagttcttactgaatgccattatgatttggggcatggtttgaaatgttgcagttcccaatctaagccacaaaaagccattttacagtgagattccattatatttgtttcaaaatatcctacaaactaagtgctttgctttcattttaaatattatattaaatatcactctttcaaactgtggaactctatagaggtactagtgtgctgttttccatgtttcctttcattcttaaaaatcatatattaaaacaaagtttttatatttttataatagtgtttcacttgataaatatttttgaataaatgaatgaggaaattaaagaacaaataaatgaccgaattgttttttgttatagttgaggccattttccactttctatgcaaatgagaattacagccataaaattgggagaattagaatcataacattttacagttagaaagacaattcctaaaacacttccattttagagaaaaataaaaagacataaagatgaagcagtgagtgattgagccaaacctagtatggagacttcggatcccagttcagtgcttttcttagatctgctacgtcagaaacttattttagtgcatctcgattttgatgcagcatcttttccatactgagaaaacaacccatctaaatcaaatggctcttcccctcatttcttttaatccctcaacaggtcatgttctagagctgggctggtgagtaatgaaagtaacaagccaaatgaaaatagccaaaaccacggctaattcatcctagttaaaaatgtacacacctgaatacacacacctcccaccacaaacaccacactgtctgcttcaattctcatctcacaaaagttttgcttatctgttttaactaatgtgtctttccccatcagtcgaacagtatttcccaagacacaacgatgtgtgaaacaggaactgttatgcatacaactttctcagtctaaaatcatggtggaaaagcgtacaaaactcctttgtttttagctggtgaggaaattcttctctgagccctcagaaatttcatcataaaattgtgttactgctgaaatacaatgctcataaagtcatataatctccaagctggacagtctgagtgtgaacacttcccagtggcagtgagatagtttattccatttttggacatctctagatgttggaaagtttcttcttatattcagcatatccgcttctgtgtaatttctacccagtgatcctacttctgctgcctggaattacaaaaaacaaatcaaattcctcttctgcaagggagtccataaaacatttcaagatgtcagctatatctctctatatcttcctttctgcagacatttgaaaatcttgattcccttggttctttctagtatagttcccaggctcctcatcattctagattcttgacccttctcatagtctccagtttcccagtatattccccataaaatgcagcacccgaacataaacataataacgacctctgacagtttgtgaccaatgtccaccccagtagaaatataccaccttctagccgggtacagtggctcacgcctgtaatcccagcactttgggaggctggggcaggcggatcacttgagtccaggagtttgagaccaatctggccaacatggcgaaaccttgtctctactaaaaatacaaaaaatattacccaggcatggtggcatatgcctgtaatcccagctactcggaaggctgaggcacaagaatggcacgaacctggaaggcggaggttgcagtgagctgagatcacgccactgcactccagcctgggtgacagagtgagactcggtctcacaaaagaaaaaagaaagaaatagaccaccttcactctggatgctaaatattcattgacaagccaagatactcttccgagagacaacattgtgaaaaagtagagacaccattcattttgactaagtagacctagatttaagaactggatctgctgttggttgagtgggagagtcataaatcattctgagcctcagtttcctcatatgtaagttgggctaatcatgagaacctgccttgctggcctctggtggctgcttcaagccttagataaggaaatgtatggaacaaactgtgtagatgtaaaccactgttaccatcatcaggatataccaaagcatattaaaataagtaaataaaatattaattttaaaataatagcagtaagaacatacaacagagataaaaataatatgtatatttccccttttaaaaatccaaaaggaaaatcatatagaaatgttaaattctgtccttaaatgtcaaatgatccatagcaactccacttgacccttgctcttgaaaagcagcatgctgatttacacaagagaaataaggacaaattctcagaatattcacttttcagctagaggatcccaaactacataaccatttttttaaaaaccgaaaacacttggaagtatttatatatttgcaatgaccacgagtttactttttcttcattactagcagacaatgatttgtcaagatgcaaggaaagcctgtgttgcttttaaaagatttttgaacatcaagctaacatcactgccaaagtacagagaaaagacactgcaaagttcagataaaagggtgctgggatatgaagcatcagcactcagagtagcctgacagttttggataagagccagacaagaacagcagaaggcaatgcccagatgcactttatattattatattattattatagattttaaagagattcaagggggaagttttttctttccctaagtgtcactcattttagcttccactagcatttggcactgctcaaagtgaaagtaaaaattaaaactgccattgtctggacccattctgttactcctttattctgtaattcctttattccacaactgaaaaaaaaatgtcagtttcttcatgcctagaagtttgctctcctttcctaactcttacccctgttaatgttgctaaatttttactaaagcaaactgtgaggctgaagacccattctactttgtgttgaccagctatcccttctgatgacattttattttgcatggagtgttaagtgaattacggtggtacctatttcaaacatgcgattgccccagcaattattatttctttctttctttttttttttttttttttttgagatggagtttcactctgttaccaggctggagtgcagtggtgtgatctcggctcactgcaacctccgcctccttaattcaagcaattcccctgcctcagcctcccaagtagcagggatacaggcatgcgccaccacacccagttgatttttgtatttttagtagagacagggtttcaccatgttggccagaatggtctcaatctcctgacctcgtgatctgcccagctcggcctcccgaagtgctgggattacaggcgtgagccaccgcgcccggccacaattagtatttctacccttttagcagccatacgacgaagaaaagatgatgattcactacagaatcaatttacacttttgtttcagatcttaaattcatatagtttagtaatgtacatttcaaagggtggacaatataaatataaaaacaatgacaaactggaattcataaaaggcagctatataacgtactcaagtataatccaaagaaaagtttaggatcacatatgctaatcctattaggttggtgcaaaagtaattgcggtttttgccttaatatatcaaatcatgttctctgggtataaagtagaatggaaccattcttttctggccatactgtgaaggagcacataagtatggctaatattagagtgcttattatgttacattcattatctcaacttaatctctattacgatgccacggaatagccactattattactacacccatttaaagatgaggaaattgagattaagaagtcaagcaacgtgcccaatattacacaactagtaaagaaaagggggaggcagaattcaaacccactctgacctcagaaccaaagctcttcacttttccattttgtgagagattaaattgctagagccaagtccttaggtcagcactatattcctccagagggacccattttcattcttgatgaggtttcagttctctccttcattcacggatgcaacaaatatttgctgcatccaggatctgctatgggctttacatatgttatcatatgaaatcctcgaaacaaccctattttgtagttttaattagtttcactttaccaatgagtcgaggacattcagagagggcattgtccaactttttatagctaataaatagcagagttaggatctgaactcaagtcttacatggttctgaagcatattcttgtcctcctaaccacaatggttccaaagcttcaccagctgtagtaacgaccctcttaagagttgggttacctttatatttacactggtcttctagcagagcattgcaacaaggtgtcccagccctactgtctcctccatgaggtttgtcccaaactcctaaactggaaagctgaggggtgtgtcaacatttagaataagcctcagattgcagggttagctcctgactcatcctttcacagaataacatgttgttaggctcagcagccattcacataaaggaatcttttttccatcaggaagcagctttcatgagctctagctcatattaaaagaggaaactgacatctaggaagactgattctgcatgccaatatttacaaatgccatgggtaacacagccattgctttaacatatttgtaaatttcttggaaaatttcttgtaaatgtcttctctttatgtcttatccttaattccatccattgtatcagcagttctatacctctatctgagatcaccacataattttaactataagaatttctggctgtacaccaagccagcaataattacaatacaatctctactaaattatcacagtgcttcacaatctaaaagcatgctcagttaccatacttagaaaagcaattgtgtttgagtcaaacaattacggccctgcctgttttcacagtgtaaaagtctcaagagtcaagaaacatctcatatgcataaaaagatggtcactgctccccagaaggctgcatggccacttaggtcaatgttctgtgcaacataaatagttgacccttgagcaacacgggtttgaactgcatggatccacttacacgtggacttgcttctacctgtgccacccctgagacagcaagaccaatccctcctcatcctcagtctactcaatgtgaagacaaggatgaagacctttaggattatcaacttccacttaaaaagagtaaatatattttctcttccttatgattttattaataacattttcttttcttgagcttacttgattataagaatatagtatatatgtttaacatagaaaatatgcattgactgtttatgttaatggcaaggcttccaagcaattgtaggctattagtagctaaggttttcaggagtcaaaagttatacctggattttcaactacatgcagggccagtgaccttaacctcccacattgttcaaggataaacttcatattatatgtactctattatggcaagaatacattgtacacatttatgaaaatttggtggtagactggttcagaatcaatgtcatatatattataaaagggtaattttagttaatttaggaaaataaaattcagcatggcaactagtcctttgcaatcatctcaaataccaaaaatgaattatgtactttatggtagttcttgataaaccagaggccacctggagcattggataaaaagcacgtatctagggctattgacagcaaaagtaacaactgaagctgggattagagctgaaaaagtgtgcttctggaaagtgtgtttgtttctcagtgtttacctgatgacattccattatatgctgaataaattttaattttcaatttaaagccactgttaatatctctcccttgctgagcatggtggctgatgcctgtaatcctaggactttgggaagctgaagtgggaggatcacttgagcccaggagtttgagccagcctgggcaatatagtgagactccatctctataaaacatttttttaaaaaaattagccaggcatagtagtgtgtgcctgtagtcccagctactcagaaggctgaggcaggaggatcacttgagcctcagaggcagaggttgtagtgaaccgagattgtgccactgcactccagcctgggcaacagagcaagaccctgtctcaaaaaaaaaaaaaaaaattgctccctgtactgaacctatctgcaagaagtaagtcatgacttgagtctcagaattcagatgaaataaagacaagagaagtgaggtaacagttgacaactaacttttcatttagatctcaccagtgtgccctcaactttctactgaggaagcaaagcattgtttgatgacattaggtagcctaagctgtaagagctttgtcctcctaagtatttcattttcaaacttgggtggctgaaaaaggtacatctactacttgaatagtctaggtcctttactagtctcaagtgtaagttctcaacgtactctgaccctgtctcttggttcctctttactaaggtaagtagataccacctcgcttttcttccttatgattttcatggtgccgacctgacttcctcctggaccccacactcctgtgttgtggatattgacagctggggaggccacattgaaaggacactcaggcagtgccctgggcttcaggctgcagaggagcagcaccataatcctccttctctgagttcatctttagccactttgccctgcagtcttcctcctttcattccatcctcatttgctaaagccaaaatgcatttcattttagtagctggaaaaggaagggtatggtgcatatttaaaatgttctaaattggcctttagcatatgttgctggcacagcagagaacctgcttccagggaaatatgtatggaggtattttatcaagaagctcctgagtgaagtttcttcactccataaatatagaaacagcattactgaaaggagacagtgttattagaggttaggaagctgtgagatactttcatcccccttcacattatgttttaaagaattcaataatgaaaatgttatttctcatgaactggatagttgattattacattttaaatatattttaatctgtcaaagaggtgattgttttaatattcctacttgaacagaaatccaatgtcacttctttaattacaaggcaacctaatgtattacattctgaaattgaaatgtaaaagaaggatatgatttatggtcaaagattaagcaaatttatcagcttagggttcctccaaaattttaaactaattctagagtgaatatatcttgggagcactgtcttcaaattctactattactgatttaaaggctaatttcagaacaagatgtctgtttttaactagtataatttttcatttgtcccaaaaggggctaatgggtcctgcaacagatatgggtttggtttataaatatgtttttgtgaggagatgggcaggacagcagtctctgttgtataacatgctgcttcttgcatccttctgttattcctttcagcacagaatgcaagccttatggctttcctattctaaatctgaagatgctcttttttttttttttttttttttgcttttctgtggaggttaaagcatcgaatacaaacagcacatcaaacagggtagataaataatactagcatcactaagggctgaacaaatatttgttttgttaattttaaatttctcttctctctcatggactgaaacatgtctatctttcagatgtattggtaatcaacctcaatgttcagctctgagagaagaggactcatggatagtttcactgttaccccaccaggtgtgaaggctgaatgagaccttatatgatgaccaaaacacataatttcagaccaatccagctcttccaggctttagaacatgctaaaatcaatgaatattcctagagaagtgaaggttcacaagttaaaaaagtattcaaggataaatttcaaagatttttcctacttatttggcagcagaaatgcagtatgctacaatatatactgacaaaatgtttggaacctggagttggtgctgtgtttatacattaatgaaagttccaacagagttcttgcacgtgcatgttttgataattaaaaattctgcagcataagagttttaccttaagttcagtaactgttgatgatgataagaagacatcattttcttggccaaatatttagaattcatcagcagtttattatactaccctgtcactttttttcttgtatgtatgtgtgtgcactttaaaagcaaaacatttaaaaatcccacaatactaattactcatatcagatagatagataaaattcacatagcttttgcctgttgcttttctactacaagtcatgtcagtctgaatgactttttaaaactgctatctcccagaaattgcacctgtttcatataaaaggcccaggcccacataatgttctctcctccagtgttgtaactcatttggagtttgttttattagcttgatggaggagtttcaaaggaaagaaagcattaaattggcagagcctaaacaagactttccctcaggaaggggctggaagctttgggtgacagtctaattgcttctaagcccccaaagaggcctcgggcatggagtaagagtgtgtcaacgtcaacagggccaagtcagccaaagaattaagcaggcagagttctaaagacctaacacatcacagatcacttcaaatggctttcaaaaggagattttaaagaaatagttaatgtctggcaatcagtatagtcctaacagacgtcactcccacaatgcaaaacacgcttttcctctactcctgctggccaggagcttcctatcaaagctgtacttcaggtcttaagccagtagagttttacaccccccagccccaacttcaagcacatgaagcagagcacctgccacatacacacagacccagcaaaaggagacacaggcaaccatcagataggctatctagccactgtccaaggagaacaggattaaacaaactgactctgatcaggggatgtgggcgtcaatcaaacaaataagccacctgtcaaactgcttacttccatgtagcccttttgtatcttctagatacaaaagagaggagagttacccagcagaatttcaggctattcacagtttcaaaaataataataataactaaagggttaataagtaaatctcctttttattgaccaactcaaggagagatttttggaaaagagtgatttaatagttcttaagtacttggtgtgcaaagagtgaactaaatgtttgtattatgggttgatgataacttactggaatcattacaatctaaatctgaaatttagcccacacttttaaaaaattgagatatctgataattaatctgttaatttattaaacaaacaagaaataaattggaagaaagaaaatacatgggttttatggctttcttttatgttttatcttcatcagacaaggggaagcatatatttggtaatgctagggcatgataataataataatgttttcatacaaaactgtagacaataaagcagaaattgtggctgtttctatggaaattggcacgtgcaaggtaattacttctatttggccagttaggaccttgtgagcagttggatacaaatctgggactgggaatgaggctaatacaaagaaaagagctctgcagtcattagaaacgaggtggtgatcgtagtcataaaaagtactgaattcatccaaagtcaatgtatagatttagaagaaaactgggactttgctgaatgcaaattgctgtaattattactatactagttttatatagatttattttttacgtatagatctccttgaaaatagtaatggtgtttacttgtctctgtatccccaacacttagcaccatgtttgcacatagtagcgactacatagatgttcgatgaagaggaatgtagctgaagggtatgagaagtgatgcttaaaaacagaagaactgtgtaaagcatccaataatctcttcctgtgttctgggtcccagtataaaattttgagagaagctaaatattataaacaaaggtcaagatcaggaaacaaaataatggcaggctgcaaaaaaggaaaatgataaccaggactgttgttcaagcaatgctagaaaattatgcctaaccaagtagacaacttaagcacctaaggcagaatgaaagtttctctcttgtcattaagtcctctattcaattaccatttatcggggtaattaaacactggaaagtgatgccaggctaattgttagattatgataattacacgtctttgctatgctacagctgatcaaaataagatgtggtcccgtgcacttagccaaagctgctctgtaatcgtcagacttttgtacagtgctaggacatttattactaattcattacaaatcaggcggagaagcttattatttgtaatgcttctaccccctacccccacacagcctcctgaaacaagactcacaaaaggttaagcacaaacttctgcctctcattggcccattgccatcccaattacacagctgaacagcattaggtgcctctatttgagagggttcatcaggctgcttcacaaacatcctgcaatcgcctatcacattggcagaaacatccaagaccccttttcagcccctgccaaccactgttttgctctcagttgtgtcccagcaaccatgagctggaaatccagagactcctttggttttggggctccctcctgctcaggtcaggcctcagctagactgagatatgtccaggggtttgctccagttagcaggagtcatggggaatacagactgttctccacctacctgacatccagtctctgttcttcaagctgggatcaggagaggaaaccagcgttctcaggctcccaccagagtcaccacaaagctaccaaatagattcggatctttggagagaaagactagaaccaatgcattgtccttgggctttacaaggccagaatccctggcatatctgggggttagaaatctctccttccatccctgtactaactgctccaggccactgttggaaggtgggaaggcaaacaggtattttatattcttcacttggctttatcctggaacttttgaggtcctccctgcaaccatcatcagaatgtgttagcatgagccactgtgaggtggaggaagcatagagcatcaggttaaaagtttagtaactgctacatttatgtcatggtatggctctctattttaggattttttttctcttattattttagcagtgttacagactgaatgtctgtctctcccactccaattcatgtttaagccccaacccacaatgtgattgcatttggagacagggtcttttttggaagtaattaaggttaaatgaagtcacaagggtggggccctaatccaacaggattagtgtccttatatgaatagcagagagctcattctccttctgccatgtgaggactcagggagaagatggctgccccaagagagccccccaccggaaatcaacttctgctagaccttggtctgggacttctagcctccaaaactgtgagaaaataaatctctgttgtttaagccacagggtctatggtagtttgttatggaagtctgagcagactaatatgagcagtttaacattaaattagggatacagtgggggatagggtggttttgaattacattgctctcagtgacttcagatgtatataaacatcaataaagaacagctaagtaaaaatggccagaaaggaagggagcaagggggaaggaagatggcagacttatgccactaccagcacttctcatgataccctgcacatgggagagactcagcatctacttgctgctctgagcaaatggctgctctgaggcgagaaggcacactatttttctaagtaagcatagtttcaactctgaaattaactcatggcactacaaaaacgactgtattatcacctggcaactgtgttatctcgctgttttagcaaaggcttttgcccagagatagaatgaagggtgttacagaaaagtcacatattccattttacctttccttgaccctggaaattaaaacagaatatgccaccacccttcaacaattgtattaagtgcattctaggggcaaaagaaaccacgaggtactttgttaacaccagaatacatgaaactgtcatttcatgcacacatttattggtggcctgtggtttagactggggaacaaaggtacttcagttcatcacataaaaatggttttgcactacttagtattattatttcctccccacactcattaaaaggatatccattcatacagctggatcctctatttacttttatagcctggaccacagaaagatatatgcaagaaaaatgcaatcataaaaaatgagaaactaattgctctatcccaaggaaacataagcgggagaaagaaataaacaattcaccatttatttctcagaaataaatctaagcactttagaggattctcaagtactacaatatttctacctacttaaatgcttgtctatctcaatgacagagaatatagttgtttttctttttccacctatcatcttaataaactctactttcaaaatgtctaccttggaaaagaactatagttcaaagggagtgcacatgatcttcctattgaactttcagaatttttggtattgccagaagctctgaatgagccacttgtgtggactgcaaggtttctgaggcaaggttaatgtcaagacacaaagacgatgaaataagcagatgataatgggcactccatacccatgaaaactcagcactgtcagctttgagaagacagggtcacaacttactttcttcagtactcagtagtgcaatcccagatcccaaagtttcacgacgtacacattaacattttattgctgctcacactgttcaaggcagacagaaagagagaatgtgagctgtttttggtcacaaactcagtgttgatgagctgggtcaaaaaacaacacaggatttacaaaacctatgggagatattaaatgagcctgggactaagcacagaatctgtatgctatgtgatggtaaatgttactctaatatagcacgtcaattgatttatttacagaataggataattttacttgttgatgttttaattcaacatctgggtatctaccttgtacatgccaaatatttatcaaaatcataccccattttgcatgctaaaaaaaaaacttggattttttttttttttcagttctacaaatataaagtattcctttcaaccctctctctgagaagtaaaggcatagggtaaacagggatttcaccttggtatatctcagatttctggctcaggacactctgtatctgagaaagattcacaacagccaaaaccaactcaaggatgtttttaaatccagtcattaattaaaaaccctaagtcatggtcactgaaagtactggttactatggttctataaacgtgattagggaaaataacatgacatgtgctggccaggtgagcagattagaagcacaatctaccaggctaatataaagagtatacccactcttggtgctgttaaacctgccctgaagcatgcactaatattcagggctggagcaaggaaggatagcgtcctatctgcagaaacaccttttccttccttgtgtaggcagtgaagctgtgctggaattgcatttcccaccatataactgggacatgatctgaagcttacatatacttcagtttagttctgaatcctaagaagttacaaattattccaactcactagaggaaatgaaaattaggagctgtgggaggtgcctattgtttttctgttttagtttaaatatgaatttctggcataaaagctgaagaaatatacttacatatgcatagcactttctggtagaacattaaatttagtttattttttaaataagggtggtgccttctgaatataactaatatctctaaagatgtcagagatgtttccaagtatatggaaacaggaaatactgcatttctttgacaattaggacatttaaaaatttgtatcacatgtggaaaattgtgttgattctaattatgaaaaaacttactggacaactcaaaattagacatatcactcctgattttcttcgaatctaagaaatcctcctacataaaacttttgataaaggttttgactcaacaacagctacaaccatcttactagagttgagagcaacaaaatcctaactcaccactccttgaaaacaccaggttatttgcctttgtattctagaccaataacctggctttgtatcctagacactactgatgttcactagtcttaacctacagtaattatataaatatacacagcatgcatgacatcagcttgcaaagagatggcctttttttttcccattgatacttagtcttaataatttcacaagaaccctacttcggaatcaagactatagagagatatactagtaaaataaagtttgagccatcatcttatccagctgtttccttttagaactcttaactacctagtttctttttttgaaaatctccaggggagaatttcattctaaaatagtagttctttcccaggacctatagatgtcattcaaaattcagtacataaagaaattctcttttcaagggcatccagctttccagtgtagttcaaagcaatcccctcaaccctgccctgtaagaagatttgagagaaatgtatagaaaatgtagcttatgttttcctaggaaagttgagctgattgtattatcaactgtctattgcattagcaatttccagctgaattacaaactgtttccctgcattatattgctattgttcaatatcattttattgccctaatgaaacaaagctatataatataaccataaagtactgattacagttaaccataatggaagcgagctaaggaaagctctatttttaaaataagcaaagaaaaagaagaaatgctgatactcagaagacttttttttttctctttttggttttctggattgggatcaaaacaacgctgacaaattacttcttctttctcttccaacaatacagatggtatttccccccaagacagaatttctagaaaacttcccgaggagcgaaagttccccaggtactaaaaaaaaaaaaaaaaaaaaaaaaccctgtgaattataaatatgtcttaaaaagtacctacctcaaaccagagtattctcttcatatcatggaagaagatatccaaattttccctggggtacaggtttctccctgtctgtagatgagctcttggaaaagtaccattatgaaaccattaggggcattgcttattggcctatattaaatcgaccagcaacacaaatgattaggatgctgtgctgggcaggaggctgcccaaataagatggcaaatccatagctaaggtttctgccttttagtaaaggcaatgaagatgacttggcagttccttatatacccagctccttttccatagatagaaccagtaaacaaagagttggaaagaacaggcaaaagagaaatttcttgggtgttgctaattaaatgatgactataagctgcagtgccaggcacttgctgtcctctgacatgcatgccagacccactataccccctcaagaacagcataattagagcaagggggaacagagtatcattccccaagcatttcttgtgttgaactggagacagttaatgaaactactgtacagtgctgtagtggcagatgatctgtgactgccctttttctaggcgcttaaactttcaacatctgaaaaattcttcttgccatttctgcagtagatatggtgtaaatgccacatgttcttactcataagtgggaattgaacaatgagaacacatggacacagggaggggaacactacacactggggactgtcgggggttgggtgaaaaggggagggagagcattaggaaaagtacctaatgcatgcagtgcttaaaacctagatatcaggttgataggtgcagcaaactaccatggcacatgtatacgtatgtaacaaacctgcacgttcagcacatgtatcccagaacttaaagtaaaatgtaataaaataaatttcaaaaagatatggtgtaaatgtaaagtacacttgaaatgcctgaatgtcaagatcagagactaggtcctccaagacaaactctggtaatggaacaatccttattcttctagagatctttggtgagtattcacattatctacgaggaacgtggatgataacatcatccatgtggacacagcatgctgagtgctacatactatatttgatgcactgatctgatgtaagtggttcagaacagtttccgcaatgctcaatatacttgcattttctcatttctgcacccctgaaaaaagctaaagataaatcagggtgatatctgttagacctctttcaatagtgtgtattgcttgaaagatgaaagagaacatgcatttatcttttcctattagagtgctaatttatgcaagttcatttgccttttgcatctattgattggattcttgttgtctcatcccctgtactccattagaatcctcgctgacttaacaataatgcaaaggcagacaaaatttgtacagatttttacatgctcttgcatctatagcctatttaaaagtttgcataagcaagacagtgtaagtagaaattatgggcaacatgaaaaagtatttcacatcattgcatcagaaagaaaatctcagagaagatgagaatacttaatggttgaacttctcttttcaattttaaatagtcatggctgaacatttgaaaagaatcttgtgcttcaggcatgccgaaattaaaatagaagcgcaatttgagattacagtttataaaaccagtaagcacagctgctacatgtaggacaggaatggccctccttttccaaatccatttgtgtaagtcaaacttagaagtaaaattttctttactatgaaaactggcaaaaggacacagccctaggagaataattttcagacatggtttcctatgaatttgctcccagactcaaagaatgcttgatttcctgcttcattgggaatatatatacatattaattagtttaaatgcttaccgtttatggggtcaaaatctgattttagttccaggaataatgataaaataacttatttaatattaagtgacataaaagctgataatcataggacaagagtataaagattgccatttaaaaaaagttttttggagatagagtctcactctgtcaaccaggctgcagtgcagtggtgtgatttcggctcactgcaacctccacctcctgagttcaagtgatttttgtgcctcagcctcccgagtagcttggattacaggcatccaccgtcacactcggctaatttttatatttttagtagatacagggttttgccatgttggtcaggctggtcttgaactcctgaccacaagtgatctgcctggctgggcctcccaaagtgctgggattacaggtgtgagccaccacacctggcctcaaagattgccatttgagatataactttaaaccccaaagagtattttaatgcactttgtacagagcacatatgtgctctattgaagggtttataactattccttctggttttcacttcactatgtccaaaaaggaagagggaaaatgtaaaagtccagtgagaatctgatctgttctcatcctccaagtgatttatggcctcagagacttgacaatggagaaatcgcaagatgctcacaagtcacgaaaagggaggcttctcagcttattgaggatgctagagttgttcaggcagggatgttcgacagaggcagagggacacctagcaggtgtggagttcagccacccagacctctccaaggatggctgcaaatagcacaagatgtccacgaacactaataggcgtcctctgaaccacttgggaggtgtcactaataaaaagtggaaatcaaaatggaaagaaaatttcacctctaatccttcttgtggcacctggctttttcagcacatatggtacataaagtttgttaatgtctggtagttatcgagtaaatcagagttgattaaagatgtttcaactttatcttcatttttcagactttatagacatccatctgataactgagaataaacaactattttattggttgtggcagacagttcaggaaagaggttaagagaaaggaatacacagttgtctgcctatcttcgaatctgggctctgctgctactaactgtgtaatcttggcacattccatgacctctccacatctcaggttcctcacctgtaacatcagaacataacacctcactcctaggacatgttaggattaaatgtataaactaaatgaacaaataaatgatgactaaaagtacagtgctttgtacagtgcctgacaaatgattaagtgctcagtatgtattaaaacaaagtaagaggaatatattcaattatactatttatggaacttttagggtattatttttaccactaaaatgaattttaattatttgaaaagcatcctgagaatctcaaagatcctgcaaaataaaaatttcaacagtcattattacatatctttagtaggtagagtgtaatttttgtttatgaagaaaggaaatgtgatttctaaaactttagaaaggcaggacctggtggcttacacctgtaatcccagcactttgggaggctgaggcaggcagatcacgagatcaggagatcgagaccagaccatcctggctaacacggtgaatccctgtctctactaaaaatacaaaaaattagctgggcatggtggcgggcgcctgtagtcccagctactcaggaggctgaggcaggagaatcgcttgaacccaggaggcagaggttgcagtgagccaagatcacgccactgcactccagcctgggtgacaaaaaactttagaaataaaaaacttaaaaaaataaaaataaaaacttcagaaaatggggaagaagacactgactttctcaaggggactgtctatgcactcacaaagaaatctcagtcaccttctggaagcatgcaggatatataaatacacaaaggaagggtgggcagttgcctctgtgaggtaattctgggacacaaaggccatctttaaacaaaactgccttcccaaaagtgaatgtcaatccttaaatatgtgtaaaatgttactttgcttgggaggaaaatcttacttgccagctaacgcattaacatattttcatctctctgacccattaatacctgtcacccagcagagttaagacccctgagagactggtgaacacagtgggtaagtttttatgagaaaggggcctcaggaaaggggaatcagactgaatgacagaggtacagggtgacaacagaggaacactgagactttgcaattctgctgaggtcagctcaaaagactaagtgtcttcacactgcattagactaaatgatgtttctctacaggaaggcctgttttaacttaaactttaaaattacgcatttgagcaatatgatattcgactgaccctccaacctttcctaatttgattgacttttcacatatttatgtcctggctcccttgttaattaagtaattcattcaagacaagtatattgatagcctcctgtggctcaggctttgtacttaaaggtggagaaacagaaatgaaccaagacatagtcctgccctggagaaactgacagtctagtggggaaggcagtcatccaaatacatcactccaataaagtgctataaatgtaagagaaacgtctaccaaatgctgtagaaaatagtaaacagcaaaagacttcaaaagagttcagaaagaccatacagaagagccagcacttgcaggatggacgaaggggaggggggcttctcaggcaaggcaaaatgtacagacccaaagaaatgtgaaagcaaggacagtgttgacagcaaatgagaccaccaaaggaggttagaaccttattttgaaaaaggagtttgacaggcaattaagaacaagggatttttttttttctttttatttcccccctctgagatggagtctggttctgttgcccaggctggagtgcagtggcacaatctcagctcactgcaacttccgcctcccgggttcaagcgattctctgcctcagcctcccgagtagctgggattacaggtgcctgccaccacgccgggctaatttttgactcctaacctcatgatccacccacctcagcctcccaaagtgctgggattataggcatgagccactgcgcccagccaagaacaagggaaaatttttaagaaggtgcagaacatgattggatttgtatgttaaagtgatcactctgttagtcctggagaagacagactggatggagagaaagctcgaagtagtaagatcattaaggagtctactgcattagaccaggcaaacaaacacacagaccttgccagcttcagctgagaattccttactccctggcacctgccagtaaactattcacttattcttccattaaacgactatttgtagaggccctattgaatgctagatactggcactgtggaaagctacaaaataatacacataaaggcttcacttcagcttcttatgactgcatagacatgacaagagcctaaagtaggtcatttgtgggcttaaggaaaaggagatggacaagagaaaagttacacagagggaggaacatcggaaggttaaaaataatccccagggctgggcgcagtggctcacacccgtaatcccagcactttggaaggctgaggcgggcggatcacgagatcaggagttcgagaccagcctggccaacatgatgaaaccccatctctactaaaaatacaaaaaattagctgcatgtggtggtgtgcgcctgtaatcccagctacttgagaggctgaggcaggagaattgcttgaacccgggagatggaggttgcagtgagacgagatcatgccactgcactccagcctgggtgacagtgtgaaactctgtctcacaataaataaataaataaataaataaataaataaataaataaaataaaataaaaacaaaaataatccccaacatttgttcattattttgcagctcttacatatcaccatgaagggcaatgtggggtgggttggagtgggggtgaaggtctgaaagagtagtgcatgtgaggttaaagacctgggtttaaatacttcccctatacctcagtttttaaataaataaatgaaaaataaggtgtcctaaaggttctataacactttcagtttcacacatggaacatgcagaaaatagtcaccacatatttggtgactgaattatttcagaagccaaatgatacgatttagtggaacactgagactacggctaattctgctcctggatttccattcatcacatcaatttcaacaagtgaagagcagctataaccaaatggctaaagctggcagagtgtccaacgcctagaggcacaaggaggtcataatgattgtctagtgactggtatggaagggtggaagccaaaaatatggctaaaaccataaaaaaaaaaaaataaggattctactcttccctgatggtaagtggcagaactagggacactttaggtgatgacaactaatagaaatgtcaccatcgatgaaaagctacaagagaagatgtagcttatcacatcatccctccccgcccccccaactacacctgctctgaacccttccaacagccaaagcagcacaacaggaaatgacaagtataatgatgagaaaaaccagtgaggtcaccatttaataattttccccaagtattttctgcactgtttcatggagtattgtcacatccaaagtccttaagaagctctctaagttccaacattcctgacagaggaatataaataaataacgtacacttaatcaaaattgttttacacctgctccttcctactaaaaatgatagaaaagaaaacatctgcattactgtctctggagaagtaaacttttcctcttccaaagtcttttgaagggtaatgagatgccttaagtgcagggaaaatttaagattttgtccaggtctgaaattgttgacaatatgttaagcagacggaggtgatttcttttgtttctctaactttcccttttggttctgatgaaggagatgctgacataaatgtttttgttgttttgcatggcagatagacttgcacatctcaaaggggaagcaaatcatctccttgcaaacgatgggttatttttgccaaaaaatttgtattaacgacggcagaaagccgtgaaatatttatatgcctcgacttccacatgagaaggaaggaggggagttgtgagagagggaacgggatatgccacacaaaaattttttggtcattttgattcactgaaacaaaatggctttttaagcaccctgggacctccacgtgtttgtttaggattccaaaggcaaagtttttttgctcctctagatgacagcaaaatcttcacttccttgaaaactggtgctatcagcctcattgtgacaagatttaagtaaagccacagaactggaattgtgaaatgcctcctgccatgctccctctcttcccttctttctaaattagttttgtcgactaatattttctcctcctagtgtccttaagcatgtgcaaagcactaattcacacataacattcaagagcgcctaatgcctcaaagtattgctcagtaactccaatgttttttctacttttgctccaaaaattttgtctataattgataaaagcatgaaacactgagcaattagagggataagggtgaaagccagggcactggatgtatgtggttcatccactaaatacgccaacaaagtatccattatttcacatgaaccagactctgttttgtaagagacgctgggggtgtttagaattctaaaattatatggtattgttgaggtcagtcagaaaccactcaaaccaatgaggatatgagagttatgcttatgtgtggcaattcaaatgtaatattaaaaagtcacagtgctttatcatttatcccatttcttaagagaacaaaggcaatgattctggaggcttttcatcgtctttagacaactgcaagaaactgagagctacgtggtcttggcatttgatcctgaaggttaatcccttgggaagtcagacagctttctttgcaatgtctagaggaccacactattctatagcataaaagctggaggtcttaccaagatggaaaacgttaaatatagtttattagactattaaaagtttatgacatcacttccctattctctgatattcatcaataaatcccctttgatctccacaggaatctcagcgtagcttcttgtacagtaatacctatgtactcaagcttcaaagatccatttacttcacatgtgtaatttgcccacttattcctgctgagataatacccttggtttaattgcccatagagcaactggataaatcaactacgttggtttgtattagctgtctatgcatatgtgtaaagcaaaaataaataaataaaaagcaagactgttcaagtcattaactgcaaaaattagaataaaaaattttttcctaagagccacaaatagactcaatcagtatttctaaattttacaaaatgaaaaaagtcctttaaaaatatacttggagatatcaactacttcattgttttggaggcagagaataaataatctcagtatacatttagatagatagacagataatctataaagagaaaacgatggtgaatagatgaatgaatgaatgaatgaataagtgaaaacctaaatgaatgagtgaacaaatgcatagaaaaaagcatataaattaaacaagcctggacccacttaagaaatgtcagacttatcaggaaacaataggtactggagaggctgtggagaaacaggaaggcttttccactgttggtaggagggtaacttagttcaaccattgtggaagacagtatggcgattcctcaaggacctggaaccagaaataccatttgacccagcaatcccattactgggtatatacccaaagggatataaatcattctactataaagacacatgtacacgtatgtttattgtagtactatttacaatagcaaagacatggaaccaactcaaaggtccatcaatgatagacaggataaagaaaatgtggtacgtatataccaaggaatactatgcagccataaaaaggaatgagatcgtgtccttgataaagctggaagccattatcctcagcaaactaacacaggaacagaaaactaaacagcacatattctcactcataagtaggagctgaacattgagaacacatggacacagggaggggaacaacacacaccagggccttttaccggggttgggggtgaggggagggaacttagaggacgggtcaataggtgcagcaaaccaccatggcacacgtatacctatgtgacaaacctgtacgttccgcacaagtatcccgttttttttcttttagaaaaaaaaagtcagacttatacagctgacattaatttacagaaattcaagcctattttcacttaatagtcagcactatgatgaaagaaaaatctctttataggctgggcacaatggctcacgcctgtaatctcagcacttcgggaggctgagactagaggatcacttgagccccgaagtttgagaccaacctgagcaatacagtgaaaccccatctcaaaaaaaaaagttaaaaaattagccgggggtggtggtatgtatctgtagtcccagctacttggaagggctgaggtgggaggactgcttgagcccaggaggtcaaggctgcagtgaatcgtgattgagccactgtacttactccagcctgggctcagaatgagaccctgtctcagaaaaatttttgaaaactcttgtatacaacaaattattatatcttatgttttaaacctttaaagagtcattttctacttgagcttctggttattacattacatacctaggaaaactcatatatgtacagacatgcatacacagaaaggcttaactccaaaacacaaaatatttcagtaaaacaccttaatccttcaaataagtgaaaagaaaagcttgcctggcctgatttctttctttcttctttttaaaaaagcttatatgaatgttgtatccatataagaataataagccctgcattgttttaaataaatctctatttgatcttctggcttctttctaaagacactttacttctcaataacaatacactatttaactggatattgaaatacataaacatatattttattacaaaaccctagaacatagtcacattctagatggagttctaaaactgacagaatgttcagatagaaagatgtgaaggctatttagacatattagatattaaaagaattgataaaaatcattgcttttttatttaaaaacttcctatagttggtaaagtcagacaatgaccaccagaataatataataaataaatcttatattcagaacaaaatttatttcatctgaaaaatataaaaatgtattattaccaactgggtcttatgtatgtcattctgatttaagtatagcttaaaatatgctgagcctattatatatgggactctttcttatgcactctatgtatattcattttacatgggaattaaactctataaattgagttctacaagtgcataagtacagaaacaaatagaaacctatttataggtaattgatttcatgatttttggagttgactaggtgatttttaagtggcactagcaatgaggtctgccaagtttctacttttgaacatttctataccttgtggtctcaatttaaaatacatgagaaatcacaaattcaagcaatgccagagatgaaaggaagaccttagcagcagcaggtggagcggaggaggtattattgaaatacttgttgatatgattcaagagtgctcaaggccatctgatgctaagggccacaagcaaaatcagcagaggcctaacctgactaattgtctcccctgattgtgacggttttgattagaagaataatcagctctcagcagcctgtaggcaaaaatgcaaactgaaggagtgtgagtgtgtgtgtgtgtgtgtgtatgtgtgtgtgtgacagatgcatagcagaatgaatgccagatcaatattaacccactcttaaaacattaaaggggttccaatatgaacaaaagccaataattcccttcatagctaactagcatgaacgtttttccttctgtcactttataattgcttttatacaatctaaaggaaatgctgatattcaggctttccaaaagtccaaatgcattcatattttgtcactgaaaattgaagtcatacaattctacaagtcatttttgagtagttactttaaaatactttatattaaactcaacaagacatcgttttaagataaattagtaacattttttcttaaagcttttgctactatttcatcaatatgttaatgaaaatgtataaaaattatacctttgtttttaaaattaagattaagaatatatatttaatcatccaaaggactacattaaaatcagctgtaatcatcatttgaagctttactttgtgattgtctgcttcttttttcagatgaccagtctctcagttttgtgcaaagtatcttaaacttagactaaatggtaatttacttcaattattattcctacattagaaaattttaaatctcaagatttagaaatttaaacttcctgaagttattaagctcttaaaggtgaaagtttggggaaattttataatatgcaaatactaacattttttagtgcccataaaaaagctaaggtcatttggttcctgtgagaatgtaaaatgtatactttatttgcttacaaatgtatcacatttagtatatttagatataggcagggagggaatgaggaagaatacatttcagaaaaaaatgtataaatcttttgtaaattgtatttttacttaaactttctttccactgtggctatgagagaatgagagggaacaagagcaagagcaagtagagagggaaggaagcttttaggtctgaagagttgaaactgggttattttaagctccattccatgaacagaggtggttttatcttcagctaagtgtttaaaggcatgtgataacactaaatgcagatttccatctacctgctggactcaacaaaatctcaaaccctcaactggtgcctccaaatgtaactgtcagtcagctgatgtcaaaacctaacgtcttttccatggccttacacatctggtccctgtcagtgtcaacgaggtttgttggatgtggtgtcatggcaggcaaatgatttatatacacagacccaaagatctcagagctccttcagaggatgcatttcatctggtgtacttgccatcaacaaatgattgactgaaattaaacaaaaccttacatcctgaaacgtgagcattctctactccccctcttcactcggatcatgaatatatttagttagccagggagttcacaaaagacccatgtcaacagtctattagtgagatagaaaaaaatgcacattaaacacctccatgctttagcctctgacctccttaagctggcacatttttaaaattctttgtgggataaggaattactaaccagccacactggaaactcaagagtagctggtgatcaagtccacccagcattttcctttgcaaatcttcagttgagggaagaagaccttcagaagtgagtgttgcctttatcaaataaattacctaaaatactgcaccagattagaacaacagcaaaaaattcctcattcttgtctttaacctctcttatttcatctccttaggacaatgcacagacatgaggcacccagaatgtctctttctttgctcttaaagtttattgttgcaacctggttatggataattctttccactttactcagtgtgaattattctttttcacaagcctcataatgaactataaaactaacactttggtccagttagcattagcatatgttgagaacaactttaatgcacagctgccctgactgggtgcagccaaacttctgattttgagtgcttcctgcaggaaaatgccatccactacctagaaatgcttcatactctgctgttgtttgattaacagttttagctttgacagacattaatacaatgttaaagatattaattgtctcttaacttagaactcttaattgaaaaagaattaggaacctggtgaatggttacaggtccatattccacatggagagggctaattaagagctctggggtgatggggtggtggcttagctcctaaaaggaggtgtccatatatatcaatctaaagttaatttaacctaagctaactagggtgtgatttatatttttatcccagagctctaggccatttcccacagctctctcttttaacatgctgaaacttgcttaagcactgaaggaagaaaaaaagtaagtaatgattgtttaggtaatgttagggtggtgcagatcagctcttgaagaagccagctgttcatgcactgtcatctatccatgcaggcttgttcaaacatgcaaagcaagtgggctacagtgctttccatctatctaggtaaaggtgtaaaaagtggcatgtgtagaagccagcaaacagcagcaaaatcttttcagatcttgctaagcctctagagagctgaaaaacattcccttttaagagagatgttttgaaaccaagtgctgttgcaactgtgccagtggttggggcatgtctctacactagttgaacaaaccacacttgtcccagcaaatcatctggctttgctgctgctttagatggggctgatctatacccttttgcatctctaatgctcacctcctgtccagatgagctctctggtctagcttgcccccttgttcaatatggccatagaagaaatttggggaaggaaatctgatgtttggggtctgtaagcccatttcctttataaatgctatgctacttatctagtcaaaatgcatcccaagaatctgcacaaccctgaatgttcattctgacccttagcacagttgttctgctagtgtacactgcttcccttcacgcttactgttgtgttcttagtggggaggagtctcttcttgcaggtcaaactctgtacctctttcctctttgcccaagattagctgggcccacagggtcacaggccctccagtcaacctaccaatgaacagcctcagtggcccacttaactctaattgaaaggccccttttgtcatttttaacagatgtaaagtgtgtgaatttaaaattccaaatgctgttaatatacaactcgcacaatgttttttgctttaacattcattgctgacctgttatgatctaaagttctccaaaagaaagttcgtgttaatactgcactccatagaggtggtaggaatagtctctagcctgatgaaggcactctagatccttgactcagcctctgaaggtctaggacctcccacagtaccaatatccatgaatgcttaagtccctgatataaaaaggcatcgcatttgcatataacctatgcacattctcctgtatgctttaaatcatctctagatttcttatgatacctaatacaatgtaaaaatatgtaaatcattgttatactgtattgtttagagaataatggcaagaaaaaagtctgtacatgctcagtacagacactttttatttcaaatattttcaatccaaggttggttgagtccatggatgtggcacccatgtataaggagggccgactgtatttactttaccatgttatttgaataagttacctagtttaaaaaaatagctaataataaggaaaagtgtgagcaggagagagaatatgggaatgctctgtactatctgctcaatttctataaacacacaattgttctactaatttaaaacaaaacagcaacaacaaaaacatagtgatcctctgaattgcttcacataggagcagcaactatgttcacttcacatatgttaattcgtttgctccttaaaacaactctaagaagtgggtgttgttattttcattttgcagatgtagtaacagacaaagagagattttagaacgtgttcaaggtttctatagtggcaccaagattcaagtccccttatctcctcttccaaatcccatgctgttccctctaaaccacactattttctactatacgttgatcatatcatatttattgttgggcttggctaccagtcagagctaaatgtaatgctcaatgagagtaagatactacttttgatatatttgttttctctgacctctttacagtttttacagttgttataattatttgaacagtttcatctgatatgcctttaatcagtcattcaaacaccttccctgagctttaactatgtgctatgtatcaccttggactgtggggtacaaggatgaatagaaaataattcctttcctcaaagatttcggcctggtcagggggacagacccataaacttgtaattacattttgagatgtaaaggtgggatcccaaatatagccttggagataagaaaaggcttacccgagtcaaagtttgagcaggagttatctacaattggcagaggcactctagataggatgggcagcatgaggaaaccaaaaggtacaaaggtgagaaacaaggtgcctggaacctggagtgctaaagcctttttggaagtcgtgagacaataaactgcagttataaactagtacatcattataaaaaaaaattgtgatacagaaaacagagtgctgaaaacctccgtatgggtatcctcaattatttgcttaaatcgtaagggaaactatgcattgaaccgctgtctatctcacaacaccatttaaaacaattgttacagtaaccaaatcacttcagtggtttttaagaagtattttcttattgtgtgcaagagaaactttaatcatccattgtacatcaggggaagagacagaataattttagtctttttttattgaaaacttcaggatattgctgatattttaataaaagcagtctagatcttttttgtttgttgattctctataaaggatttctaggcacaaattttgatttttgtaccttgacaccaaaatatacttttccataaacgtatacctgacaattctttgttctttaacttaaggagcatttcttccttcaaatttacgtttaaattaactgttttattttaggacctcaaaatatcaattggaggctactggctcacgcctgtaatcccagcactttgagaggctgaggcaggtggatcacctgaggtctgaagtttgagaccagcctggccaacatggcaaaaccccatctctaccaaaaatacaaaaaattaggtggaggaattgggaatagcttgaacctgggaggtggaggttgcagtgagttgagatcacgtcaccacactccagcctgggtgacagagcaagactccatctcaaaaaaaatcaattggaacacatgaaaaaaaaaaaaaagaaatgtagaacaacaaagcagaacaaaggctagaactacagaaaaatagatggttaaagtgaagtgggcctgaagatcatttatcctatgttcatgttttatagttgagtaactgacacccagaaaggtgaagtcacttggctaacattgccaagttcattaacggcaaagctcagagtagagtgaattcctgaattccaggacagtgctgcaaaaattatctcctggagttctgtaaatgtaaaaaaaattgaagaccctgtgagagttgagagtttcttcctctgctccacaggagtggaaggaaagtggtcagaattgagttgtcacgcaatggcacagcagaagaaaattcctagcttcaagcaatgattggtgagttcacactgtctcagtggggcagcaccacctggaatctcatatgaggaaacatcagatgataagggcagcttgactggagtcagctttaatagccttaactttgtctccagttgccaacaaacagcagggtcagctagacagcagcagctacaggtggccatcaccacttcatctctcttccactctgcacgcctcaaacgcttagccttaggaactgtttaaccactgcagaggtaacatttttagggcaattttggcttttctggtttaaaatcaggaaaggctactgtgttatacagaagatgactgtagccaataaggaattccatgcaggaatggcctactctgctaatcaagaggtagggaccttttctgtgccctcatttaacaatctgtattggaataaaagcagaacatatgtaaaggcttggaaagtatctcctttttgattttgctgatgccatcctcatattgatgagacgagaatttttttttaagacactaaaaatgaatttaagacatggatctagcaccatggagcaaaggattatcggccctaaccatttctgctccatgtcttctattattgcctgctgactatttctgctcataagggaccatgaactatccatgagtgcaaaatggatacagcacaaattgattcagtaacatcacacagacacgtatgaataatgaggctcagttgcagtctgtcacacagcaagcatatcagtgtagctgatttatcgaaaacttgagtgagtaaagcctctttcttaaggaaggtatcagctgtttcttcacttttttggtaaaaaataaatttgagcaaactaagatcttttgtaatttaaaatgtgagaaaaaaaaaccctgaaagtagctttcactataactgacctacttctgatatcttaaccaaaaaacagaagagagggagaagacaaatggtaccaacgttaccataaaccttaaaggttcatcagagatgctaatcaatttcaaattccctaaggaaagctgtgtctttgcatgggcatctatgactgctagaggaatatgcctatgtcattaaaacaagggaaaataagcttgttattagcacccctcccctttagaagaatatcctaggatattcaatgagaaaaacaaaaggacacggtattcattccacatctatcatgcaaatacggtgggtgtagctatcaaaaccaaagagaacaatcacagcctcaggcacaacagtccagcatctctgaaacttgccctgtatttctttgtgttttcagagtagggaaatttcaaattctgaccacatgcacatttaagtaaaagaggtaggaatcagactagatgatgacccctcctatctcttctaattcccaggttccaggagaccttgaaactcaaaaataaaaaagcaaaagaacaaagattaagattttcctaaaaaagagagactacagtaaaagcatgtgttaaaatatccataatcacaacatctaagcagttttcagatgaagcaaggacagagaatatacacatagagacagaacttgcctaacagtagagagaaagctattcagtagaattctttaagggcagcaaggtaccacttagtaagtcactgagttcaagccccaaacagcatctttgggaatccagccgatatacccctaaagagaggcccaatgtgtcagacattaaatatagaggggggaaaaaaagaccttttctacaggttgtaattgaggcaagagaggacgggggagaaagactgtgatctaagcaagagagaaaaggggaaaaccagcactcaactaaatgaacctagatcagcttatagatgcagcattgcttctgtaggtcaaaagtgttaattttatgtgagaatagcaaaagatcctgttattacctctttaaacaaggcattatttttaaaagtgaggaaaattaagcaaatccagcaataacttgattaacctatttagtcatgttggttcataaagaatcaattatttaatataggcattgagtaaatttttttttaaaaaaagcatctgtaatttattcactggctctagggatatctctggaatcaaagacagcttaactgagttatgaagttctcaccaaatacttgtacatgttttcaaagggccccgaaagcagcccggtactttctgcttcaggctacacattaactaaattccaatgtgccctgcacagagcaacctcttcatcaattatttcctgcaactcttcagaatgttctttttgcagcatgtgtggttagaccctgggatcactgtagaaatccagaaaatgccaggatgcagacggacagacacacacaccccacgcaaaaacgccaaggtcctaaaactgcatgaagttgtcatcttcactgcaaagagtgaagaactgagaaagatcagaaaagctaaggaggatagagtgtgcttgggaggaggtttgctgaagaaaagaatcagcaagaaagaaaggaaagaaaagggaagagatgagcaaaaaagagaaaatcaaagatcatcttttgtttatataaatagcttctggattgtgacttttatttgatgtcaacaacaaatgaacaaacaggacaaatgctgtattgctgaactgatagcctcatgttaaatagaaacttttctccagaataaacaccatagtgcagaaagttccatggtaaacggctatgggtccacactatgagttagacctaaagcatcacacacagcatggcccttgtagagctaatatgttctttcattcccagaattaagtcactagtccaatggaaacactaaccctaccaatctcccagagactttgtgatgaacaaaacataagattagagatgaaaacacctggcaaaatgtaaagctgcaccctgctatgtgggacagtgctactcagaatgcctgttccccaagatggaaaagcatcacatctgtttaataagcaactcagtggcctcagctaaaccaagtttggttctcttcttcctgacactcccaaatccattgtatgaatggttcacacctttttctttgtgctaagattctaaggtttatgaatctgaagttcattcatgggaataaggagaaataccacacagtgatttgtgctggaaagaaaacacagcttgctagtgggcaggagatgtgggttctagtccccattcagtcactggcgtccatcctgatgctgaatatgtcatatactctccagggttcagtttcctcatctatgaagcgggggatggagtagctgagattagatagagaggcaagggcagctccagttctatagtctttaattcaaagttaatctacttttatttttgctctaaaatctaaccacaaccattctccaaagattttgaggtaattcagtttgatcatttttccagtaaaataaatatcatatcactaaataaaaaagcagattacaatgaaatatatagaataattttaatcatgttaacaaattcacacacatatatttcatactttatatataacatattctggatggtggcattataaataaagttcactttcatcagtgtactttaaaatatatatatttctgattttcctcaataatacatttattttataatcagaaagatagcattagaattaaagagccaaactactacacctgatattttcaggactgtcttccaatatttttccaataaaaactagagacataggtacatatttgtgtatgtgtatatgtaatttataaaacactcggattcagtaagaaattgtgatacttggtaaaaacaattgatctaaacaatttagagagtaaataaagaggaattataagaattctgataatgtaaattcagggcacaaaataattaaaacttgcttgaattaactcagggatgctatagctataagaattttcttataatcactttaaaattcattaagagtgagtgagcttttctgtatttttccatatgcttccatatcctctttttccatcaaatgcagtatgcactttggttccttgtgagtgaggacaatttgaagtttctaatgttgactccaaaggcatgaagtcacactcaccgagctgcatctaagtacctaactgggaaaatgttttgtgtggcatcaagtacctcatattagatcacagtttactctgtatgacagcagcatgggaagtgggttaaatgcattaagaaaataatttcaaagcccaggagagcttttgggaagttttactatgaatctttaaaccagaagcaatgactacagtgaggggacagtaggaatttcatgggattcaaaaagaggcagggaaataattgaggcacaccctgcccctaacctcctaacctctggagtctgggctggctagaattcagccccgggaccagcagcacttcagcaatttagcaccaaaaggaagctttggtccactctcctgtcctccaggggtatatgtctcagaatatccctccaatcttcactacccttgtcacaacccaggcccagggataccttctgatgaagatgacaagcagcccctgccccagccccagaataaatgaaagacagcaagattgtactttagcaaaggtggggcaagacatggaggtgatgctgctgcttcaaaatcgattgttgtgtacatcctcggggagcaaaggggagaaattctgcacttaattttccggagaaacaaagcatcacagaggattctgagcccagaccttctccttctctgctgcactgctccttctctaaggtgaacagtttcatttcctgcctgagctttctacaatgaagtccaataactcagctctctgctgtcctgacagtttagttaaacctacagaggaaaatgttacaaatacaatcccaggcaagaggggagttgcccataggctcaaattaactaccagtccccaaatagctaaccctcacttatcacacagaaagaattctgaagcaaaaccaaatccataagcaaaattcatcacgccaggaaagaggagaggggaaaataaacacctcaagtccacaactactgtttccaactctccctcctcactctgcgtcctgacagagactatgttcgcagccatccctctgcctgaagaggtaaatctgtttttaatgcaaaactccttttctctctctcttttttgtccttgagaccagcactgagctcaccgaggaagcacggcctaagggtttacacctgtgacccaaactttccattctgtgtgaggctttttttttttttttaagaaaaacaattcaagggaagtttccgaaccactgcttttccttaggccaatggttaccaacagcgacagcaaagcttttcattttcaagtgtgacccaatttatgacttacattacaccagatttcaccttcacttctttccaaggccctgcgaaggccgtcttttcttgcatactggaaagagtgaacatcaacattttaagcctctaaagataatgggtgacggttacctaacatgacaacccaaagtcatttctccctgtttcctagatcttgttctgtcacaacttatgtagaacattagaagagttaatatggacaggtgagtcctaaaaatgagtcttggacagctcataacatggcagaacaccaaggtttcaccgctttactccaaagacgccacgtaaatgtggctttgcctcttaaagcatgagccaatatgacagcaaagctgacatggtgatcatggagtgatgacagttagcttctgagaacttaagtccaacataattgaaaatcaaataaataggtagttaaataactatcagaggttttattctcatgcaaatccatcacagcagcgtaagaaatgtagggatacaatcatggtgacagtctttgttcaatctctggctagtccagattgcttgcagagatgttccctcattttaaatgtactgccatggtgtcttagtatatcacgaggggagaaaaaggcccctcacaaagatacacacacaatccaagcaggatagagcctgagatcctcactgaaaaacaaagaaaaagggaatgaactcaggttcacggctactggtaccagacatgtgcggtgtgctctgcaaccacctgccttgcccactacacccagccacactgtgaaatcaagaccgggtatctcattttcagctctcactcataggagaaagtcgggagcaggaggaggcagactaacttacatcaagtcaccttgctcctaagcacacagctaggacccaaccgcaggtgcttgtgactccaaagcacttttcatcacaccttgattccaaagacggtgctcgagttatttagagatgcagccctttgctaaaagagtctgccactgcactgccaaagcttctttcatgataccaaagttccactgtggatttagagacaatagacggctcataagtcgtgttaagccatgatgtgtcaaaggtgcaggtattaaatgctgagtcattgctatgctttgcagagataatacttcatcctccctgcccagtcagctaggcttggagaaagatagctcaagcagagccgggcaccagagcggaaatgctgggaaaggtttctctctcccagactcccttctccactcccacacctcagcaagtctcagtgtctgcctgttttaatgattcatgcacaggagaacaaggctgatgtcacggggccaaatctgggtgaatggaatgctacccttcccagctgtgcggcatgaggaatgttctcgcgagatcgacttagagaaatttgctttgagacacttgcctttctcactttctgtcacagttaatgaagtcagatctcctgtttgtacaccactcactcggtgtctacaagaggagataaggcaagctcacaaatccctagtctgtaagttagtgtggtgagtctggtaggtgagatgcacaaaggcttgagcgtttggggtgggccatcaggaaagggctccagaagcattggcatttgactccaatgttgtgggaagtgtgatagctggagctggggcaaatggaaggcgctatactaggctaagagaaataccgaagaagagataacaatcctaaattaattgggaagagcgttaggtttgtcttaagtatttcttttattcttccacagctcagatttcaagcctatcttcattgatggagccttagtctcaataataaggaaaaccaatctttagaagattactaagaggttacacagtaatttacatttaaataggtaattactgaacaaaatcgaaataaaaatctaaaggaatgattgtaatggtggaattttagacaacatgccaagtggaggggccatctcagcatctatcaaatctcatcacttagggcagtactttcaaagtgaatacctagacctttagcagtgtgaggagaactacaggtgatatgtggatatggcattaacaaacaatgaatgatgtaatgagaaaagtaactctatgaatcttctctcaagcagtcaagaaaaaaaaagtctcactatagtgctaataggtctttaacacctctctagcactggctaatctctcctttcaatagagagaaagagcaggcttctggatctgaggcttgttggcttatgacaataatatgtacattcatagcaaagggacatttggaaaaaggctataaagtttccatgaaaaaaattaggtaaaaaaaatagtgtctatttgaaagaaaaatattaagcaaattctgacataggtgatatgcgcacatggcaaaagttgtgaaggtggcacgtggataaccaaagtgtgagaaatccggtctcacagcctgttcatcaggcagctttacctttgggctttattgacctagaagtaaaatataagagtcagagtcagcaggaaaagccagctctgagtgctaatggcagcggacccagaggcagggcatggaaatgttaccacgctgtctttcccaggcagaagcaggaaagagaccagtgacccactgtccaaggtcctttcctttgcacagcaaatcaaaaatcatcagaaagaggtaacaaacataggctacatacatgtggacatcaaaatcaggcttagggtttttcatgggaaattcataatcatattatagctataagaatgaaacatttacagccaaactttcaattatgacatagcattttgttctattttcatgatcacacttcgtttaatgctcaatatcactgacatcttggtagaacggatagcatacaagccatataccattctttttaaaagcagagttatgcaaaatgtgctttaaaacatgttgtgaagaaatgcaaaatcacagtttttaaaatgggaagaaatcttgactgccctttgttttgtcagaaggaaagtttatcacccaataaaaaagaaattatacttgtagctttaaataggcaagaatcacattgtcaaaatgcacatattttcttggaaatagtcacccttaggcaggaaaaacaaaattgcttttaatgacagaaatttttagattgtgcttggaagggaagggtgtttataagaaataaagctaatgagtcagagagcaaaataaaatgaatggtgcagttcctcacttgacagtgcataacttgataagaaatcaagctctgctagcagcaatcattgaaacgtccattctgaactgaatggtgccaggtgactgtccttagaaggaggcactcctagcctggaggtgcttttgaaatcttccaggactaaagaatcacacccttagaaattaaggaatgtgttcctgggtgtgcaagagttaaaacctcaccaatgttggcactctaccagctttcacagttcttttggttgaaagcttacattaaaactcatgaaattaaactcattaattaattctttgtgttttcttaacaaggacccatcagctacatgtgatgtagaaataaacaattgaaaaggaaaaaaaaaataggccatacaggttatttggcatcatgtaagcattaaggaaatacagctgcttcactaaatgacattttttaaaaagaacaagtctgaaatgttgttgtcaaaccagtttatgtgttgataggagcacagaatttaattacttatgggtgatggaggagaatatagattctagcacacctggtaaaatttaaaccacattctgccacaaccaccaatgaatgtttagcaggaccaactaagtgcttagcattttgaatttgcaggatccagtgcaaaataaaaatgtggggccccttgttaaaacattattaagaatttcaagatggtagcagcacaacattcaaccaaacaccaggcccttttgaacactgggtcccatgtgactaccccagcccagcatccatgaagctgttccctgcgctcctcaactgcagttacactttcaggcccctaagaaagtaccaaaccagtggtacagacttgcccatcctacattcataagaaaatagatcctcaaatgccctaaacaatattccccttaatagattcaaagattgatctaattttggtatttcctctttcttttatttttttttgcaagcctgaataaagacttctcaaaatatttcagtttcctgctgcggagctaagccaaggaatggcttggttgttaacaacaggcagttcagtatattgtaaaggaagaagttaacaatcatctgaaagtcaaggcctgtagcccaccaccttctgactgaccttgccacagtggtgtctttcttttcttgttaatgtgtctttcaacactcaaacaggatgtcaactatgagagaagttactgccccccctttattttttttttttaccacgcacccaagagctgtttccacatcacaagaatccctgttactttccagtgaatgactgtgcattgtggcttaatctcaaaaggaagtagacgtataataccttaaaagaaaacaaacatgcacacacaaataccagaaagagaagtcatcccacaaattccacctctgaattctagcatcatttcttgtttctccatttggaagcttcaaattattctctttaacaactctttctagcaatgaaatatgaagaggtgatgatttcctccaaattaggaggacattaacaattaagtgttaatgcgaacaccgttaacagtaatgcaattataactgtattccacaaagggcaataggaaataattactctgattctcaagtgatagatagttccaggagaatgagattctcagtctaaaattcattaggaggggctctgaaactcacatacacacctacagctggagagccgctcctttgctgtaataaccctgtaagtgccaaatctggcattctcttgccatctgcttttagtcccaaaaaatggcaacagtgagggtcctgggaacactaacttgctgcttctggggctaccatacagcactcagatcctgatagggcttatctgaatagccagagatgctattttaagcctccaagctggacccaaagcaaatgacacccaattgttattatacggcttctgaggatgatgaagtatatccaaggaaatgactaatctccaattatcatatgcatggcagcattgagacttgaccagagagaatggtataatagcagtgaaaccattaatgtctgtgtcagtcttatttgattaaaattggaggactaaacagagaagctgatagaatcagtcagttgctgaagttttctcctaatgatgcatagatgggaattttaaaatgtgcctctaaattctatatcaattctcaatttcggcactccttcaacaattcataaattcttctcccctttaatattttaaagattaacattgctgataatggataaactaaactttttgaaatttcacttctctattctgtactttgtggtggacatgtccacaagaatgatgaaatgaaatcaggacaaggcggaggcaggagaatcacttgagcccaggagttcgagaccagcctaggcaaaatagcaagaccttatctctaaaaaaaattaaaaataaaaatacacgaaatcaggagtaagatgtcttttttatctcttttcttcaagaaaaacccatctactaagttctgatgatttctttcttgatatccttctcagatctctcagaacccattttaataccgcaggctcatgcaatactattgtcactcatgcaattagtataattaccttctagctggtctcacttgtctccttatcgcctcccaattcatcaggctttcccaggttaggaaccccagtgactccctattctgtaaaatcaattctaatttgtgcttggtccttcgcactccccatattttggtagcatggaacctatccagcctcaattcccaggactcttctgtaacctggtcttctcacctgctgtgcaaactcctaccttcaggcctctgttgattccccctttttgcctccaattccctcactcctccactgggctttcttcagtggttaagttctgttaagctttcattaccttcatagcccaccaagatctcttccctttctgagactgcacaggactgaggatattattacacttaatgtgtgcagttacagagattattttttctaaatctgagacatggtcccagtaacattttatattccttggcattgataaggatcatgtcactatcttgtctttatccttcattttggggcacatggtctacaaattcatgctagtcagttgatgatagaaacattaatcctccaactgaataatgtagcctggataaccgataatgaactacttctactaataggtgaatccacttgtaaattatgggtagggcaaggccatgttgcttagtgatggctggaccatggattgtgattatttacaacagctgaaaagatgtatttggtgatccatccacatgtgaatggtaactaatgaaaaaagaatttaaacatcaaagaatacagtattctccttcatagcttggtgttgtagctataggggataataaagacagtgatattacatatgtagtagttcttacatgtagttgaagatttatctattgtttcttttaacatttaataagttatatccatgtccatacgttttagaaataactgctatattgtttcaaagagtgcaaatagccttaagtctgcagtgatatacacaagttctgaaaagctatagatattcacagaaaacacatgcacaaagccatacacacaaaatataaagtttgattgaataatttattattccagaaaaacaagagtaaatgtggatattaaaggaaataaagacaaatccattctctacaatgcttgggggctaatttaacctacagtaattagacatctagcagatctcacaactagtcaaaccagtacttccaaacacttgttttattacatgttttgtcactaggttacgatggcgtcatcaaatatttttatcgtaagcgtctatacttgcagtgactcaagaccgtgtttctctcagctactgcaaataataatgttaatagtattagtgatgataaaaattgtaacactttggatgttaaaaacactagaagttgttagtaaaggtctctggagatttctactcagaatttaaatgagaacttgagataattcttacactcctggctgcaaattagcaaccatcactccacagctttcatattaaaactatgggtacttgaagactttagtcattaataaactttgcccaaaggacattagcaaaaggcatgcttcaggtgatgggatagtgcctcccaggacagtgggacttgtcagactgtgcaacaggatcccatggacctgtctcaatcaagttaattagagacatctgcagcacagagatcaagccaagccagctctggcagcttatttgcaccaaaaaggtacaactcatgtgggaggtaagagagctagaatgacaaacagatagagatcagtaacgtgagctggctcagtcatctgagtgtactcactgttgaaataaagctggtaggaccaagggatgcaaatgtcgagctgatgaaaaggctgaaggatatttgaacaaacctttgatattcttagcccctgcaggcatctcaacactgtaaatggagcccccagtctccctccccccagcacctgcttgaactcttcattcacctataccttacctcctggggttgctctcactcattccagggaccccagccaccgtttttctgcaaacaactctgccctcttccaagatgttgttactgatggagatctgatgttggaagttgtagcctttgtactgctgacattggttgaaactttgcctctgaaacttacactctattcgacccaaatcttgactctaaaaagccacatcattccccattgcttccaggtctgattttttttttttttttttcagtctgagtctactcatcttagtggagtttgggtctttaaatatttcttttattcattctccttgttgatatcattcttgaattccctaaacatgatagcagccagcttctaatgaattccacttattctacttttcatatacacaccaagaagagccaggtgtctgctcactggggaggcaaatagaactatgcccaaagtcagaatgtgactacaacagatttaattctcaaagcagaaggaatctgaaaatacaggtagcctaacactctacaatttggtgtggaacagatgccaaaccatgacacattcttccagctctagaacgtgttatgatccgatattctaattcattaacaatcggattttcacttgaatttttttttttttttttgagacagagtttcgctcttgttgcccaagctggagtgcaaatggtgtgatctcggctcactgcaacctctgcctcccgggttcaagtgattctcctgcctcagccttctgaatagctgggattacaggcatgtgccaccacgcccagcgaatttttgcatttttagtagagatggggttccaccatgttatcaaggatggtcttgatctcctgacctcgtgatccgcctttctcggcctcccaaagtgctgggattacaggcatgagccaccatgcctggcctcatttgactttaacatccacatagcaaatacatgactatcatgcttttgacacagatctccataaaagacagattgtaaactgatggcctgtgaatcaatttcggccctgtacacttgagtttagccagtacaatgtttcagagtcatctgaaccaatatttagaaacccagagatttcaaataaagtacatgtttctaccttctcttgaaaacttggatgatcagatgccactggctccacattcttcttacacagaaatattctgctggagtggatgacacccagtttgtacaccaggtctgattttctcacttaggtacctgccggctgcattagccatgaaagtttgcatcccttgccaaagcacccacgcctttgtcacttttcagtataccaagtaatcaataatattttacagattgttttccattttaagaaatggtcatcagcactgaacagccacaatggagttttcaaggatttcaaacagtctgagttcaaatctagtatgtaaaaatttcccagaggatcagaaacccttgttgagttttcctccaggcatgactaatacaatacagggaggtgctgtcatgcaaccatgcatctttgcattacgaacgaggaatggtttaattgcaattcacccacctatagcatcctgggatggctttatcctgttgaagggcgtatctttaggccactaactttgttaaaatatgtcaggcctgttggtatcaaatattggctaacacaggaaacaccacctcaatcttgttaaatatttttagcaagaggccaccatgttccagaatgatgctggctgacctgccagaggcaagaagaagccccgaagatctaagacaacataaatgaatgactaattaagggccattctaagggaaaggacaattatgttgactcataactgtctaggttcctaccattcaaggcctatacaatttacataaaaatcattgtcattagaaaagtttctgtcccactgttaagacagtgtttgtgcaatgtgaggttacttcctgcttccacaatatgactgtgctttactaaacaaacttctgagctaagatgtttacttgactgggaaatgactactaataagctgttaaaggatgtatcctcaagttactacttgtggcatttgtaacacgctccctgttgaacaaaggtgtcacagtagcacagtgaataaacaatccttttttctccctgtaagttatacgatattaaatgttaataattaatttgtctttgtggattaacatacaagagcttttcaaacaggtactggtgcaaccccacccttgtgagatggctaatcatttcacatacttcacacttacccagctatcagtatcactgacctcagctagcaaagtgtgaaacggcagatggtttgtagtgttcagtaatgtcctatgaaaatgtagcacagaaaactgcaaaaggttttgggagagaatggtggtttatatgaacttttcaagaaactcaagagaaacaaaatgccaccactgtccacgtcaaaggatctggtgaggatcctgggagaaaaatgtcaagagattctaaggctttcagtagcacaatattttcaaagtgcttcagaagttatttcaatctgctgcattgctaaaggggaacagagcctgaaaagccagtataattttgaaggctgttcaaggactatgtcagcaacattcttaccctgcataagacttatacatcttaagacagaagatttgtctagggtatccacaatctgattacatatttctcacgagaactaccccaaagtgcaagccctttgtgttgttctacctgagatgacatgacttcagcctcaaaatacccaggctgaactgtttctggagcaatgagatgttgttaatgaatatcaacacttcccagatcctttaaaaatgctaatatcaaaatattttacaagagtgaatttcaaactgtgttcatgtttttcacagcacggcacctgtttgaaatggtacagtttgaacatctataaaacatgagatggaagataccaaggtggcttgagagtttttaaactatatatatattttttttttttgagacagagtcttgctcttgttgctcaggctggagtgtaatggcgcgatctcggctcactgcaacctccgcctcccaagttcaagcaattctcctgcctcagcctcccgagtagctggggttacaggcacctgccaccacgcccagctaattttttgtgtttttagtagagattcggtttcacaatgttggccaggctggtcttgaactcctgacctcaggtgatccacccacctcagcctcccaaagtgctgggattacaggagtgagccactgtgcccagtcaagaactatattcttgagagcaaaatagagtatattatacttagaatggaactatgtaaacctttacacatctgtattttcaaaacaagaacccagagctgttcaagtgataaacaaaatcatcaggtggcttgtttagagtttcaaaacagacccttctattcctgctgtttctccctctggtttcattaaatataaaacaaatgaaaatgaccagttcaatagggatatctgacagaatttggggagaaacatttcattagctttctatgaagtccaatacctgtaattttatgtatcaggactctctgatttgaagtccctacagaaatgctttattcttagtccatttagctgcccttaaaatgtttattttttctctttctctctctctctctctctctctctcacaggaacatccaaactgtgttgtcacagtgtataaaacagaggcatattcctttcaggttatactataccctgactccttgatgaaatgatttgatgtggttcacaaatcagaatcagacagaatgaaatcattacaccttatatagcttaaaaacaaaaaagccagacataaagtggacaggaaatcagtcataatgaaaaactatttcaagtcacacatttgctgatttagtgtctatttgctgagcatttgtatcactatgtgctaggtgctgctgggtctgtgacaatgaacaggaaaggctgtgtggcaactcaacacgaaagccagctgagcctcctagtaaccaaaacaaaaagagaaacatcacacagtttcaaaagggaggttactggcttatcaagagagaaaaaaaatgtcttggtaagaagctacggagaaacataaggaataggtcaatgtgtagataagagatactaatcataatattaacatatagatatttatgtacctatgtaagactttctcttccactaaaacagatgaagtaatttataatcttttgaattaagcaatcaatagaataatatctgcagaaactcttatctttctggactgtttaaaggtacaaatctagaaccaaagtcgcatatgtgatttaaaacaagcagaaaatacatattggcaaagggctttcttacatgaggtattactgctctagaaaattgtctacattaatttataactgtaaaaggatctctggcaattacatttatcctattctcttatttttcaggtgtcttttggggatacatgttataaatcttttttatttctctatataacccttctttcttttgggtaacctgatagtaataactaagccacaggtgaaaggtttctcaaggtgtggctattgtgttctcttgactaacttctacctgcactgtttcctttttacagggtggctcttatgtgactaatctaggccacaatatattattttttttaagttaggtaaaagtaaatgtctccagacctttaactatatagtactttatttgctaaattatgcaaatcaatataccctaaatcaaatacatacctcctctaaagagagttccccttggttttgaaactcactttaacaagctatcaatcagaggctgatatttagaggtagcataactgattggtagcagtgggatttctggccatttttagtgataaccaccgaaatacatgagcagggtttttaaaccctaggaaggaaaaagcctgaccaaaaaccctgacagatatataatgccatgatagaaatgctactcattatgtcatacctaataatccacatgtacctcattactcagctgtttgtgttacaccctgttgccaaaggaagctccctgcttctcctcctgatccagcaattaatatgcatatcaggcacagtggccagacttctacggagaaagaggaggcaggcaagagatccatagtcataaagacctaggcgagtaatattctcagcattattcaggaatgtttagttgcttgctcaaatttatcattaacaaagggcctatttcccaaaggcttccactgtgtaattagcaacaacaaatactgcccctactccggttaacctatgggattagttacaaaggttttgtaaatttcagaagatatctacacagatgtcgggagagcacacacgcaaacacacagtgcagcataatggatgcagccatagccattaagtagtttaggatttgtgagactcagacaacgaatacattttatgggggaagtcataaaagtcagacaggaaaaaatatacagcatgaaagttgaaaacttctagacagcatgtaaaaagtacggagaagtagcaggggcaaaggaagaaacgtaccaagtggagctcattggtcttaataaataggacaaggtcacctgagtttacttctggaaccaatagaaatcctgtagtatctaattatttttgtaaaatgattattttcatgcttctatttaccattgtcattagataggttcatatttcattagtctgcttactaaaatgaaacttttcgttttatttatggaagtttttatacttctctaagcctgctccaaaaacatacaattaagcactgctaacctgttgatcaggaaagtatactataccaaaagagatgcaaagacatgttaaccattcatactgattgaaagggctcaatttaagaaagtaattttaatttagattaaaaaataatctgtaaatgacagagtctggaatgacattatgaataaaaattaaggctaatgaccttatcttaaccataaattactttagtttgtagagatttgttcacacttggtaagcagcactgttcatttcttatgatgggtattcgtgtttaaacaagttggcaattttcaattcagaagtcaaaatactgtcttagttgccaacaaaaataattaatgaaacacttctaaccccaggggtaaatatgtaagcaagtgcatggtaatggataataaaaatagcacttccttttacatatggtgctaattaaaatctgatcagagtaataattgagcagtgcccaggctacccttgatttttcttgtcaggtttcaattgtttgacacaaatgcactgacctcaataaatgaaaacacatttaaaaaaaaaaaacaacctaaattatagctatccttattcaggccaacaagtgatttactgtcgctgtgggttttgaggttactcgagacatggaagttttctagggagccactcattgccactggtgttcatgaacaagaaggcaccagaaagtccatgagactttcattcagaggtttttccccactgaatacacaactccctccctatgcaaattccaattaaaacaaaagaataatatattacctaaccaggggttgaatgagtgtgtgacaggcattttgctaagagctttccaggtattatctcaagtcttcacaacatcctgatgaaaaagaatcattactggtcccatcacactgacaaactgagtctcagactctggctccagagctcatggtcttaatttgctacactatcttaaagtaatggaaaaaatgcacaccagtatattttaaaaaactaaaaaaggaaagaagattctgagtacaatactcgtactctccgaaattaccctttttcaaaaagaaagattaaataccaaaactcaattgaaatcatactgatttaattctacaatgtgatgtctaaaacctctaagtacctgcttatataagtaaaaacaagtcatgagaaaataagaataatacatatttccatgtcccaagtgccccaccaatatgcttcatattcacaaagctctagttaaaatgggaaaagccaacagattactattttaatatgaatgcttaatgaaatatatactaatactcacattcaatttttccataaatcaatgtattgctaaaacagtatacacttttatccactcaatagtcattacttttatttaaaattaaattcaactgtattttgtatctacctacaacttcttgccctgtgaaggggtacaaagatgtatcaaagatgctctctgcttctaagaaattgtttattaactggcacaagaaatagcatcaactataatatctggtagagtgtaaaaaagggtagagttcaagttcctaaaaatgttaatgcgccaggctatacgtaaagcgctggcctaggcactatatggatcaagactaaagacacaggcactgtcctcaggagcattctagtggagaggggaggtatccaatacaccaattacgtgaatacctggcttcctttcttaagtgtataaaaagcaaataaagccttaaagactgcttcacagagctctccatgagcagggctggggatacacagaagccagggaaaacagatacaagactcttgcagtcagcggtcccagaaagacaaaatgagggcttgtccaaaggccttgtactgggagtgaaggcaagtggaaggaacgagcaatggggacaaacaggtctcaaagggtgggtgactgcctagaaatgagcagaaggagaacttggaaataacaggtctgaacaaagagacagctttatatgacagaataaataagaagtatgttaggtagacaagagaaatagatgtggtcactgacttgtggagcctgaggagctggcaggggacattcagcataaatttactgagctcctattacatagcaggcactgttctaggatccagaggtacaagagtgaacaaaacaaactaagaggtgtgcagcaagcaacagggtaaagttagactctcctgctgacaggcaaaagccagaaatacagactgagaagtgtcaactgcaaatgagaaaaaccctcggttctcctgtattcaggagagtttcaagaagagagaagagaggctacaacactgaatacaggagtgagttggggaaacaatctggctggatgagaactgaacttaaccgatttgacatttctgtgactgttgagatggccttctccatcgcactgggccaggatccagcaggaggagatcacagcaagtgtgcctttgagaagtttgttattaaaatgaaataaaggatggtattttgatacatagttctctgagaatacagagaaagtagtgattcattctgaccaggagatctgggaatgctgatggttggcagtgaggatgtcctctgtttttgaacaataaatgcaggaaaagaaactgaaaagaatgccaggtatggtggctcatgcctgtaatcccagcactttcggaggccaaggtgggtggatcacaaggtcagagttagagaccagcctggccaacatggtgaaaccgtgtctctgctaaagataacacaaattagttgggtgtggtggcacacacctgtaatccctgctactcaggatgctgaagtaggagaatcacttgaacccgggaggcagaggttgcagtgagctgagatcaccccattgcactgcagcctgggtggtagagcgagactccatctcaaaaaaaaaaaaaagaaaagaaatggaaaagggatgatagagagtcagggttacaataaggtctcattacaatacagctttaaacattagaaaacaaacactgtcttgtgtaatcatacacttctaagttagacatatttctgaacaagataaaatgtgctacataaaaataaatgctggctgggcgtagtggctcatgcctataatcccagcactttgggatgctgaggcaggtggatcacttgaggtcaggagtttaagaccagcctgggcaacatagggaaacccttactaaaaatacaaaaaattagccaggtgtggtagcatgcgcctgtggtcccagttattggagaggttgaggtgggaaaatcacttaagcctgggagacagaggttgcagtgagccgaggtcgtgccactgtactccagcctgggtgacaaaatgagttgatcttgtctcaaaaaaaaaaaaaatgctatttttgtttaaattaggcaaatatacttatctgttatttaagactaaaaacctgatttcttggtcctccatctagaaaatagtctgttttaagacaaggaaatagttcttgtttaaactagagaatgagaagtctgtcagacacatggccccactcttgctccaagtccttctcacctattctcagataagacccagatcttgggaaacaaattaagggcgcatctgctggattggacctagctgcactgggagttgccagagtgctctgagcagcatcaggaattcctctgggccttgtcgtgatatcatttgcgcaatgtagcctgtgatggcagaaaattaagctggtatttatacagggtattagagaaggaccctccctgcaccaggcttaaagtgacaaaatgtcagcctcaatcatcccacaggctttggtctccctctgtaacctctttctttttggctgctctctctctctctctctgtctctctctctgtctctgtctctctctctctctctctctctctctctctctctctctatatatatatatatatatatatacatacatatatacacatacacacacacacacatacatatgacactaacagaaaaataaattgaaaagagcactgaggcagagtgtatttcacgcactggtgccaatgtttcatatctcatgaacctcgggaaaacaattcgtagaactaattagtttacagtgtttaagcagcttgttcctcgtctttaatcttctttatgtaatagtgtgaacaaagccatattatcttctgatttttttatacagtttaacaaatataatctcccttttctttccagagattacttcatttagacatcaaactatgttgttgttgtttttttcccctggggagaggggatataaataaattgacatctattcacataggtctcaatggtctaccagatccacccaggccctaatcctctttgttgtcatggaatccacctggcttaattatatttacagttttcaacgacaccacatggcatgcaggttttccctgaactctgcacatcttcccgaatcctagctataagtcacactccagctgctgtatccgtctcggattctagacggtgacaaggcactcttgcctgaaactcagcatcaggtcctcaaagaatagagcctggataaatctcccctccagtatttttatagcctactaaaagaacatgatttaagagaactcctgacctaaagccaggggatgggaaatagatacatatgtgtacaaattagttgggtggtcaggggagcaaagaagaacaagatacttaacttacaaaagttttatcttaaaatactgctcacaagtatgacttttaagagaaattgaactttttgtgctttctgattctagataaatatttagttgctaagctgctggaatgctatgagatacattttgggtagagtcaaactgaaatccaagaactgggtaaggctagtgttgaagtaattattattcatctggtgggtgatgctgcacacaaataactacttgcactgctaaggatttggagcagagttactccctgagagagacacttttcaggtggcagaaacctacctcagacttttatttatacactggaatccacattattaaagaattttacagtcttggaaaaacacaggacttggtgcaaactttcattttgcttgcctgagaactgtgtactgtcccatggtacccatctgccttaaagttcactctgtccttaattgtcaaacagattcatggtaactcctaattagtgcaaaacaggtaacacagctgcgactctgcaactgctgaacacctttagcatctatatcaagctaagctcaggagccctctctgctctctcccaaggttaatggtttcgagtcttctgagaattatggagtaggtgcccacagtgagagagggcgcctggttctccaagccgctgttcccactactaatagagtcagcataagaagcagccagtttccagcaacggtaacaatggagaaatttctcttactgcacagctgccaaataactttgaggatctgattcagaactaacatggaagatttaaatggatccattgcaacagacgttttgcatgttggcacactggaattagaggaactaatcagagccagagtggtaccagatggtctcttgagaattcttctgagtttaagatatgtgagccaatgagacaaactgtataattgcccaagattttactctaagagcactggcactgggagtaagaccactaggaaactcagctctgccactttccagctgtaggacttcaggcaaattaattaaataggatggtggtgaagaattaagtgagatactgtatctaacactcagggtacctaggtagagcacagggaagatgaggagctgttaactgtgatagttatgattttgtattttttttttttagatttctgagttgaggaatatttgcaagcaggtacagtaattacccaattcagatgtttatagaaaaagaaacacatcttaaaaataaaggtaccacaaaaaacaagaagtagaaaattggaagatggagagatgaaagaaaaatgaagaaatttcagagaaaaatgaaaaaacaaagcagattttaaaaagaaaaagaaaaaaaggtaggaaatacaaattaagaaatttcagagaaaaatgaaaaaacaaagcagatttttttaaaaaaagaaaaaaggtaggaaatacaaatctaagaggagggtttgaattcctaatcctgttctttttccttgcacttctattcaaatcccttttctgcatctcaacttttgtctgcactagatggtccaattctagccagacttcaacttgtagcagtcccaaggtagaaatgactagaaaaaagaaagttccctcttagctatgaagaatgaaaaacattaaaatgcaaattcaatgtaaaaaagaaagcaagactatacacacatttcacagtagcaaattctcaggcagaagtggaagccagcaagtaaccccctgaggtgtgctagtgtaactgtttcaagttttggggatgacagataaacagcaagtcctattactactgaatgaatctctctctctctctctttttttctctgggaagaaaatgtttgtgatagaattggtccttgagaaagagtgaattgatctgttagctttctgtgctggaccagaaataattattgccatacctacttcctatggattatgttcaaaagttagagatactcacttattctgtctttatgctatggggaactaatcggaactggggtttgcttcactgactctcacttattttaaaagtcaggcttagtaggaaagaaaaagtcaaagagattgaccaagaaaggatgaaatgttcggtctaggtaaacaaacactgtctcagataaagttctccacgggtctcgacctcaccttctactgcgtatgaattcattttacaatgttcgttttttttaagctagatctttgtgtgcttattttcaacaggggatgacaattgatttgttttctattgaacctcgccaactggatactgaagcgagcacggcatatttagatgcccttaaactttcaggttcacctttaaaacgtgccaagacaatgtcatgttgagggtaaatgtgcaattttcactaggctgagacgagaaatgagtgtctcgcaggtgaaatgacattaaaggcgttacagtaaaacagagaccaatccttattgattcattttaactcaaataaaattccaataatttgatggacatgaaatagcaaacaaaggaaaaaacaaatcagatgattcctgagtgtgtgtgaaagagcacccaggccctgctagaaaaaagccacactgccaaattcaaccctatgtatattcacaggcacttatttagcctaccggcttctccttcaggagtaggactggtaaggaactttaaaagctaaaagatatggaagatacaacctaatcaggttcaggtagctagagaaacaagacacacccataagaaagaacttatgatgataattctaaaaaaaaatgcataactacatagtggagagtggttcgggtaacttatggaaatcctgaggctataaaagataaaagaaagacatcagtttatagagttcacccatatctaactttcttctccttctgggcgtatgagagtattatacctctctactaccttagagttaggcagagttgtgggcggaaggaacatgagtcacttttgggctgaagcaagactcttcagtgttctcttatgtggtggtttgtgttgagatgacaaaaccacaagactgaagaggcctctatcattgagtcacacacagataatagttacctgccttaataaactctgtcaaacccctgagatcctggggctgtttgttactgcagcacaatatattctgtcctgacaaatatagataccaaggcagggaggagctagagaaagttactatgaaaagaattttagggtctcctcagtgtatttatactttagtttccttccccctttggctgacctgtctgcctccaatatctctcaaatactccacattgctgctagagcattctaagacctacatctgttcacatctctgtttgaacttcaaatggaatcgcctggcacaaaagataaagaacaacttccttagcatagggtcaaggcccatggtatctggctctgtttcccaatgttatttttgcccactagttcccatcctgtattcctgccgtcagcactctgattgagccacattctgctctgcctccatgaactgggacacactgctgtgcctgtaatggcccccactccctcttccccccgggtgaacacctaaccaacttctggcaggattcacttcctctgtgaggccttcagctcctctctcctccctcagcactttgtgcattctgttacaaaacactgttccttaaaaactttgtttaatccccttccaatggatagtgagttgctcaaggcagtgagtgattcacttttgtttcccccagagcatctagcacagtatctgacaagcagttagtatttgcagaaataatgaatgaataaaggaaagaaggaatatctgcatggctgtgtccatgagagtattaggcagatgacaggggcagagtagaggtttgttggatagaagtaaaatgtaaatgtaagcagccagcaggtgtcaaattacaaagaatgagaatttttcacttgatccaaaaggtaatagggaatcatgataacttcatgagcagcaaaatgataattttgttcagccctgtagcaccttgtgccttgaatgtcagctatgtttatgccaatcttattcccccttggactgtaaagctccttgaaaacagggtttgtgtcctaatcatatttgtatcccctatagcaacaagcacagtgtttgtataacaggtgccaacaaatatttgctgaatttaattttacaaagattactccctatgcgatgaggctggatagaccagctagcagactactgtattatatccaacattacatgggaaatggacttaaaggggagtattgcctatggaaatgtgaaaatagaaatctaagatggtctaatattccagtcagcagcctttagggtctctaatatcaattaatgttttgagcctggggtcccagaaaaatggtggtctatttaaaacacaaatgttgagaggaagatttgcttttctcagggagtacatgagtcccatgtgggagataacaaaagaaaatatactagagctaaaagcagctagaaatactaaccgctgtatacaaatgttatcttatcccccatcttgcggcttagttcaatttttttattgattgattgattcattcactcactcattggttttatttttgtaaatttcttacattgtataaagtaatgtttctgaagtttattcaagtctatttagattattgtctgtttcacattaatccccaaagtcaaagacggtgagtgaagtaaagaaatgatgtgctagactcttctgctttgggtttcccagatatctctagttattctctatcagaaagggtttgcaggggcttcctcttgttgaagtaccctttttaaaactccagctgtcagcagggaatcctacaagcatcaaattattttacaaatcccaagtttaaaagagcactccattcagaagctatacctggttttattatgactcacttcttaagaagacacacacacacaactagtgagcccttaaaagaaacattaagaccgaaaaacaaaaaaactctttttttttccaagacagcgtcttgctctgtcgcccaggctacagtgcaatggcacgatctcaaatcactgcaacctctgcctcctgggttgaagcgagtctcccgcctcagcctcccaagtagctgggattacaggcgagtgccacgacgcctggctaattttttgtattttttagtagagatgggttttcacctgttgggcaggctggtcttgaactcctgacctcacgatccgcctgccttcacctcccaaagtgctaggattacaggcatgagccactgcgcccggccacaaaaaaacctcttttaagatactgtccaaagcctgtacctgagggattcagtgttatacctcccaaaataaaatatggatttaaaattcaaggtatatataataggttatcaataagttaactattaccatcattacaatatttcatttaatctattgcaaactcatgtattggaccagacaaaatttgtttgtttatttagatggagtcttgctctgtcacccaggctggaatgcagtagggcaatcttggctcactgcaaccgccgccttccaggttcaagcatttctcctgccccagcctctctagtagctgggattacaggcacgtgccaccatgtctggctaattattgtatttttagtagagacagggttttaccaagaccaggctggtctcaaaatcctgacctcaggtgatctgcctgccctggcctcccaaagtgctgggattacaggcatgaaccaccgtgcccgtcctggaccagataaaatttaaaccaaacttaacagattaaaattttctgtgggttaatgttaaaatcatacctaaaaaagttttagtccaatgtgaacctaagttcacattctaaaaggtacctggaacctcaggtgccttcactggaccctaaagcttccaagcattttgtgattgatttgaccccacctaccccccccaccaagatctaacactaatgtttcattcctgcaactgaacattatcagtttttcatatcatttatttgtggcaaaatgagaaaacatatccatagcaaggactatgtacaggaaagttctctgagtggccttgcactgactcagttatgctctttcttgcttgtagctctcaagaataactgtaccagtgtgctaggaatgcaacatcctgagataagaggggacctggctgaaacagctggacttagttccaatgtccccagaacaggatgtccttcaacactttagcccagaagatctcatgactcagggtataaaacccagggtgggtggatctccagggtccctcagctggggtacaagtggggcatgcagggacaagattccatctttccttggcagcttgcttgaaccatgggggaccagctagctagcaattaattctaggattatgttattccttgatgcctatctatagataataaacccgctttgtataacttgtgtgcttgggtgttctgtctcactagactcagagaagttggtaaccagtgcatagtgaacttgcttcacactatgtcatttatttgtttatttatttatgtattttagtgacctgatcttcctatggtgcccaggttagactccaactccctagctcatgggatcctcctgcctccacctcccaagtagctgagactacaggtgcacgttaccatgcccagctattgcttttaacacatcccacccatgctttcagttaaacaattattctatctccctgaattgcgtgacattttccaaaaaaagaatcatcaaatgaatcctttcaaaagaaatcaagcatctcttgcatcctcaccctgcagcattaagatgcaggcctgccagcgagggggtgaaatcttcaccctcacctttcagggaagtgcagggtaggctaccacctgcactgcaaagtttatccaacatgagagttcctttggcagggaacattaaccgctgacttatgcttgtcactgcataggtaaaggacactgatacaggtaaagaagtctgcatgtgcactgtcatgaccaatgccttacagcggctactcagattcctctttacttactgtgtcaccatccagtggggaaaagcacctcagtattaatcctagttacacatactctaacaggacatgatcttaaccattagggcagtattaattaaggtatcttgcagagatcctgctcattatatatttaaaaacaagatgaggtttcattaactcttttactttcaatcatcttcaaactcagctcctagaaagcaaactgggttccatacttgcttaaggcttaagaacacattttacatttattctcattcaagccacattgtgatatgaagtgatttatgaattagagagcacatgtgttatcagaattccgtaataaaatgttcagagactcttggctttgtcaccattagggacaggacataggcttgcttttccatggtctggccaaacggcctccaacgacaggacaagtccccacctccaggcatattaaaaattataacatggtatatacttcaggcagcagaactcttaattctagcattttctcaaggcaatacagacggcccctccctccctccttcctcccttccttccatggagttccgctcttgttgcccaggctgaagtgcaatggcgtgatctcagctcaccacaacctctgcctcccgggttcaagtgattctcctgcctcagcatcctgagtagctgggattacaggtgtccaccaccatgcctggctactttttgtatttttagtagagacgggtttcaccatgttggccaagctggtccggaactcctaacctcaggtgatccacctgccttggcctcccaaagtgctgggattacaggcatgagccaccgcacccagactgttctttcttttttcttggtgactggaataagggaagtctgcaatttttatgactttatatgtgtatccacaaaatctatgtgcaaagattgcctcttcagaggggaactgaatagttggaaaataggagtgggaagaagacatgtttttcactgtatacccttttatagcttttaagttttgtatcaggtatatgtattatacattcaaatactaaaaattaaattaattaattttttgagacagagtctcaccctgtcgcccaggctagagtgtgcagtggtgcaatctcggctcactgcaacctccgcctccagggatcaagcgattctcatgcttcagcctcccgagtagctgggattacaggtgcgcgccactatgccaggctaatttttgtatttttattcgagacagggtttcgccatattggccaggctggtctcaaactcttggcctcaagtaatctgctcacctctgcctcccaaagtgctggaattacaggtatgagccaccacccctggcctaaaaatgtaattttaaaagtacaaataaaagcaaaacaactacaaactttcctaaaccatgtttaaaaaaaattattcagtcttataaagttacaaaaactttttaaaaatctaacctttaaaaaaaatattcaaaatacattttggaaaaaatgcttcaaagattttatatctaaaacactgcacctggacactgttaagaaacagttatatgtcatccttttattatgataactattcagctagaaagatcattacctactttgacattataaaagttagtgaatttaaaaaatagataatgtgtttttaaaggaaagcatgttatttttccctctaaggtatgcttgacaaaagttcagcatttcaagtaaatacacattatttcatttatcagttgtgatcatctcattctcttcagtatgacttaagaagcttcaggaatgtgtttattctcacctcagtcactctcacaggcaagactcccattagagaaagaagccaccagacgccaccagaaccttaacaaaattaaggataccttagggctctcaatttcactctgaaagaaaatcatccttggccgagcacggtggatcatgcctgtaatcccagcaccttcggaggccgaggcgggcggatcatctgaggtcaggagtttgagaccagcttggccaacatggtgaaacctcgtctctactaaaaatacaaaaattagcagagtgtggtggcgggcacctgtaatcccaactattcaggaggctgaggtaggaggatcgcttgaaccgggaggcggaggttgcagtgagcagagatcacgccactgcactccagcctggggacagagactccatctcaaaaaaaaaaaaaaatacatctttaagatctattcttgtaagattttttttcaacaggaaagctaaaaaaatgcttaaaaatatatacattattttagatttgaagccaccacctagagaaaaggagatatatcctatttgttacataatgtctctccagaataattacttttatttgttcactttctagagcaaacaccatagttgttttttgttttttgttttttttttatcttttacaaccaaatattttctactaaataggagataaagaccaataaaacctttgttctctctcccttcagccaacccctaaggcatattttatctctagagttgttatctgaagtgaattactgattaaaaaaaaaagttaaaggacccagactgctgaatgtgtgcggtaactgcagtgttttccacaccttgtttctctttagctaggccctaccaatagtcactgttcctaccagcctgcttttgcagaaaagaaaaagttgcctaaataccatggctccaatgcctaaattcctttaccaagaaaaaacaaaaacaaaaacaaacaagtatattacaagactctggaaaaccgaagtcttacatttacaatgtacttattcagatttgtaaactcctaagtggcaggagaatattaacatgtacttttaaggaattttcatgggcaaacaggttaacttcagtaactacctgtacaaggtttataatgagctgtagacccttttttctaactctcttggccacaactggtatattttgccttcagagtattatcagtgtgtatgtattgaacattggcacagtctatcatttaatattcacaacaaacctataaggtttatacaattattacccacatgtcacagatgaggaaacaggcacaggcacttacccaagtgtacactgcttgttagtgttagtgtggaggctgaaacggaagcaggctggctccagagtctgcatcctaaaccctattttgcaatgagtttaatgctcttaaaatgagcagaaatgaaatgtaaaacattttttaccccaacatttttttatgatgttgagagatgacggcgtgctggcagtcctcacagccttcgctcgctctgggtgcctcctctgcctgggctcccactttggcggcacttgaggagcccttcagcccaccgctgcactgtgggagcccttttctgggctggccaagaccggagcccgctccctcagcttgcagggaggtgtggaggcggaggcgtgagctgcgggcggctgcgggcggcgcttgagggccagctggagttccgggtgggcgtgggcttggcgggccctgcactgggagcagccggccggccctgccgcccgggcagtgaggggcttagcacccaggccagcggctgcggagggtgtactgggtgccccagcagcgccagcccactggcgctgagcttgatttctcgctgggccttagctgccttcccgtggggctgggcttgggacctgcagcccgccatacctgagcctcccaccctctgctccatggcacccagtcccatcgaccacccaagggctgaggagtgcaggcacacggcacgggactggcaggcagctccatctgcagccccgttgggggatccactgggtgaagccagctgggctcctgagtctggtggggacgtggagaacctttatgtctctagctcagggactgtaaatataccaatcagcactctgtatctagctactctggtggggccttggagaacctttatgtctagctcaggaattgtaaatacaccaatcagcactctgtctctagctcaaggtttgtaaacacaccaatcagcaccctgtgtctagctcagggtgctagacaaatcaacactctgtatctagctactctggtggggccttggagaacctttgtgtctagctctgtatctagctaatctggtggggacatgaaaaacctttgtgtctagctcagggattgtaaaagcaccaatcagtgccctgtcaaaacagaccactcagctctaccaatcagcaggatgtgggtggggccacataagagaataaaagcaggctgcctgagccagcagtggcaacccgctcaggtccccttccacgctgtggaagctttgttctttcgctctttgcaataaatcttgctattgctcactctttgggtccacactgcctttatgagctataacactcaccatgaagatctgcggctccactcctgaagtcagcgggaccaggagcccaccgggaggaacgaacaactccagacgagccgccttaagagctgtaacactcacctcgaaggtctgcagcttcactcctgagctagcgagaccacgaatccaacagaaggaagaaactctgaacacatccgaacatcagaaggaacaaactccagacgcgccaccttaagagctgtaacgctcatcgcgagggtccgcggcctcattcttgaagtcagtgagaccaagaacccaccaattctggacacaatgtcatgacttaggcagtaagcatccatgaattcttaaacttttaacgttattcatttttagcaaatatctattgactccacagaatatgcagtcttgtgtaagatatttcaggggaacacgaggaagtatgacaaataacgccatgttctcaagcagtttgaaactccttggcgcctcctctccaccaaaaaaggaggaaaaaaacaaattaaacaacatttaaaaatacatttccaagcatccccggaagtcaggatcttctagtatccatggcctattatatacaatggttataggcctggtgttgaccgggttgctgggttcagtttgcctggaagtggattccagaacagcctatcaggaagaggtagtttctgtagtcaaaggcaggaggcaagctttagccacctcctgtactggcttgagataaaatcaagaaatccacctcctgactgcttgtccaggcctcttttttctgtccttcctctaacgtcaacccaatttccccaaaattacttagagcaggctggcgcggtggctcatgcctgtaatcccagcactttgggaggccaaggtgggtggatcacctgaggtcaggagttcgagaccagcttggccaacatggtgaaacccctgtctctgctaaaaaaaaaaaaaaaaaaaaaaatacataaattagctgggcgtggtggcaggcacctgtaatcccagctactcggaaaacagaatcatttgaacctgggaggcagaggttgcagtgagccaagatcataccattgtattccagcctgggcaacgagagcaaaattccatctcaaaaaaaaaaaaaaaaacaaaaaaacaaaaaacaacaactacccagcatctctttgctacagacaagatcagagagtctcgttcatcccatgtttctgagaggtaatgtcaagttattccagttcagctgcttgtgtttccatagaggatgagcatttggcctttaggagggattgagaagtaccttatcacaacgctacctacatgtttggtaggtcttacccctctcctccttcctgctctcactgacacagatttgtagcagaatatacaaagatgccttttgtgggaaaatgttgccaactctaccccagacaacagctggtgctgtctgttggggcttgctaagcaataaagtgcgcttaaacaataactgcaacttccattagtggatgacccattcctggggaggaacatcctggagaagaaacgtgggtcagcaaacctaggactaaacccagatgtagcagggcttttggcttctcctccttcagactaggccataatctccctgaatgagacaaagtagttttcagaaagtaccaagtagacagttcatgtgtttggctcctaggagcaagtcatatccatttagagtcttggctttatgctaatggggacaatgtcccctggactcctttggcatggctcaccacctgccctcctcctgacaagcattctcattgtcccaaagtaggcacctgtagtttcagaaccagctccctgaggttgcttccatttattaagacaatttgggcctagaagctggttagtaagttgccatggtatcgcgagcaaagcattagtcggctttgctttgctatctgtagtagtaggtgatcttttataaaaaattgttgatgtacatgaggacaaataaatcaacacatttacatctcctaactcatttgtaggaacaggttcatattctgctgaaaacaaaaaatcaggagaggatcagaggcagaggcctgggcagggaggctattttatgtaactgtattggtataaaattactccttttgctaaccacatctagaaggtaaacggagccttatatggagaaataatactggagaaataatagtcatgtaaagataggctgcctaagacgtaaaggctgggaaagattttttgaatagatagaaactttgaaatgtggtgagatctgattaaatgggaacctgtctggtttgcatcagctaaagttctaaagaaggcataagatgcttgtttggtgtctgcatctcacggctacctagggagcgctggaaaatcttagcaacttcttcagtttgttccacttaaatctgaggctatagaccacctctgtggggaccattacataacacgcagggcacagtgcaaaatgagaatgtaggactccttgttcaaaaagcaagaaaaaaacagtgccattaagaacactaacatctaaagctttttcctttcttccacaaactttcaatttctcatgatgttttttatttgctatttaaagtcattctgaacaaaggagagaaaaactaaaacatttaattattagcatgaagtttaccatttatctttatttttattattagtagtattattttttgagacggagtctcaatctgtcacccaggctggagtgcagtggcgcgatctcggcttactgcagcctcggcctcctgagttcaagtgattcttctgcctcagcctcccaagtagctgggattacagacatgtgccatcatgcccagctaatttttgtatttttagtagagacggggtttcaccatgttggccaggctggccttgagctcctgacctcaagtgatccgcctttctcggcctcccaaagtgctgggattacaggcgtgagccaacaagcccggcctacaatttatctttatatggtacagtgacagtttcaatgcaaatataagagcatttaacttacatgtggaataatatgacacaaccttttttcatagctcatacacgtatatttatttcattcttactagggcagtggaaacactacacaactaactcaactgaaactcactcacaaatttcttgattcatgcatattataccaacacactacaggaacagacagcttccataatccacttactttctactcccctggagcttccctggacccccacacatcatagtctatcagaattctgtatttgtgaaaaactgtgaatgtgatatgcagatagtgccacaatggacaaacaaacatatcacacatcgcctcggctcatgaagatgctccatttatgaaacactagttcaaagataaaattcagaattttgagacagtgacagcggagccttaagccaagtatggggcccttctgagctcagggccctgtgtgacagcacaggttgaatgccatgaagctagccctgcacctcagacctctggccaatatgcttagagggactattcctgaatactaataatgaggctttccaaggaggtaggtttgatgccaatgtacacactgtgataaggctgcaggggatagactacatatggtgattaccctgtaaattacctgttcatatagtttccccaggttgtgtcgttggggcctgtgcttttctttatgtatataagtatgtatgtatgtatgtatgtatgtatgtatgtatgtgtatcagccaaaggagtctttgatttcttttactgtgagatttccattggaaacagacacctgctttgctctcttctcctttttcattatcataaccaaatagcaagcacatagattttggttagtcattctaaatcgaaagacacaaatatatataggaagatgtcaaaaaaagagaagaaagatgaaatttttttttaaatcgggagaaagtaaacataccctcaatacttaaatctcccacaatgcacaacaataaacctgccctgatatgggcactgccagggatatactcttctccctttctgtctctgagtaacaacaggttgcaactagtttgaattaaagagcctgcatctgcagccaacagctggaattcggcaactgttgttaatccaccttaattgcttattattctatgagtccttgtttgtgcttttgttattcaaagtaattttccctacatgcacatactaccaagcatggttttagcaagctgtggccaaagaattcctgtgtttccatcctagggctgtcattgttttcttttgaaacaaaaacatattgacactggatttttttaaagggttagcaagttagcagtgatgcccacagatggactagcattggcctatatgtgcacagagatacaggtattagccaacgtctaaataagaacaagtcttcttttggtgttttaattagagctgcagttagcagggttgctattttccctaaacaattcttcccctccttgagttagggagggattttcactccaccacttcattgcactagtgaataaatgagatcccagggttccagggagaaaaaaaattaccaatataaatgcatcaggtgcaaattaccaaggtaaataggcccatggagactgtaaagctagcaacaccaactggaatatctgagaggggccagcaggagaaagcccatgggtcacagtctcagttctgcagtgtactgtgtgtgtttcaacccggatcattcatcctgcagcctgcagaaaggaatccacagcacaaagcagttgtgatttggcattgacagtgttctaactaatgcttcagttgtagcttttctattcccctctctttttattcacccaaatgccactcttggatagtgtcaaagcagaacctccattgtgagagaccaatgcaatataatatctccaactataagttgatcattagtaattatttgttccctggaactatttataatctgcaataaggaaaaactgccacaaacatcactattaactgtggtctgtagggcacgaaggctgatcttttacgttttccctacaatgtatacgtatatctgctaaagaaagtatttgtagctctgcatttcttctttctgttgctctttactgcaaagtctttcttgttctgtaataattttgccagggtaagcctagtcccactgtaagcttcacataaagcaaagacctgtcatatacttgtctctcccagagtgcagcactatttactgacctgagttcaatttttttctagaagagagcaggcaaggctttccattagcctggctttgtttccacccaaccctatcctcatatggtgtggctgtctcacctcttaccctcttatacatgtagcctgaatgcacacttgttagtcttatttattaccctatttgtgtactgaagcacatgtcccttaaaaattagcctgctctaccctgactggaacatgaaattctgcaggcatctgagcatatattcaaatataataaaagggctatattataacaaaggtctttaagggatatttgcctggcccttaaatcaccttgactttgtttcttcaaatagcaagtacctaaaaaatattcattaaaaaaaaacaaaacaaaaaggtttcctgtgaacatttcagccaggattgttcatcctgaagcctgcaggaagaaacctgtgaacaagtgagtgggagaattcacagtggagtcagctccagctcctaactcttactatttattcatacctggtgtcgtcttggttttatgcttcctgttttagagcatgcatcaggctagataaggacatattgtgtgcatagtataaactaatatgaggacaacttctacaagccttctacagcatatagatcaagtgtcattcttaaagccacaggcccttgttaaaacaatttatttgcatggattaagcctcacttatagatattgactcaactatatgattttgtaaatatttttttaaaatattctgtttcttacttaggatatttcttacctcctgcacaacacaacatcaactatacaatcaataagatacagtctttagctacaaattaagcttcttattttatctgtgtaacaatcattatgtggtttaatgatgatctgcagtcttaaatacattatatactgttatatcagagatgacataaaagtacagatattatagcttatgaaatcagcccctccttaatcagtttggcaataaaccaaattgccctgatttagcaaagaaattctcagaaactatttttctcattcaacatttgtgattttaattctttaaaaaatatttcagtgtcttattttgcacaaccattcactatttgtttgaaaaacttaaaactgtaatatcattttaatacagtcattataaactaaaagttaagatacatactatcggctacatttctgttgtggtattttaagcctcactttgttgaagcagcaattattttcataacctgaattaacgaatgctgattttgtacgtgaaaagatggacagaaatgtcacactttaattcacgccattaaacaaacaaaaaacggccataaggtcaaaataatagaactagatgaaaaaagtagtcgatctagaatcctgtgaaattttctctgatttaaactgtttcttgccttaaagaaaagtactgcagctgtgatacaactatgagccctcctccctttaaaagctgatgtcagtgagaaataccccatctgatgggttttcaagatgtacaccgggcattgcctacggaagttagttaattacaccaacctgcggctgttagcaatgaggactgcccctcttcacccaacgtagggcagaaaccaatcctctcagttcaccgatctaattccagttttcaggcacactggccatccactgcctccttcccttccctctccaactcttagaaaacgaaatgcagttaatttatgttcattttatccatttcctctcatgactcactgcaacaggaaactgccgtctctgttgtgtttagaccagtctcgtcttagccacgagctaacagtatcatcatttagaaagatccctcatcatgccacagtcaacatcaaactgttcctcgacattctgaatttatctagcacatcttccctatctgatgcaaatgaaccggcaatcattttaggaagcagtgccttaaagaattgtgatcctgacacaattgctgtggcggtttactcattacattacgaagcacagctgtatcttgttgtttcatctgtggggcttttgacagcacataactgctgaaaagcatgtacatggggttgatatatacacacacatacatacatactcaggacgtgcaaaggagaacgtggccgtgctcgaagtgtatcaaactatgacttctaaattcctttccatcaaatgccagtagaagcacttgataaatggaccctaggagagcacttctcattgcctcaggatggaacgactcgcaggcatacgacactccatcaatacagagagctggcagattgaaaggcgggaaggactatctctgatacggtgcatctgcttactaatagcagcagcactccaaccctcttcccattcattgcctacaggaaccactcctcagagaggcacgccagtcaacagatggtctctggctaaggtgtaatcaggagcagcttgctaaatttacccaaaacaaatagaattacaggcttttgcccgagtctgaaattgaattgagaacttgggtggtggataatggaagctaaaatggaagagctcaaaatgcatcacagcatgttgggaaagggcgggcacagggtgcagtttcagctgtgaactccactgtttactaccaggtcatctattgccaataaacttgtctactatgcaggatcgtttcccctcaagatcaaagcttccaggattggtaaaattgtcaccagttaatgaagtcatctgccttcggtgcacagtgaacaaaatactacctgatgttttgaatatgttttgcccagttgcaatgccttcacgtaaaatgtcaacagttctaaccatcctactttcattagcagtttttatgtccactaaaaatctgtcattcaaaaggtaagaatcattaaggattctgaataatgtgatcttctaagaagaggtgttccgatgtctatctccagaattcctcgctgttttcaatcattcgttgctcagaatacaggcaacataaagcctcagaaattgcctgaaaaagtcagcataaaattaagagtaaatcatttaacctatggctatgtttcactacttacgtagtaagaactgtgccacccacacaaatcactgtatcatgaagctttaaaagtaaatgaggcaaaatatgtaaaagcacttaaattataaagagataaggtcttaaggataaggctatttgtaacccaagctatcagcagtcactttaaaattattatcttcataaccattaatattttttattactaaattgtttacccattaaaaaggccattaaaaaattaaaaatttcagtttctaatattttattgttttctaatcttctttggaaataaaaagatgtgtattttgtattttacatcattcagtatttgcaatgcagagcttttaaaatgtattacagcatgcattgaattagctacctttaaactaataatcaggcaattctcctcattcttcatgacttaaaatcccattatggaaaattcacttttatacatcaatcagtctaacattttcaaacatcagttatataagaagtatctgaagtacctcctattttcttcgagcattttgttgtaaggaactctgccatgcagagaaggaatcccaaaagaaaggtcttttttgttcaggatgaaagtatttaaagagagggtattttttaaattaactaaaaaaagagcttcattcttaaggtttgaattacagactgacaagggctaaaatatcttttaacataattattttttaaagtaactgacttgaaatgaaactagcatttttcttaaatgaatgctgttaagtaaagcaaaatgtgtccctacactcgaagaggatacatttttagtgatatgttatatatataaaaaagaactagatgctaaagctaccttactaaaatatgtgtcttctctatttggagctttatctgctattctctcttcttttatagaaatagaaaatgcattattaatgtacaaataatatgcatgcttataggaacaaacattttgagctgcagaataaactaatgaaaagagcacagacagatacagatatctaattactacattaccctgggcaaatcatttaactgctctatgattcagtctgcccatctgtaaaatcagtggaacagcttccctacctatccccaagatatttggtaggagtacatgaaaaagtgttgtcgaagcctatttaggcaccaagcttaaaaggtctggcacatgtttgtgaaagtacaattataatgattttcattactattctagtagactctgaattttaatctttaggaataaccctaattattttattttaaaatgcttcaaaaatatagctataacagaaaaacctgtcatataactagtagtaaaattttggccctataatatcatcctatttattattcaattattgcttcaataaaccaatgtatgtataaaaggtagcctttgtttttccgtatctttaatgcaatttgttctgaaaaactactgtgacattaataataaaggacaagctctgtaaagaaaaggtgcctaacaaaaacttggcaatgatctccattcaaagcaaaaatgctatgaattttaagataagggacctgttatatgttaagtaaaaatattcgtagtttataatttgtgaagcagtaggcattgcataactctgagaaaaaatgctgttcattatatgaatggcaatttcaaataatatcaaatgatttaagttcaaaggacttaggaaagcttcatggcatcctgttattaatttcacaaaaatttctttagaaaagaaactgagtcctacatgaaaaatgtaaaactacaaggtgcactgtgtactgattctccatgcaacaaatctgcaaacattgcctagggcatgctatatgggaaatctggacagctggaaatcatagtagacaaggagatttaggtcattgatctcagaattggaaaatttcccctagtgagccaatatgaatctggcacatatcactgatacacacacatacacccctcctatatcctcaaaaaagtagcatatcactaagagatatcattagaaaatgtatgcagtaatagcaaagcgtgtgaatatattaactgattgcgtagtgaaaatcttcaatattcagtaaatattcattgggtacctcctatgtacacaacactgtgagaatcagtagtaagagatataattaacatttgttaagtacttgctattctacattctttacctaactcatttaatccccctttcccatctctctctctttttctctcccccccaccttctcttggagataaaaaacaattatgatcatcaacatcagcatcatccccattttccatttgagaaaactgaagcctaactgaagtagcttgcccaaggtgatagagctagtgagcgacagagccaagatttaaaccctggcagtctgatccagtctacacattcaaccactatgctatattgctctaaagcacaaccacagggagccacaagaaacacttcaagctcttgagcacttacgctttatttgtgtacctctcactgcctgaaatgactcccagcttaggactcaccagctccatgaacccttcccagatttccctcaggaacagttgtctactcccttctctggtccatcaagatatcttgtacatattccaaattctgtacttattggaactatattataactatttgtctgcatgtttgctctttttattcgtgaggcttggctgagaattcaacacatagtaaacatccagtagagtaaatgattaacctgtcattggaacattacaatttagttgaagaagtagtctgaactctattggtgtaagtatttgtgtttgataatggcaaataagaataaaggttaccttagcaaaggttgctaaattatggactggggtgaagatagggctcaaacctcactctgatagaccttaaaggataggaatgaatcagatgactggaaaagaggagaggcaatctggggccagatgagcaggagcaggagcaggggatttgagaaatgagtgcctgaggcaggtgtggagggtgggcagcccatttaatggcaagctaaggagcctcaaatttattcttagggcactagagagtcttgagcatggaaataacatgatcagaagagcaaggcaggaaaaacagttttggctgcaggaaacacaaaggtgaataacaaaaaatatataatatctagattttgagggtgaaacctactcagaatccttctttagtaaggaaaaagacagctgaaacattcaccacctgctgaaaaaggcttgtctccaagaagcaaactgttactaatagtttttaatgtaagtaaaaattcattaaacatttattgctgctttattatcctacgggctaagaatacagaaataatgcatcatcttcagggataagaatctaaatttttgaaaatgaaatacagaatatggattagagaagtaacataaaatgatcaaaagtttgtatgtgaaggtcagaatgagagagctattattcttatataatatgatctgtcaaaataaaaaaaaacttttgttcaaaaataaatgatacaatcagaaaatgagaaaggacattagaagtaatctaatcccacagcattttagagatgagaagaatgggaggaccagagaagttaaatgatcacctccaggtcacacagaaagttgtcagtaaaatatggattacaaatctcatctcctaactatggttgactgctttgcctctgctgtttttcataaagctataaatatgactacactagaaaaataattctggtatattttggtataaaacaaattataagtctttaataacatccatgtaaactttaaaagattaaaacaatagagccaatgaaaatggatcattcattcatttagcagcctatattaattaagaacctagccagggaatgcaggaatggatgaagggtttggatataaataacggaaaatggcaaggcgtggtggctcacacctgtaatcccagcacttttggaggccaaggaaggaggaccgcttgagctcaggagtttgagaccagcctgggcaacacggcaaaacctcatctcctaaagataaaaaaaaaaattagctgggcatggtagcgcagctgtagttccagctactcaggaagctgaggtgggagaatcacttgaacccaggaggtcgtattttggatatgctgaattaaatataaaattaatatcaccagcatttttaatttcttggtaaaaatgtagctattagaaaactgaaaattatatacatggctcacatatttctattggacaatgccactctggagaatgagcaaagattaaccagctgtgggctggtgcatgcttagaaaggccaggaaagaggacaaggtgggatctaaccattaaaggataagaatctgaagattttttttgaaagactaattttcagggaattgtggggaagaaagtctcacagaaaaaaatgtgggtagttacccaaaagtttctcccatcatctttggaactttggccaaatcaggtgatgccttgggcaaatcaggtctccttcctcctgccactgaactaaacttgcagtttatccttctgtttgttctctgtggaactgtgagccaagtgaagtgcagatggatggcttcttggaacagaactgaaagcatgccagtacttaagttagaatagcatccaccttcagtgaccacagttattatgtgaacaccgtaggtcctcacgtgtgaggtcaccgtattatagaagcagctctctggataattattcacacagacacaaacacacacacagacgaatgtcatcagagttttttgctgtaaaacactatttccatctgtgtcttctgctgcatagtttaattcctgtatatgtcttttaaataaaaatgtgggcctcatctgtgttacaccaaccttgaagacatgaactgcagacaaattttcataataacttcagggctatcaaactggctagaattgaaatatcaaggtcagccctgccattttcaaattatcttcagccttgatataacaataatcttaattaaatagacttctaaaaactaagtgtaagtcaagcttgaaccatcactattttcagagtatactaaacagctagtaatacaagtataagcaataaattattcttgtttttataataatgagaaaaaagttctagaagttaattccacttaaaggtgtttcaataattaataatttcatttttctcatgtccaatgtcattacagaattaggtatattcattacttgaaacatttcatttaatcattcacttatttacttattgcagtgttcctttattgtattgcagttatttgtcctgacagtttatagttcctcgattaaatggatattttaggtattctggttttaattacctaggagcaaacttcaggtttcaaagttgcatttggacaaagtgctattcctataaatttatttataggatggcttcgctcttgagttaatcagaatttgtgtcacttacataacaatggtgactagcgtgacatgttagtagtctctaatgcaattttgctaaaaattttcttataacccattaatacataagagcagatgtctttagatacccttttacagactctttaagatgactatttgttcttttcatctgaaagaaccaacacaaaagagcaaaagtgagtgtcaactctttttcttttccttttttttttttgttttctgaggtggagtctcaccctgtcgcccaggctgcagtgcaatggtgcgatctcagctcactgcaacctctgcctccaggattcaagcgattctcctccctcagcctcccgagtagctgggattacaagcatgtgccaccatgcttggctaatttttttttttttttttttgtatttttagtggagacggagtttcaccatgttggccaagctggtcttgaactcctgacctcgtgatccgcccgccttggcctcccaaagtgctggggttacaggcatgagccaccacacccggcctgagtgtcaactctttttacaccccttaaaaatatactcatatacagatgaatggttataaatgatttaaaaacgtagatgaggaacactggaatacggccttcacgagggcagaaatttttgcctattacattcattagtatatttctagaacccagaagagtccttgatcctagcagatgctcaataaatatctgtgtattgaatggcacataatggacactcagaacataaatgtttaatgactgaataattcatggaaatgattacgccattagttaataacaatatgctccatgatcatcatttcactgtatgctactgtcaaaggcatttgaatcacagcaactccatcttgaataagggctatgtaaaatgaggctgagagctactaggctgctttcccaggagggtaagagattcttagccacaggatgagataggaggtcaacacaaggtacaggtcataaagaccttgctgataaaacagcatgtggtaaagaagccaaccaaaatccacgaaaaccaagatggccatgaatgtaacctctggtcatcctcgctgctcattatatgctaattacaacacattagcatgctaaaagacactcccaccagtgccatgacagttacaaatgccatggcaatgtcaggaagttaccctacatggtctgaaatggggagtaacctgcagttccaggaattgttcaccctttcccagaaaactcataaataatccactctctgtttagcctataatcaagaaataactgtaagtatccttagtctagcacctcaagctgctgctctgcctatggagtagccattcttttattcctttactttcctttcactttactctagggacttgcaccaaactccttgcgagatccaagaaccctctcttggggtctggatctggacccctttctggtaatactacaatatgaatactttaaatggtggttaccaggaagtcttaaatgtttatgacaagtaggtgcttagtacgttttcttgaatatatgagtaaagaaataaactagaaagactgggtcacaatttagaaaataagtcatgaggtgctgaagaccagaacagcccaatctttttttataaacctcctggatgcaagttttaacacagtctcaaaaaagttgtgatcagtttctccaaagctacacactgagactaggatgacaacgagctacctactcaggattttgcaaggaccaaaaatcttttcttactttacaatactctcaaacagaaactattttaaactacatggttaattcaaccttgtggactggatggtcatcaaaatgattatataattatttcaacatagttgcatttctttctttttctttgtgtgtgtgtgtgtgtgtgtgtgtgtgtgtgtgtgtgtgagacggagagttttgctcttgttgcccaggctggagtgcaatggcacgatcttggctcactgcaacctctgcctcccaggttcaagtgattctcctgtctcagcctctctagcagctgggataacaggcatgcgccaccacgcctggctaattttgtatttttagtagagacagggtttcaccatgttggtcaggctggtctcgaacttctgacctcaggtgatcagcccgcctcggcatcccaaagtgctgggattacaagagtgagccactgctcccggcaccatagttgcatttctaaatataaaatccccacgaagtttgaaaagatgatgagatcagggatatttgaacacatttttaaagtaaatggatgtatggaatattatgatagaatatagtagtagtggtagtcaagcatgaaactggtagagaaacaaaaatatacatgtaaaataaactcagtattttaataataaaataaatggtatcctaaaaaatacactgattttgtaaatctatattttgctattgtgactttctatgaatatccatttataaagtgttacattccaacctgaagcttttttaaaagtacaacaatctttttagtttcaactttaatctgtaaattaagtgccctaaatcatctaatagcatagctctaaattcatccttatcaccactgcctatttaacatcaaaactatcataaaaaaaatagttcttatctatcaatgcatacatatattacttttcttaaaaaaaacctgactaataatgtggcaccatgaacatgttatatgtagacatggtttgttcaaagggctaaaaaacaattatagccctgcctactcacaatgcattcccccaaattttcattagcttacatcatagtaagacttcacaaaattttcatctgaaaagacctactttccttaagatcttgctcacaaaacacccaaaaggtgcattttgagaaaatgaagaaaatgccatgatgctatctgtggctcctgcaacacttgttttacttcctttcgaaagaaatagaaagtcaaaagagacttcaaatggtgggcagatgtaaatggcatttgcctgaaaagacataaagcagcattcaacagggaagtcccaccccactgagtctgtataagcgctcactccatctctgttgtagttgaagacagtggctgtcaatcaatcctggctcagtggttaaagaaccccacataggctcctcagtagggtgtaaatggctgcaatcgcctgggtataagcaactgatttgcaagctgaggggcaaaacaaaacaaacaaaacaacaacaacaacaacaacaacaaaaaacacaaaaacccccaccttgtttcttcctcacacaacctgaaatcaatactctagcctgtttttttttaccttctaggaggtttacagttcttgtaggccatcattacagagagtcacagaaggcacaaaactgaagcatgtcacccaggttaagaagctgaagactttgtgctgatttccagtgattattgccattaaaatagagcaatgagataaagttttgccagagccaaacacacaccatggtgtttttgcaaaagcatatacgagaacttaactccaagatgacagctccatcaagcagcaatcaccgagaatgctgttctgaattcaaaggcaaccctgctaaccactctttctgagtaaatcacttaacttcttttatacctcaggtagttcattgtgcactacctcaccatgggttgcttaccaagaaaacgtaataaaaataattggggagctctttgaagacataaaattgctgtggagagaatcaactgtaaatttaagtctgtgctccttggtgaagaagtctccaagtgagctagtcttgatgaggtctcctttgatgatttggactgtactactcttagtagaaagaggctctgccccttcctgatgggtacttacgtacccagtggccaggaggaatggactcagggatggggctaggggcctcacccaccaggcatgagaggtaatttgtgcttccctggctgccttggcaccatgcctctgtagctttgtttcagggatgacatgcttcagctcaggctgctgtgcttaagtcctactgtagtcagagatttggggctgggaaaagaggggcagctttgccccctcctgagccaagaggagagggagagggagagagagagagagagactctatcaaataaaagcctgttgggatttacaaggaaacactcgcttgggagctcaattaataataaaatgtgatgagcatgttgattctgtgggttttgtttccaaatcatttgctacctgccccatttcagagcatgtcaggaatgggtactctcccactgcaaagatggggaaatgagtcaaagtgtctcacttgtgtagcaagtggaagccagatgtcagaagatgtatgctgggcagatgttagaattttaaaacgagaactacctgaatggccccagcagaaaacatggtattctaaaaataggacaccgacaccccaccgaaatcaactgttcatttatttattctacatgacgggtgctgtggggcaccagcttcttgcaagcctgcaaaactgcttgtgattcataagatgtttctgaacagaaagaggctggtggtatccgtccattaaaaacaggctcttcactgagatactgggctctatgttgttttttctttaattccaagaactcagagggagggacagaaatgctcagtggatagctatggatggatgagcagaggggagaggaaataagtgtgacatgtaagctgatctgtgtgatacagtaagagaggaggatgttgcgaggtaggcctgggtcagcgtcgcacaggtgttggtgctggaatctgtttcctgaacgtctgtgctgaacacaaaaacaaccaggaccacgggggtagaaataacaagtctcacattgctttaacaaaaacaacaaaataaagcactattcctgttttctgctgtttctgtcatgctaaatgacatccctgtccccaggtttagctatgtattttgccacctcataaaaccccaatcaatcttcccttctcttctggcaccaagttatgaagcatccctgatcttccagacctaaagaaaacagcagagagacggggctcctcatcaggtagaggttttcttttttgtcagaatttgagactaaatacagattggagtattcacttgggaattcaacagagatccatcttaaggaacattccaaatacacaatcagaaagaaagcatttgtgtgcttttctgctcctaggaaaatgcagagagaaagaaaaggttactgtttcatgtgaactgatttctcccttctctgtggtaggcagagaacacatcatcccacctggaacgtgagtcatttgtgaaatgcttgttttaaattcaaacttctccacaacctgacgagtgtgtgggagacccaaggaagctgacatacaagggcagatttatttttctgccagaaggaaccatcaacacaaaggccaatggtaaccctaaaaatggaaatgtgctaaccctttttattgtcaagcaaataaaaaaattattcttcaaaggaggagaaacaaatgctcagaccctccaatggcttcctgtctcattcagagtaaaagcccaagtctctacaaggattctatgaggtcctacgtgacctgcctcccgtctcctctttccttacttcactgacttaatctcctacctctccttatgatataggagttaagaagaaattaggcagatagcaagggcatgggagtccttgataaggcttttctttttaatgaaaaacagaaaaacagccccaaatcattttctaacaaagagctgcctgcaagctaggagcttgcatgggtgaatgccggcaggaactaaggactagacatgtgcaggatggcagctccatcttcctttctctgccagccacgtgtactgtcaaggagcagacaagatggtcccaatcaactagaaagtccacttgcactgtaacctccgccttctgggttcaagtgattctcctgcctcagcctcccaagtagctgggattacaggcgactgagccaccacacctggctaatttttgtattttttagtagagatggggttccaccatgttggccaggctggtctcaactcctgacgtcaagtgatccgcctgcctcagcctcccaaagtgctgggaatacagatgtgagcccccatgcccagcatcaagacatggtttttattttttattttattattattattattattattattattattattgagatggagtcttgctgtgttgccaggctagagtgcagtggcacaatctcggctcaatgcaacctccgcctgctgggttcaaacgattctcctgcctcagcctccctagtagctgggactacaggcatgcgccaccacaccaggctaattttgtgtttttcgtagagacagggtttctccatgttggtcaggctggtctcgaactctcaaactcaggtgacctgcctgccttggcctcccaaagtgctgggattacaggaatgagccactgcacccagcagacatggcttttaaagtgctctgttttatctacttaaggcctggactccacaaatcaaatcaatgtgttataatacagaactctgggtacttcctaatcttataacctcttcctactcatgctcacgccccaaaggctatctatctatgagatatgttgtacacaggagaatccaagcccaagaaactaaaaatcatcccaaagcagtttaaaaatgaacagggtttattttactgtagagcttgttacatcatccatttgttgaattaccatttatgttgggttacttatccttacaattcaaatgacctacagccctagacactagaattttatttcatttttgagacacagtctcacactgtcgcccacgctgaagcgcagtggtataatcatggctcactgcagcctcaagtaaccgggctcaagtgatcctcctgcctcagcctcctaagtagctaggaccaaaaatgggcaccacaatgcctggctagttttgtgtgtgtgtgtgtgtgtgtgtgtgtgtgtgtgtgttaatttttggacagacgagtttacactatgttgcctaggctggtggcaaaccctggccttaagcaatcctctcgcctcggcctcccaaagtgctgggattataggcctgagccaccatgcctggttgagttttattttttttaagcagccacgatatacaggaatcaagagaatttaatcctcaaaagtaaaaaagaaaaacctctatgaaaggaaatgacttgggcttgtgtctatgtagtgcccaaaacaacctgttggtctgctaatctgttaatcaaacaactgttttaactatattatgagaaataaccacttcaagttatttttgtttttatagaattgacaactcctgttcctcccaaactgcttctttgatacactacacatatggccgtaaaagaaagaatgctttaaataccatgaagcccacatctaagtacttaattatctgggaagcttatgatgatggtgatgatgttttccctcaatggtaaatctaaaccatgtgtgacagctgcaaaccacagcatttatttagtaaagccagggctccttgctcctctgtaggcttaggaaacatttcagtgatgtctgaaaaataataaaatatgttacataaaagtccaatatctagaacctcaaaaatattatattcagtgaaagaagtcagacataaaagaacacatattgtatgattccatttgtacaaaatgtcccaaaaaggcaagtatatagagacagaaaatagatgacaggctatctagggctgggggtaggcacaggggatgactataaatgggtatcaacctttctagaatacacacgtcataaaattatatcgtgatgactggatggctctgtaaatacactaaaattcattgattgtacatttacacctcatgaattttatggtatgtaaattacatctcaataacactgttactaaaaaaaaaaaaagatggaaaaaagtccagtatttataaaagcttacaggttatagggtgcagggaggagaaactagaagacaatgatgctatctcacagtattcatcatgcaaattatggtttctgttcttttctccactcctatacaatcatggtgactcaggagagggttacaggtgtgttgaagcacagtgataaaagtactgaactccgggccagactgcctaggtcggccacctactgctctgtgacttcaggacaaatcactcggtgcttcttgtactttagtttcctcatctgtaaacactagtaatagtactgacctcatacggttgttgtgaatattaaattcaatatatgagaaaagtttaaaagtgctcactatcattattatccttttagcctcttcttgtgtgcccaataaagatcttggttttctgtatatgccaagatatgaaaatcactgggaaacaacgtcaaacaaattgcgctgcattatgtctgaatcatgttctgtgacaagtcatattacaagtggtacggttatattatgcaatgtatgtgataatgtgtgagaacaaacgaagcaggctacgtaaaagactttttcaaaaataaggttgtacatcacttagaaacacattcttaaggatctattaaactcatattttcattataatctgctaagtatgaacactataaaagcgtttttgtctactcaattgtcagggtcaaagtagaattgggttgggttgattggtatatcttttaaaaatactgtatttttcttatgcaatgaagtgtactcagcagggatccaaactatatatgcaacaacaaaacaggattaaaagctttttaatgaaggcactgtaaacagcattttccttctgctttagaatatttcaaatacaaaattagcaagccccagagactggaatttctgctacaggagagatgaaaggttaactgtctaaaaaggaaagactatgtttgacatattctatttagaaaataaaagggtttcctaataaaagcagaggcccacttgatgcgcctaatgctccttcagtgtttgcatacacaactgagtaattagaaagccccactcggaaaaaaaaaaaaaaaagtgaataaaaagccattgcagacatcggtcccttgtttactaggcttgctggaggccctggaggtcactgtgattgacaggattttggtgttagtaggagagttgataatgcacacacatctctggagaggagagctccggagtcctgatcatgcttaatagaagggcagccactgtggagaacaatggaacaggcaaagcctgggggactggtgggcagaaggatgttcaaggattgcaaatgacgttcccagtcaattagtacccattgggaagccgaggtacaccatgccaaaaaaaaaaatacctaaaaattctcagggcaagaatcttcctttgccaaagacaaggtaccactgtagccatttccattaggtatacttcagtaacctcagctcccccaaagcacccctatgagctgctgaagatcaagtcattttagaaaagcaacactagttcctacaacgtatggcaatgttttcattaggcatggctgaaaggcaaaaaccacagctttgaatcacaaagccacctgaactttatctttttgttctacttgaattcctagaaactcaatggaaagtattttctgtatttccagtcattgagaggaaccatgttaattattcccaaggttcctccccttaaagatccctgtgacccaaatttaaaaacaagatccaaccggtttcatttgatgtaatgatatttgagatgtgtggttacagagaataaatctatttctataatatgttattacattagtttaatgaatatgctttcaaccaatgaagatattcctcttccagagacacaaaggtagttgccacaagaacttgaattaccctgtcgttgttcttcatttccacttattaatgagatcatatattagctgttgcccatgcaaagttttaaccatcaaaatatcctaattctaaaagtcggaacctagtgagcagaatcatggtccaattgttgattctgcttatagaacatcagttaaaactgcaggagtacatgtgctgaaatgtagatttttacaaaatgggctgtttaccttttcataactcctttgctcaaaaacacaggaccatttattgaggcaaaggaataaaaacaatcttgtcttgacaaggtcacaccaggttttcctagcttaatccttttggaaaactttttctcacttaatccatttcatcctgtagaaagccctgttcagaatttctatatgatactgaaacaataaacagacatgtagggtgtcaaagttctaagggaaaaacatacagaggtctttgaaagagtgtcttccaaaataaaacactgagaaaacgattgttgtttctttggggcatggagcgaagcgatccccttggaaagcacacactgcagaaaatgtaaaattagacatctacctgaacaccatgacttagtctaaaaaaatatgcaactgtgcttaagtgaatttatttgaatatttttactttaaaaataagtaattttaagaaaaggagagcagttagtgcattttcattctgggagcttcaagtcacatcaaaatcttcacgcaaagtttcctttctctttgaactgtaagcaccactctggctgggccaggtgggatgaagtggagcaacagcgacaaagcacaatgacttactttcccattccatcctgatttctcattcatgctttgtttcctttctttaaaggggggaaacagccctccattcatttgctacaaggtccacagaaccatctcagggcttacggggacagtgtgtcaccagggcaactgaaataaacacgaaagacagatgtgaaggctggaattcttcaacggcaagagggtttgacacttcataaatcactgtgtcactctgctataacaaaaactggtctcatgtactgtacccgaggctttctctcgctgtacttgcttgtggagtctgtttgcataccacatctggtttgtcactaaaagctttataaaggcagtgaatcaataagagtgagaaaagggtggggcccttcactctcaatacaataaagtcctcttaagaaagaattcaagaaaccagttactaagaaaataaaaaactaaaaaggtctcagataagaaatgaaaatgctttcaatctgaacacataaaaaagcatgatcttggttatctggctactttcagttggctatgctgttctcaagatcacaggcacaaaatgttgagcatctatttgtatctgtgtctaggtgagtccaaattaactattctgtctttcatctggtaggcaagggggagctcctagtggagttcagtttatttaaaaacataaatgtttgttaggttgaaccgaataagtctgccatcttatgattttcttctgaagaggttacgagaagagctggccttcaaactataattagcaagttttcgaggatgtgtgagtgtttctgactgcttggtaccaaccagatctgccttaagcagagtgaatgggtagtaatcactgtggatcaagatgtatttgctgtttcttttactaaattatcttaacagtgatagctcagggtacttagcagtcattcataccctggtcatgtagtcatacacaatatttaaatgtatcatactaaagaaaacaccatttgtgtctattttccaagcttccattctcttacatttagtcaatttaattataagataaatgtaatatgatttgaaatctaacttgaaaataagcatgtgccatttcaccattagacctatacagatgctcctttgacttatgattggcttatttcctgataaacgaactcattgtgagttgaaaattattgtatgtagaaagtgcatttaatacatgtaacctacaaaacatcatagctaagcctagcctaccttaaacatgctcagaacgcttacattagcctatggtttggcaaaatcatctggccacacaataaactttagagtatgtatgtatgtatgtatttacttatttatttatttatttgagacagggtctcatctcgctctgtggcccaggctggagtacaatggcatgatcatggctcactgcagccttgacctcctgggactcaagtgatcctcctacctctcagcctccttagtagctgggaccacaggcatgtgccaccacacctggctatatatatatatatatatatttttttttttttttggagagacagggtttccatatgttgcccaggctggtcttaaactcctaggctcaaacaaccctcccacctcagcctcccaaagtgctgggattccaggcatgagccaccaagtactagttgtctaccctagtgattgcgcggcttactgggaactgcaactcactgttgctgcccagcttcgtgacagatactgtactgcatatcgccagcctgggaaaagatcaaaacccaatattcaaagtatagttttgactgaatgtgtgtccctttcataccatcgtaaagtgcataaattgtaagttgaagaccatctatatattattgtatgtctttttttctttcttagtcagttcccgctatgttttccaggctggagtgggcagtggctattcacaggatcagtgatcattgcacactacagcctccaactcctggcctcaggcaatttgcctcagcctctggattagttaggactacaggtacaccatcttgctaggcattttatgctttctttttctgttacaagagtggacaaatcatcctcatgcacctaacaatattatatagcaacggtccatagtattttcaagaatgaaaactcttccatgaagcagctgtatttctgttatctgaacactaaaaagtacaacatgacaaaaagtactctagtgcagtaactttttatatgaatttgtactcactagcatgcatattattgggggataataatgctacatgtattctaaggcacatctgtacatgttttattagtcacccatcaaattttgtgatacaaggaaatgtgaagacctctttgaaatatccatggggtcacccaggactttatgcctcacagagccactaaaacctatgtctcctggctctttctcactctctttctttttttctttgtctttttttaaagacacagggtctccttctgttgcctagactggagtgcagtagtgtaattatagctcactgcaggctggaactcctgagttcaagtggtcctcacacttcagcctcccaagtagctaggattataggcacgtgccaccacatgcagctaattttaaaaataaattatttattttttttagagacacgatctcacttgaggtcgacgttacctccagtgatccactttggcctcccaaagggttgggattatatgcatgagttgctatgcctggcctctttctaatttttctggcctcagtccaagtactactgcatgttggagtcaacttcattgactacccaagccacttgggtaactttcttccagccactatgctctatcacatttctggtttttatgaactatattttttattcaaactcatcacactctctaattcttttgtttattcagttacttgaataaaggctgtctgtatcccccattcactaaatcatgggaccttgcctttttaacaaatagatgggtatttccaacacctaaacagggttcatcaaatgtaaagactatttaatttccactgatacagattccacaagacagataaagcaaagagacaaactggcttaatttaccaagttaatatcactaagctcaattagtactgttttttcgtttgtttgtttattttaaccaactatggccaatcttcacacagaccagacaatatttctcctcttttagtgtgttcttacctttgcttttgaaagattttacatatgccagacacctctggaagggcagctatcttagtattatccagagttgggaaatagccatgatatcattcagttatgaaaatcagaaatatgtgcttcctttttttttttaagaaatagtctcagatattcaacttgtttgtcttagatttgcttaaaccccaaacaatctgtgtttaatgtttttggtgtcccactgctttgcaagcagacataccacttgcaaatgtgccagccctttgtgcaaacacccaaaaggctacatcagatccaaaagctctggctcacaagggggccagcaggtggagagcagatgaatcagccatgagtgtgtgcctttcggcctgctaagaaggaagacagtggcataaagagagtattatggttccaggcacaacttcagtctgtccaagaggctctatcgttaacggagaatacagagattacattcagttacccgaattctacaagctttctgtaatgctcaaaaggtttaagtgcacttatctgtcatcccttcactttcctttttgaaataaatccctttgtaataacaaatcagactttccttcttctctttatgcaggtgagcaatgcatgggtgcttttatatttagctggtagggaagaatgacaacaggtagcagaagcagactgtagattattatttgcaattaacaataggagatatagctcccttcttaccttccaattcatttctctatgctaatagaaaataattaaactgcacagcaatttaaagtatcaggttgggttctgaatgaatatctttaaggttcatgatagcaattaatagattcctttttaatgccagttgtttagatcttgataatcaacctgttgggttcttctgttttgtaattcatgtagttagtcaaccaaaatgatactatttaacctcttttcacccatggcaatctttaccgtagatgaagtcactgagccacgcacattctaacttgaaattaccatgagtgactctttaacttgaagttactcacctatgttcctggcaggccagatttgtgagcaaaaaattcactggaagtaacataaagccattgtgggcaccagctgtcccagtaggagcaatgagggagggatattaataatggcaaaacatagttgtttgcctggtcacagaaaatggcccacagcacaggttgagtgagtcacagctgatcaaaaagtgcctcaaaataggaaaatgtctaagcatgttaaaaatgcaacaacagcttcaggtaggtgaaaaacaataggcaagctatactatttatacatcatctactatttactccactaatgcaaacacattttttactactggcaaacagagaagaagaaagttaactacatacaggtctaatgatgctagccatactgaatataggagaaaactgtgaagttatttgcttcactaaaagccaaactgggtttttacacattaggtaaagtcaaacttcatgattaaatccaaggagaggtaactttccttgatatcccctcaggcctagagtgaaccagcagaaaacccagaagtgcagaagggatgtcctttttacagcatctatccacctttgcctatagtgataccacttttgcaattttagaaactttctggatagttgcttcatactcagagtcaccctagaaatttcaatagtagtaaatattaaacttctaaaaattagtagcatgcaagctcccagttttaattaaactcatactgttaatgcagattaggcatatatgtttatatcatacacaaactgcacttctgatttacatgtattaatcttagagtaatagcaaagtataagggaaaagaacacaagcttgatgacctaaagggattttacattcagatccagcattgcctgagagacttttgacagaaaatttaacctctctgggcctctgtttcttatgtaaaaatgaagacaattatattacaactttcaaggattatgagataaaagagattgtaagattagtgggttaatgactgaagaaattacagttcttggcacatacagttcttggcacacagtgtatatagatatgtgtgtgtgtatatatgtatatataaaatgtatatggcatatattcaatatatgttgctgtcttatctcttttttccctaattcatatgttaatgtaaatggttcaattttagtttatttaaagccatgagcaccttacatttgaccaacctccatgcagttgaaaatccatgtataacttctgatttcttaaaccttaaatactaatagcctattggtgaccagaagttttactgataacataaacagtcaattaacacatattgtatttttttatgtattatatactatattcttacatgctagagaaaggaaaacattattaggaaaatcataaggaagagaaaatatgtttactattcattaagtggaagtggattatcataagttttcattctcatcatcttcatcatgatgagtaggctgaggagaaggagaaagaagaggggttggtcttgatgtggcagggatggcagaggcagaagaggtggaagaggctgaaggggaggcaggagaggcaggcgcacacagtttaacttttattgaaaaaaatccatgtgtaaatgaattcctgtgcttcaaacccatttcggtcaagtgtcaattttacttaaatttgaagcactaggaggtctctgattttcttaaaacctaaatctaaattttctttcaaagtttttatttagttagcaatcatatttatactgtactatagaagatatttatgatggatacgggaatgaatcagaattgcccgcaaaggtcaatcaaaagaagacataaggccattttgtgtatagccagcaaatacggaattacagaaatcaacagaaacttatctattattttgtttatccaaggagataaagggatccaggaagttttctactggctcaccatgagccctatgttattctagaatgattatagattcaagattctggattttagaatgacaacattgcttcttgcaataaccattaggtttcaactagaagactcaaagacttcaattggaagagaagcctgatcccagttctagctctgtaggtctacagtgagagttatatttcctctgcagcagttcattccagtgtaaggtttgcctgaaaacattcttcctgaaaccagggctgggccatacatgtggtctctgctcactctgacaggagaaagcaaacagcccagacttgattgggtctgaacatggccaccctctgtgactctgctgtatttcataaggcaaaaagtatatgagttctgcctttctagaaatcatctttatatgtgcttttctattcagtcatggattataaatagattctctgattagtttcccaagtgaaaagtatatagaaaagaacaggatttacttctgaatgtgaaagtacattattttattctaacaactaaatcagtagagcagcaagttatccctaggagatcagaaggagagcaaattcctaaataataaggtcatgtagtaaaaatggaagtatgaggacaaaatgtaagtgcaatgggaaattctactttcttcaatatagtaataaaatagcttacaatgccaggaaaatattataaaaccattagaaaagtctacaagttatgacaagatggcttaaagtggaaaaaaatagggccttcacctatgctgttcttttaatatattgactataggtaccacatgttttgatacagaataaccaaccatattagccacaaaatgccagatttttactttattttctcctggataaatcaggaaaaaatacctttgtgttgggaaaaaatatttgtgcttttattccccctaagtttctggacataaatatgacctggcattttgtctattagccagaaaaccaaaacatcccatgttcttgttttgtttcatgtatgaaatttgaactgcaaagggtataatataatcatataagtagatgtataaatgggttattcagataaactttattttcttttaaaacaacctttttttcttttttcttttttttttttgagatggagtctcgggcactgttgcccgagctggaatacagtggcgcaatctcggctcactgcaacatctgcctcccaggttcaagcaattctcctgcctcagcctcccgagtagctcggactacaggcatatgccaccatgcccagctaatttttgtatttttagtagagatggggtttcaccatgttggccaggcttatcttgaacgcctgaccttgtgatccacccgcctcagcctcccgaagtgctgagattacaggcatgagccactgcacccagcctaaaacaacgtttaaggttcatctagattggggtgtgtgttaggggaatgggataagagaaaataatctcaacaatcctaaaatcattctattgttaaaattaattttccttttcagagtagtctcatgcacattatcttatttcagatgcccaacacccagatgtggcaggtagggaagtttcataataacctcatataacagataggaaaaccaagatgggaacatgtgaaaggaaatgagggaggtcagggaatgactgacaacaaccacgtcagggagaaagctctgactccggggccttctcctccccctcagtacatgaaaaatgtcacaactttctcccccagaaatagaagttatcccaaacattctctacaaatgttacttcagaagccagcaaataaaatgactttcaggaaccacagcttggcaaatagatggacaggaagaaacagtgtcaagtcactgttagcacaaaattgcatctctacattggcacggagctggtaattgacaggcagtatagcaggagttactcttcagctctgtcatctgcaaaatgggaatggtagtacttaccccgctcgcctcaccaggctgctgtgacaactgactgtgataacaagaaaaaacctccatcttcatccccagagcttgatatcaaaacaactaagccagaaagaagacctttggtccttacctgatgggacactcattataacaggagaaataataatgtcttttacaaagctacagacacagcttatttgtgataagaaaacagttttgttttttagtttttttattggcattaatttactcagaatatctactaagtgcactaataacttcataatattaaaaaaggtaaaattcagaattgaataaaaatggaagggtgaaatgtgcttgatcactcagttaaaccatgacagtcttatatgtgtactgtgagtttaaagcaatagtctcaaaagcatgaaaccacctagctaacttccatacacctctattcttggttgtattgagtttgttaattttctctctggattttttcacagctagaatggtcttcctaaacacaacaacaaaaactacttgaaaaataatgtttaacatttctctcagtgatatcattatggtcaaactattgcaaatgaaatttaatattttaattatataataagcactgatttaggtatggggttatattattataagcaataaattgtgactgataggtatatagataatatgttctaggcctttcaaactttgtatcatgacccatgagtggttagaagctttatttgtatagaatacgactgaataaatacatcagagttacttacatattatgaagaaagtattactttcatgaaacttttgtttcaattatgtatatatgtttgtgtacatgtatttgcttggccatttacaaaactaatttcttactatgggtcattgtaaaaaaataactgtttaagaaacactatttagggtatacatttcacaggttgtttttcttttaagattgttccgagtttatttccattttctcagtaattaaattagccagctaatttcaatattggtagataaatggttgctatgatttgaaaaactagtttgaaacattgggatgttagaattaatggtgtctttcaaatcattgagtccagtgtactctgttcacaggtaacagaggtcctgagtagtgaagtcccccctacccaaggtttgttaatgtctgtactagattcaatttatgcaccaggtcaggtaaactctagctgccaccgtagcccaaaaaaaccaactagataagtatagctcaccatgcctgcacactgtccaaactggattctcagaggatctggctttcccagaagctgcctggacactccaggcagcacaatctggaaatgcatgggattttgaccattgagagacaggaaaaggcatggaggcaacagatggattgcttgccttccttctctgcaccaaggcagagtggttctgaaatgcaacctttttggtgccattccacatgatcaagtgaccacttttgttttgtgctgaagctatggctgttttagtaacacaccaccttgtattgctctcctatctttcttgcttcaattcatttttctcctcattcttgcttccctggaactgcatggccaacccccttccctccacaacaaagtattagtatacaagccattgattcatgctgtgctttctagggagcctaggctaagacagcatcctacatacaaatgcaaattccactgtgtattaacaacttacataatgagaaaatagaggtttcaggtattatctatacatgtcattgccttatgtactttaatctcaagaacatttttaggttgagtgcaaattttctatcttttggtcttaaacaagggttaggatttattacagatatcttacccatgctctagcttcgttaagctagttggaatagtcaggataggctagattatgaagcagtaacgaccaacttccaaatttcagtggcctaaaataataaagatttatttcttgctcacactgtacatccactgtaagtcagcaaggggctctgctcattgtagtaactcagggactagggttgacagacaactgctatcttgaaagttgtacatggtcatgccagagagggagaaggaatggtgaagcacatactgcttcttaaagctcctgcctagaagtgacatgggtcaccttcactcacatttggttgaccacagctaatcacatagccacgccaaatttcaagtgggtgggggagtgtaattcaactatacacctggcaggtaagagaaacaaaacctctgtaaaaagtccaaagagctaccacaaatagtatttggggtaagttatctccactacagaaacattttgctcttgatgtctaatccatggattggctgtgatttcaaatggcctgcagaaaatattgaaaaatttggaaatttattttaaaggccaaatgaacataccaaatttaacacaggcatcaaggcagagtgagaagaaggacagagtgggagatctgggctcaaagcctggttatactgcttactagtgtcatggcctcaggtaatctcttaatgactcccagtctggttcccacacctataaaaggggaagcaacaattcccacctagtaggttttgtgtaaggatgagaaataatgggtgatactgtttcatgctgtgactggcatacagtaggcacctgataaaaggcagctggtactgatgggtgtttacctgggacattgcctctcctgtaaagaagtatccaagtatatcattatttctttttgccatatttgtatactttactagtatagatgcactactttgtaaagataattttttgaattaaatttgcaataaatcaaagctgtagaagatgacagatttagaactcactaaaaatgccctttaacgaagatgttttttaaagttctagactcaggttcaaaaaatgtcaactacacaagagtcaaaagagggataagtctctaacttacctaaagttcatgtgaattaatctgagggattctggttaactgtaagctcaccctggatcagtgacacacagctgcctctcaagccctaggtagacttagctactttaattaacacctagaatccagatgaaggggtgtaaccaatgctgtacattttaactcgtatagccagaccacgtacttactgcagtgctcagggtgccaccttctaaacctctactgacaaatgaaaggggcaggcaggacggtgaggctgccgaaggcaggacagatgaggaatgcctaaaaaaactggagacatttaggctggaagagactgtttcaggaaacgtgatacctatcctccaatacctgaagggctgtcatgcagaatagatctttctctgtgccaccctagagaacaggaggaggacgaagaggtaagaattagcccttgactactggtgagctcatggccaagcagaagctggctgctgacctctgggaatacaccagtgatttggatttctaatgtgttttattccccaaccttacaaatctatcagcgtttgggtgtgcagtacttgttctaaataggcattctctccttgccttttcaataaagacattatagaaatactaacgtaatgtgcaggaattcatttacactgcttatgctacagaaatcttgatttagtagatatcccttcaggttacaatttctgctgctggctgcaatataataaagatgctgacagttgtgaattactgagttctacaaattatcaactgcaatggtaaataggagagaaataaaaggtaaagtaggtggctaggtcaccaggggtgatgcctgcctttctgaataatgtaagacctcctgaaaatgatggcaaatagatgcccctttctgaggaataagagaaagtatattgggctctaagtttcaggacatagaggttaatggaaaatgggaacggctttgttttatgagccccactgaagatggatgactggggagatgggcaggaggaattatttcttatctagaagaaactggggttaagagatgaggcaatggcgtgtgaacgctgcatgagacaattattagtggagagctttgactaaaggtgaatggcctgctgggagatgggagacatctgataggtaaagtcagtctggccctggggccatgacctcattaatagttaaacaacagcactgaaaattaatgacccacacctgactgcccagtgaaactgcactcctcttcacaactgtccagaaatcctcacacacattccagcagggagtctggctgccagtggttacagcaatccctctaggaattagccgggttaaatgagtagtggcaagacagatgaagaaatagactttatccggcctccacggtccaatgtgggacggaagaagcatggaatttctaagaagtacagactggccatattgaaggtatttagaaaggaaagaccatgaactggtcctctaccacaattggacatgtggaccgaatctgagtgaggaaggctgggcaccagagtgacctctaccccacctgccatatggctgtctgacaaaagcgattcgtcaagcatcctggttgccaaatatgctggctttaaaatgccatgtgaagcagagaatattttaaaagaacagtctaaacaacctcataattttaagtatgaatactttacgccagacacaagattacctaaggtgttcacaccactgttaaggtctgaggaaacaaagactattcccccgggtctccaggttgtctgctttgtgcacagatttttgaaaatagagtacaataaattccatgcaccacagctcacggcagctaaagacggagctcctgagatgtaccttttttatttattggcgttggagaagggaggtggtaatgtttcctgtattggatgccttatactttgcagacctttggggactcatctctgctgaattctttaacagctgagatgacagggatgtccattacccaaatggacagcactttctattgatcagggctccacttagcgatctcatttgtcatcctattgtctctcaccttcactgctctcgatatgaagcggggggatctttttttcaggtgtgagagagttaatctacattccaagcacaactgagcaattaaaacatgtaatgagcagaacactttagtgcttcacctatagagaagtctgaattgggcttctttctatctcccccatacaggccacaagaagctaaagaggtaatccactcctgaaaaagcccagaagaataactataatacttttcaaaccttagctgtgtcaagtgcttgctttgcttccatttctgctttcagaaactcattttaaaagataaaaaagaatattacaggaagaaagcccaaatcccaacaaaacaaaggaaggtctacctaatcttgccagttaatcatttgggaaaagtcctgctctgcatctaattagatcattagatccatgcagttaaacatccatcaagaattctcctataaaaggtatgttttatgtagttcccatatacggattaaattgggcatgtggaaagcaatgttgatccatttaatggactcccccaaaatatatatcagcatctttgtcacggagctagacggcttctttatcctttcaccaaaatgcagtaacaaaaataattaaacatctctcagacctgaactgcacagtcattagacaatagtcaatgactggaactgccgtgagagcctgaaccacactttaccttggcttttctagccatttctattcggaaagctttccatatctggatttcccctgagaactattttatgatgctataaagactgttaaccagaggcaggatctccccagcacctgagccacacacagaaatatcaaataacatttaattgctggatgacactgtgtgtctgagcttgaattctgatctccaaatattatccatgcaactgtctgcagagataaggttgttatgataacagcagataaaaccaattaaacctaagagcagcaaacacttcaagatcttgactttcaccgtaaatagagtttgaggatgtataaactataaggggtctgatactatcttccttctgtaaggaacattacttgaggcttctttccttttgtgtatatgggggactgcttccatgtaaacacatgagctaagagaaagcaacacatgcaaactgcatgagctagtaattagttttatgtctagtcctggaaagcaaatgacaataaagaatgtaaatctaggtcatctttaaatacataatactagttgtggttgcaataatagactcaaacatgctattctaaatacactcagcacaatttttcccttttcacatttcagaggcttttcttctttttagctgacaacattctactagtgtctctagctgtttgtacacatattatgtctgctttgtgatatgttttgcagctccaaagccaaaacaccaggcagaagtgccaaaccttaacctcaagttacttctggtagaccacatataaggagaacagcactgaattggggtgaaatgaacagtgtatgtgagctccccagaaagcttatcaaaatctgacagctaaacaggatactagcaaatttatcagccaaatgatgttctaaaggaaaacaaaattgatacaaaggaaaatagtatatcttcaaagggagcctgattctataaagcctgaatttctttcatgaaaaataaataaataaaagcataatgaaagtttgccatgaaggaaaatattccattttctttttaaaagtgactttctatatttttggtgtgaaaaatatgatgtaccttcctccacgtatgcctttttgatgaaaagtggaaaaaagtcttagtagctatttcatttagctatgtctcacacctggggtataaatagagtataataacctgtattgtaaagagaggagggtaatggcagagtggcattcaacagcggtgggtacctaggtaggtagacagaggactgcagacttagaaaggaaaaataaatgtcacatacactaggtgaacaatgactgtttgtagatttgggagaaaagaggttggaggcctaatgacccccacctaacaaataatacagtatgtggtttaaaaagtaggcaatttgccagtagtagcagatgataaataatactgaagaacttccaaataatcttcctccaatatatgggcctgattacacctttactaagactatgatgatctaaagaacaatgcagaaaaacatagagtcaaaaataaaacaaaaattttcaaagaatggaaaataaaactgataagattaatcaaatgataaagtttgaaaagaaaaatatatttacctttattatatgacattatttttatagaaaacagaaactatatattcttaaatttaaaatggaatatagagccctctaactgcagcataaataatttttattaactataagaagtttctagatttagaaaagtcaaaggcaaataatgtagtgtctggttcattttcttactcgatgacagttttttctcgaggtcgttatgggcaaaattaattttaattaatgttagtcatgaagatcatcactatcattactcccagttaatattgatggaacatcaatactgtgtgcagggtttagaggaaatactaacatggtttgttttataaatagccagaattcctcactcattgtctagtctacacttgtctatctggaaagctcattcttcccttacccttttaaggcacagtgcaccctctcttccctgctgattccctggaatcctctatatccctctccccactagccaagcactcatcagtggcaggaaccactgcttgagccagtttgcatacttttatcaccacgtacctgactgatatgagggaggcattcactgaacttctaataagactcagatgacaccatacaattactccttgttctatttcttttcaacattctcactgccagagaagcagctaagtttaataataagacattaaatggtggcacatggaaatcttcaaataatctgcttgtttcataccattcacctgtagcaacaggccgaccctctacacagagaagaaatcctaatttaatagggacagagcccaggcatctgatattttttctttagcaactcaggtgattaacatataactagggcagaaaattactgacataaagaattaaaacttctttcaaatccttcatttcctaccataagtcactcaactgtatctttatactactggtggtcacatacattgttattagaattattctatacttttgtttcttatattgcatgcctagcacacataggatactgtttataatcttatttctaaaggatggtcaacataccacccttaaaataaagattgatgaattctatgtccaaattcttaaggcagaaggtatttatttaaaatatatcaaacaggagctcaaagtcttgcaatcagcctgccaacatggcaatcaaaaaatatgttttggcactgacaataattcaaaacacaatttacagtttggagacacagggaacacacggcaccctcaggaaacttatactcaataggataagaagtagatttttcggccgggtgcagtgggtcaggcctgtaatcccagcactttgggaggccaaggtgggcagatcatgaggtcaggagtttgagaccatcctgactaatatggtgaaaccctgtctctactaacaatataaaaattagctgggtgtggtggcggctgcctgtaatcctggctacttgggaggctgaggcaggagaatggcttgaacccaggaggcggaggttgcagtgagccgacatcgtgccactgcactccagcctggcaacagagcaagactccgcctcaaagaaaaaaaaaaaaaattgaagtagatttctcaaaactaatcaacaattagcaacaacaatttctttcattagtatattggtttataagctaaaaacatttgtctagactgggtgtggtggctcatacctgtaatctcaacactttgggaggccgaggtgggtggatcacttgaggtcaggagtttgagatcagcctgaccaacatggtgaaaccctgcctctactaaaaatacaaaattagccaggtgtggtggcaggtcaaggtgggcagatcacgaggtcaggagtttgagaccatcctgactaatatagtgaaaccctgtctctactaacaatataaaaattagctgggtgtggtggcggctgcctgtaatcccagctacttgggaagctgaggcaggaaaatcccttgaacacaggagccaggagttgcagtgagctgagatcgtaccattgcactcctgcctgggccacaagagcgaaactccttctcaaaaacaaaaacaaaaacacttgtccattcataatcttatttaatcttcaggatgattccatgagagatcatgaacattttactgatgacaaaagtaaggttcaaaaaggtagagtgctttttttagctcacacagttattaggtaacagagccatgcaaaccaaatttctgaatgttttaccctacatccagggacaaacatcacgctaattactgtgcagtattcaaaagaattaaactatggtcgtgagacctcagaggaggttgtaagctagttatggaaagaagccagatacacacaaatgattagcacataatacactggagtattggcaaatattaaatgatggaggtgagtcagctgtcctccagggctgaagaaaaggggtatattgagattagaatggtggggaaggctattttatagggtggaccttcgactgagtcttaaaagattgataaagccattaagcaggaagaggggaagcagaagctcgatgtataatgtgtcttgttatagtcagtctggaaatgtcaggctaagaataattccacaaagggtgcatctccaattttcatttagtacgtagtttgaggccaagaggagttcactacagctgagtttactcaacatagggaagcacctggattcttctctcagatttgtccatccaaattcattttcttataggaaaaataacaatttaattactgaggtacttactgatgtttactgagtacttactgagcctctattatgtgcaaagtactatgcttgccattctgacaagtacaaagcactgtttatgctcttgaatctcactgggcacagacacaaaaatttagatgcccaaattgaatattccattactgaggaacataagaatggtctgagcagtaagtacaatgaatgtacagacaggaagtgggatttagatgagctggatactgacatggtagtcttggccacttaatagcacaagcaaagctgacaaggggggatgagtaaaatgtattcagtaaactcatctgacagtttgtgtagtatctactctgtggtagggtggtgtaagccattggagatacaaatttcaccaggaatgtagagcaggcatagaagattcaagaagagataaagtggttactccacgctatgttcgtaattttgtattccatttgtaaagtccgaattcagctgcaatgatgtcatgtgaacatctgggtcctgggtgtaggggttggaggagaatgtgtacctttctaagcagtggttcctttgaggcattcagcttttctcttttgtcaaggctgccttgctttgatatggtttctgtatttccggcttatacaattaacaactgcacacatgggaacaaaagcgactgtcacaacattcacagcttgtgaggcataagacacagagtatgcactggtacactaatgaaaaggcagactttaaaatcccattcataccccagaaagttcacagcacactgacatgtccttgggagctgcctggaaacactgggttctttgaatgtggtcctgatcattttctcagaaagataatcatgccctacatgcctggactatttaaggccacatgtgctaatttaatttacgatgctaaaaagagctgcaccatttgcgaaggcagtggaatgcaaagggctgctccgagccctgtacacacaagggatccccctgatcctctgacactgggaaagagagagcaatggaaaatactagctgtggcatggctgtgggtaatagtgcttaatccatgaccactacaagcatggagatatgcttggaagggaagtgagatttaagcaggggaaggagaatcactgacttggaaaactgtctcaaaaaaaagaaaaagtcttgctcttttgcccaggctgaagtgcagtggggtgatctcggctcactgcaacctctgcctcccgggttctagcaactctcctgtctcagcctcccaagtagctgggacttcaggcacatgccaccatgcccggctaatttttgtatttttagtagagacggggtttcaccgtgttggccaggctggtctcaaactcctgacctcatgatccacccacctcagcctcccaaagtgctgggattacaggctataggcacaagccacagcgcccggccagaaaactcttaaatggatacaaaccagtcagcataccattggtgactctatggttatttaactctatggttaattaaaaggagaaagtaggagagggaaatcatggaaagaatcattcacgccacagctagaggtcagaacaggctttcgaatgtggcttttgaagtcacaccttagctggtggcttcctgcctcaaactacatgtagggatccataaggtgcaacatctgcctttcacacagaaatgctcatcagcttttccttagccatggactatttgttctaaaggattctaagagggtgaaggaatgctaactccttagacagatgatctgacagatggactcaagggaggcaaggctctatcctgggggtgaagagggggagggggcaagagtcaaaaagcaaacaaggaaaacacaaagggcataacattctcaagctttatgaacatacataattatgcccataactaaaatacatagtcaagacagaggaagcacaaaatagttattctaatgtataatctaaaaccagattgagaatgcatgacaaaacctgtttatataagtttgctacggctgtaaaagaatacaatataaaaagaatcccatttattcttgcacatatttaaaaaaggaaaaaagtctcattgaaatgaaaattatgtcaccgaacaaaagctgattatctgctaactttctgccctaattttatgaaaacagtatggcaaaaaatatgagcagattgaagaaataatgtaattgtataatacatatgaaaatgttcccccaatcaatgaggtaatcaaagatatagaaagtcaatcacttttgctataaattattaaagctaatgaaaagatcactcaatactctcagatgctttaggagtaaaaatttgtaagaacttatcaaaagcattattcaatatacttatactttaaagatcttaaaaatgttcacagattttgagtgagaaagcctaattctgggaatctaccctaaggaactcattagaatatgaataaacatttctgtttagaaattttaatcaagaaaaaaaattaaggctgggtgcagtggcccatgcctgtaatccagcactttgggaggcagaggcgggtggatcaggagttcgagaccagcctggccaacatggtgaagccctgtctctactaaaagtacaaaaattagccgggcatggtggcgtgggcctgtaatcccagctactcgggaggctgaggcaggagaatcactggaacccaggaagcagaggatgcagtgagccaagattgtgccactacactccagcctgggaaacacagcaagactctatctcaaaaaaagaaggaagaaagaaagaaaaagaaaaaaattaacttttataaagatttcaatgggatgtaaaagtaattataataagtgatgaaaattaattattaatataattacataattatattcacggtatgattatagcaaggtagaaaaatcaaacaacaaatgaaaactttcataagtatacagacaaaatactgaaagttaatttatcagaatgccaatagcaattatctatgtgttcttattttacttttaactcattagaattttacaaatatgttacacatgataaatgttataatcagaaaaatgtaatcgaagcctaactctagcaatagcaataaaaatcaccacaaagttacttcatgaattatttaggaagaaataacataaaataaattagattagcactgatatagtcagttttctctagtataacattgacctgaaacttgtgttggttacagattgcactgaaagagccaggtggttttgtctagcaggcaacttctgtgtatgcacacacacaaatcccagattgggacagacacacctcaacttcaagctcagtaaactgaaatgaggaaaaaaaatttcttttgaagtagcccaaagcttaacttatagattttatacttgataagaggatagggaagaaattagagccatcctttgggaacttgactcagtcacatgtgggaaattttcctggttgatctgtagaaataggccagccaccattttaattattctctctgttctaccatctttaaacatctaaattatttttgtattgtaaatgtttggcaaacagactacagttttatttttatatctgtgttgttgaagaataaaagtgaacatccttcaaagtcacaagttctgaagcaaatgatatagaaaaaaaatttaacactgaaaattctgaaaaatcaactttcccaaaacaaatcacgacattttgttaagatctgattatatttaactcttctatttcccatatgctgaaagagttcatatgagacaatggggccacactttcagggggaaaataatatgtcttcttaagtctttctaattttaaagttctcaggatcataatattgtttaaaaaaagtcaaaatcttgaaaaataagaaacaagagcctcctgcttcccaagctgtactgaaaggaaactgtcaaagaataaaaagtcaactctgctaagagttccatttctctggtcctataggcacagtgagaatttcctgtggaaaagacaagtacagctggtgtccaattagtaaaagatggtgatgaaaggatatagttattcagggtctgttctttgaaaatgataatgacctctgatttctaagttccataagtagagtctgccgcctgcatgcaggctgctcataaacttcccactttcctttttctgtctgtgttgttgtggtataaggggggggtgcggggagggggtaggtgctggaggtacagaaggtcatgccttctctgccggcaaatatgattaatgtgtgtacagggaggagaaaaacgccactcacctggctatcagccagcctgactcatgcctctgggcatcttagaacaccaaatatccagcaactctggctggggtctagagagatgtctattagctttcacaatgtctgggttaggaaggtgcttctaatcttgtttgtaataaatattagttcaattgttagaagtgtttttaatcacctaaaaggaagtaaacaggcttgcctcacaacctcgacaggcagtgtatgtgtgacttgttctttctatccggaatcactcggttcaaatgctcagagggaagaaagatggtcataaaataaaagtgttatattaaaaataaataaataaataaataaaaagtgttgacctcacccaggcccatttaccgcactatttacactattgccacacagcctggcagcaccaggaacctgtgttcccaagaaatggaagaggccagcagggaagcacccatgggtctgctccaagcccttcctgggcagggcttcccggcagagttacacaacagctgatacatctgtgcacactcccggagcctccactccgacaggagctaaattcatccatcagtgagaaaacaaagtagaagggaaaaaaagctggggactccaggttaaaaaacaaccacaaaagattttcaaagcaacttcttcaaaggcccttttatatttattttaaggagacatttcaatttaagtgacgttgtcaatcattttctttttcaaatatgacaatgctattttacccctacttctttctcatggctggatggaaatgaaggggaaagttatcttccttacccaaaaaatcacacaaagaacatcttggcaagggcaaataacttaaatgttttgttttcagtgttcttaatttagctattttccattaacttactattgtcataaaaaagtgctctgattaaataaactttatatacagcataccaaatacttttctgaagttatcgtttgggaatacagcagactaaaagaaaggaagagcatgggctgctgctcacaaagtggtgaacatgccaaagtataatttaaaaaaaaaacccttttttcataggaatgaaaaccatttcagaaaccattaagccaaaatgtaggctacaaccataacttttatatcctaattattagccttggtgaaatgatcgtgtgtataacatttaatatgctgtaaaatgggatttcaaataccgaacctataagcatctcttacattccatagattccgaagattaaaaccaaaatcaaaaggtgcagagcggcagctctgcctccctaactccgtgaggggacaggaaatcagggtgtagtgtgttctgggcagtccaggtatttgaaagagaagcagcttgtcaggtgggccctggagggaagcccattatatctgtgggggtcctgacatttggggtaatctaaaccttgttacttgcgaatcgcccctggtgggagggagatttagaatggatgcctccttacccaagcaattagatcatttaggaaacagagaaaatgggcaataaggatctccctcctagagagcacttgctggtgttcaatcagatagttctgacaacagaagatgtggcatttgctgaacaaaacagtaaatgctggggctcagccccacacagggctttgaaaatctctcaacgcgtagtgcacagagcatcacaaagctatcacctagcatccatagtgtccttgaacacctgaggaccaggcagaacaaggatgcatttttttttgtgagtaacctctgggagtaccaaatgcaagggcttcttacagaccaggagcaaggttgttcttgaagagaggttgtgttctgtgaatgatacaaaactctgaacttcaaattacacaaaagtagcacttggaaaaagcaaatgatgaatccttgtaagttctagaaattatcttcagagccaacataaacactttgaaggaataagagcaattcaggcgctggtcctgcagaattaaccactccctcctcagtgttcttgggatattcctcagttatggcactcgtcacgtcaccccatactagaattatttctttacttgccaaactccctgagtgcctggagaacacagaatgtcttattccaatcacaacccaaatatttagcacaatgcttggcatattttaattgctatttaaatataagctgaaaaaaattaagtaactttctcagatatgtgataaacaaactccaaaaaactaccatcatctctgatcattctttaactcccacaatgtctacactgtcattttagttatcactgtctacatccccatccttgaggctgatttgaagccatgtgacttgtaaaaaatccactgatgacaaacataaccgacaacatctaaaaggtgaatgacaagcaaaagcacatgatgtctaccgtctaaagccctgtctatatctcagctgaggaaataaaagtcacacatcgaacctttacttgccttaaagatgtgtgtgaaagccacatctttcacaaacattacctgcctgtcacggtatcagggcttggccgaaggccttagtgttggttcagtaatatcggctgtaagccagatgtttccagagctatgggccacattttcaaaaacacatgcagtatttctaatgatcttatatgttgggtatattgagtatgaaattggttttctaccaatctgattaaaaaggaatcacccgcaggaaaatatttcctgaggactgcaggagtgaaacagaggccaaagaagcacaatgaaaacactgcagttctacctgggttttagcaagtgagccctaaccctgtttcatgaagtaagctacctgtttctatacttgcatccattcattaattaaggatgaggatgtatttatttttccagatgcccttacaggatgatgtggctcctagatggttaattacttaagccaaggtcaagaacctgctatgggaaagccacttggagctcctcggcaacttgtgtttagctcttcaatctgctggcatcaaagggaaattttcaacagcacacaaatgcaagggagttttgttggcaagaagggcctctgatggctctgtaatcaactcggcttcaacaggccttttgcacagaccaaaagcaactcaaacttttggaaagccattcgtttttttcctaatcgaaacactgtctcttgtgtcctaatgtcctgttggaagtgatttctatgaactaagagaaaattttgtctgtagcagtttgaaaacagagcaaatgacacttctgcaagcctgacattagtgttttgtttttaattgaaatccaacatcaaataacatgcctgcaatcagaagaggaagagtggacctttggaaaaatggggtttcagtggatttcactgcccagagagatgggggctgttttccatttcccttaagcgatatcaaaagttgtattttttcaaatacagaagtgagaagcagaaaaaggtagctttccttctcttcctgaagtatagaaaagagctagtagacaagtctcaaaagataacacaatttgtaggggccgccctcctagcactggtgcggctgctctgctcatcctcacaaatcaatctggtcatctccagcacatctgctcaggtgctgacaaatgatgaattccacctcagaatccataagcagaaagaggctggctgataaacagctatgagcggaaatgtatgcacctttcataagcaagacaaatcactcattctcaccaaatgcttccaacaggaacactaattctgtatttatttgcacagcatatgtactgcgtccgaagcagtgcattaaaaaagatctcaggcagccaattgctttgattactttattcatcgtagtattacaagggctcaatggcagagcaatgaaataggaagctagtgaagactgaaacacctcgtcaatggcttgtcagagttgaaggtttttctggtgcgtaaaacacacacacacacacacacacacacacacacacactctcacccctggtgtaggaaagaattttttttttaaataaaatactgtggccatgcatcttaaatttgccatatgcctttcctgtcaaccagcagttatttttattaataactccaagaacatatcatggaattcttttttgttttgagatccggtcatgtgactccttcaacaccagggaacactgggtaaattgtaatgttctaacatgccaatgaatggtctcttttagagccaagttggtgatgaattgatatttgctaaggcctaagcaagcacagggcactatatatattccttcttctgtgctctctgcaatgatggatggaagtaaggagcagaaaagaagtcacacagacaagctcaaactgacaaccaagcaaccaccagtggactgtttcaatcaagctgcaaaagaagtagctttttgtattacttactgtagcttcattcgcctactgtacacatggatcatggatacactgtaccattggcctgtctgaaaattggaatgcagtagaaatagcagaaaagatacaacttccttcgggcccctagaggaaggtcttttaagcaaggcattttcccatagatgccagtacgggaaattcatgctcccatcttcatgagagatctgacttttgagaggaaaatcaagatgggtttgctgttttcctttaataacactcatacctcccaacaacagaaacctctgggaccacaagacaggtgtgatggtgtcacatagtatcctccaagctttgttctaacaacaaagctctcttggttaggaatttctggtttacagtttaaaatgttagcgtaagacactgatgttccaaaaaaaaaaaaaatacaagcctacttcatgaaaccaatgcctgttgtgcaaataaatacagagttagtgtttacccctggcagggcatttttctttgagttggctgcagagcattaaaaaagacattaagtagattatacatttacatgaagtcccttgttatttttaaccataaaaaaaaagcatttttctttttgatgatatatatactaattgtgaatgattacaagaggtgactttgtaagacagtgtaattgtgtttttttcccccacagaaatttcacggtaatgtaactttggtaaaatagcttaactaaaaatctgttattaaaataagtgcttttggcttaaattgaatcactattttttgaacaaataaacaaaaatcataccctaaaatagcattcaatttcagagaaggtggtttattctttatgtagtaagctcaaattcctaagaaggtctatataaaattctgtaaaccctgtctaagttaaaaataattgtgaagaataaactacctttagaaagattctagaagaagccataaaaatcaagtgatttgaaccttcattttccaatgacgacaatgaggtccagagaggcaaactaacctactcaaggaagcacatctaacataactgaaactcaactcaaaattaaacttcagaatccaattcattatttcagttgaggtggagtgaggaaagactacctacactttttaaaaatttttttgaagtttagaaccaacataaattttattaaacaatggacttttaaaacaatctctccccctttcacaccagaacagtatggaaaaattggatatcacatatgcaatgctacattaatggtcaaaatatttttttcctgaaattttgcttcacatttaatatgattatttttataagagcaataactaaaaataaaggaatgctgtagatataccttcagatagtttttttgcaaggtgagtaagtttctaaaaagattgacaggtaaaacttgaaatttgggaaatacgtgcttggattcctgttgtacaacgggctacaaggaactgtcacataaataacacagcactgaaatgtacagctgacgtgagctgttagtaggagcagtgtctagcagaagtaaagaggctgatgctgagtatctgttgtatcagtcctttgttttaaagccagatgtgcaaaatgtgaaaccacctgtcagtttcctcatctgtaggaagcagtctttcaaaggtgtgttggctttggtggattatggtggtaggactagtactccaccaagttcaacagtgtaaagtggaagaagtctagccaagtaaaagtcttcgagaggatttgctctagacgagattaagatccccaaaccctccagtgtctgaattaagtaaaatgacacaattctcacacttagtaagaaaacatatacacttacacatacacatttttgcaattacaattgtgtaattgatttacccaatagtttttccagaatgctttactttgcaggctggatatttcttttctatgcaatctagctctagagaagtaaaaattcattcaaagtatgccaagaatgttgcttcctaaaatagtggtcctgacacatttcagagtaagaaaaaaagaaagcccaaattgtaattgatttacatgatagtttttccagaatgctttatttttctttcggattaacaattaatagtggtcaaaaacactgaggcttttaaatatataggcacctcaccaatttgtctggtaattaatcaggaaagaattacatgctgtaatcctttaacacaaagcagacattatttcatttgatccccacaaagtctttaagataagcaaggcaagaactatcctcattttacaggtaaggaagtggatgctcatagtttaccatactcatattgttaataagtagcagcttgttagtcccctcgaacagactaagagagaagtatccagtccctaagagtaaactggggttcttttgaacagatgggcctggaccatcgaattgtgtgctcatccataccgagcacccacatctttctctatctcacagtcatcaaattcaatctcttcagctctcatttcaagcctgttgggtcccaggcttccacagtggtaagagggaagggagaagggccagtcctctgatgtaggatgcctctgcgtagggatgtccctgtaagagtcctggcagtggcctgggccttgtcctgggatcaggcattgctgccctgagttctggctctggccatgaggaatgagcagccaccttcccaggcctcctatgctgtccagatccttcagcacccatggggttgcctgacccatgcagaaatagcacctctcaaatgtaaaaagggattggttagtacctatggctctctggaaatggaagtcattccttataaggtatttgtctacctttcaacttttggatttttgactgtcaaacacatttttaggacagtaatctgtagtcaagctcattatagggtcttcttagaaaagaaagacattaacaaagaaaactgtaaaatagctgtcatcatgggcaaagtgccctcacatggttccactaaatgcagagatgcttttagatgtgctcagatttctgatgggtacacaaaactgtggtcctgaaacacagggaacaactcttgtcagcaatattctgagatgtcaaatgtcaatttaacatggaaatattataacaagttaataatttaaaagttctattttaatatgattgaatcatataatactaatagtaaattgtcattgatataatcaataagtgtttcctcatctttatatgtatgcgagacagtgttaggactacaacactgaatttactcctcttttgacagtattgtagaggagaatgattatgcgcttaccacctacatcacaggcaaattgtctaatctttctgagattcaacttccccatttttcaaatgggaagaaaaacacatactttgcagtattggtataatggctaaatgatacgatatatgtactgtaccttaataaggcagttataattttcattcctactttctatattgaaataaaatgtatgcactttagtagacatttctattcccaaagaataccaaactttgtagtttcatttcaatttggccaccatcataatagagacttgtctcagctgaagtctcgtcaaatgccactacttgataatctgcaatgtgacttctagaagtccttagaatattttcaggccctaccagtattttggtattctaggtagactacagtagtattctaggtagtattcctgctaggtacaatgaaatgaaaaacaatcagtttctataactataaatttggtaattttaaaaagctttagtatacaaatatcacattataaaatcaggatgctataaaaattgtttaatccagtagtaccctacattaataaggtgttttaataatatcacataaactttatatagcacttaataaatgccaggtgatgacctaagagctttttatagtataattatgcgtcctaactcatttcatagtcctggccaccctgtggccttagtaccatcatcatctttttttccagagataaaaagatagagatgtaggttaattaaccagccccaaggtcacacagcagtaggtgcagagccaggattcaaacccaggccaactggcattagaatccatgctctaagtcaagggtctgccagtgtttgtttgaaggccagagagtaaatatttcaggctttgtgggctacacgatctctgccacagacaatctgtaacatgtagcttgccaactcctgcttgaaaccattacactcttctgcctcagaaatgctttatatttttcagagtagttttacacgtaactcattcaattctcacaataaccttttctagtaatgacatgttctgttattgcccactggtcagcaagaaaacggaagctcagtgagtatcccccttaaatatccagcagcagagactagagacccacgtgcctggagtccagattgagggatccatacaagaattttttctgatctactttagcaactccctgccgatctccatattcttccctaccaaacaggacacttaggaaacaaatgatcaaagtggaagttatgacacctattttacccctctttgcagtatcgattcattccgtctctttcctgtcctatcagaagaaaggatgtctctgaacatttactgtaaaatttccctacaaaattttaatataaaaacatgttctgaaaaatctcctaggacatgataattcttttaagtctaagaaggaactataagcaaaatatgtaagcttttaaaaaaaaaaggctgttaaagattttacaaagctgaaaaaaatctccactactgtctccatatgaccaacactttcagctaaaagtgtacttttatagcaatctctctcctcttctccttctattgagactcaagttttttttttcaatattgccaaatgcatacactataaaaagtgacttaaaaaattctggcgttagcagagttatgcaaacctggccatttactgtggcccacaacactgcaaaacatgaccagggctctcattacctctgggaacttcttctggaaaaagcgagaaaatgcctaagagccttccacatactagctttatggtaaatggaaatagcaaaagtgttgtaaaaaattacagtgccaataacaatactaagaatgataataataataactgctaatattaactgagggctgattatatgcttggcatcatgctcactatgtattaactcacttgatccccaagtgacccatgagggaagtgctcttaccatcctcatttaataggtgaggaaactgaggcacagaaagcataggtaactcatgggagagaagaaaactgggaagtgacagactcagtgataactacaggctccaaagtctatgttaaccattcttaccattccattagtgaacaacatctggtgtctacttagagcagggcactgtgaaaaatgtaactgatatgtaaagtaactgataacttttatagtatcagtctgaaatctgtttatatgaattggcttcatctcatcagggagctctgtatattcatggagctctccattttacaaagccaagggaatgaagattttaaaaattcagagaagaatgttctgatgttgtcatgtgcaccagatattgcaaacagctatctatggtacagtgaagtggaaaagactagcccatgtaatagaacaggatttctgggtccggttcctggttctgacattttgagcaataatttttataagctgtaacatgtgggcaatagtaatttacctgtgagggttagttttaggggtaaacaagacaatatgagggcactttgtaaactgcaaaaggataaataaatgcaagttgctattttttttattatagccctcctctaaggaattagctttagatataaatttcccccagaggggtaatcctaaccacaaggcaatacaaatacaccaagaaagaaagagtgacagggagagaaaaagaactgccccagtcctgttccactaaacaccctggaacttaaaatatttacttgggtttccccaggggccttattaaactgtgggcaggcagcggccatgactaacaatgggacgagcactcactgcctgctctgcaatccccagtgaccctgccatggctcggctgtggaaacgttagggaagagaaatatgtgacacagggagaggaaagatgggagctaggaaagaaaagatctcagccccactccaccaccgccccaccatccactgctttcaaagcttggtgagagtaatctactccatagggtcaaggccacagtcacgccagggaaggcaaacccatccattagattttatatccctaaaggggagagaccatctccattttacatctccccgaggtgtagttgtttaaacattcggaggagaccttgaccttgaacagaagctcttactggactaacatagcctgctttctcctagtggtagagcaattatctggcaagacactctactttgtggccattgctattgacattagtgtatcttcttgcatatccaatgggaattctacagaattcactaaatagataatagtgatgagatgttgattccttttatgattttccttctaccaaatgaaacatattgaatattgacatttttggtctaaattatatacacattattatcattctgagggattagttcttcacagagtcagttaaaaaggcatttgcatgattctttgttcttaagaaaaaaaagacaaccccacacctagtaacttcttccacacatcattatattttctttctttgcagttatttctggattattatttagcctgggatgtgaaaatatctgatactttacaaaagaaaattaatacctagagttgagaagtaattcctttgaaaaatagaataattttatgataaaaattctatatgcagagtaaaatgagtttcttcaaagaggcaaactgtaacttatgtccagaaagctggctgatcgccctataatttgttagcactgttttaaaaatcatactgatcataacagttcattcactgagacattttatttttttccaatacttcaaggctaacaaattacaaaagggagaaattaattacactagaatataaacagatgtatattaaaagcacacatctcatatgtatcagaaataaaataattaaagcttcgagcaccttttctagaatcctcccattctgatatttcagttgacttttatgccccaaataaaagaagtattactgctggtgattcttctatgacactgatatgggaaaaattaatatttgcataatacatgtaaaagcagaataaaacaaaaacataccaataataagtaatggtgaggtttctctatttatcctcatagaaacattaggtggaagagaaaggaaacaattataatcatttcagaattaaaaaggaggtaggaagaaactaattgataggcaaagagaaatatccatgaagtgtatagggccctcaatttatttaatcctttgattatacctaacaaatatcatgtgccaaatactgtgagatcaacttcactatcagtaataaccctatggattaggcactattttctatactttgcagataggaaaaccgagtcttaaaaaggctatgtaccttggccaaggttaaagtgctactaaatgcccgagccaagatgcaaattcctacaccctgcacatctttggagggacatttactactacgttctgcaacagcagcttctgccagctgggagggagagaggttaccatgctgtctgcctggcagctgtgcatttctctagctgggctctgaacaactcagaaacattcaactcgatctggagctgtgcctcagcaattctcggtaacctgggcattctcacgggttccccacctcttgctctatgcaggacactttgtctaacatatcctgcagagacagatgtagagagttgagcagctttaaaaataatgagtcttggcaaactcttggcttattagcccacacaccagttcacatatgactggaatcctcaaatcagattacctgacaggcaatttcattatcttgctctggtacaccttcagaaccctgagatagccagatacacatcacccattaatctatttggtcagccaacatgcagctttgtaatcctgttcgtgcagctacccatgttcaaccattttttagtgcttttgtgtccactgttatatgccattttgtgtacaggagaagaggaatggagattttatttgtgttacatatttaatttcatcattattttattctacaataattgaggctgaagtcatcaatgtaaagagatttttatcccattacttctcatctagtcatctgaaactgaatgttaaacattctgccatgtagagtaagcactgaccacaacatgggtttaattaacctgtgacagaagaaaggaatgcaaagaatggataatagcttaaagttagatgtaagatatacacattcttctataatcgtagtgtatatagctaatctgattttgctacaactgttcattaaatctcaagccaaaaataatggaaagaaacttctttattaagtagcaacttgctgcaaatctccatttcaagaatatagtaaaaatagcattctttctacttctttctcatctttcacccagaaggctgaaaaagcaggatgagcttcccttagggtgcagagtaaaacatcctggtcctttcaaagcatctctatccaactcaccagctcatactcctcctataaagatcaggcattccatgcaaattgcacgacacagtctacgctgctggacacattcatgatttcccttcttcacaccttgtgcccctccaaaatatacccattctgagcccttatactacttaccgtctatttggtcagtaagtcaaccccattgcctctctttggcacaaaagtatcctaaactgcctttgtggataaacatgctatccccatcaaggctgtccagacctggcactcacagtttcctatccaccttagtctctcccacatcaactagtaaccaggagaactacatttaatccacacttcctatgtgccaggcaccatgtgagctgttatatgtacacattcttacttaatctgcacaagagtcctattagagtttacaaccaccaccaaaaacctgcacaagttatttggcaacaaactgcaaagtaaaactcaaattttctatgcttcaagctggaactctgttctcctacccatcatagtcttcttaataaataaatatctcagcctggtgtggtggctcatgcctgtgatcccagcactttgggaggttgaggcgggtggatcacttgaggtcaggagtttgagaccagcctggacaacatgatgaaaccccgtttctagtaaaaatacaaaaattagctgggcatggtagcgggtacctgtaatcccagctactcaggaggctggcacgggagaatcgcttcaaccggggaggcgggggttgcagtgagtcgagatcgcagcattgcactccagcctgggtgacaggagcaaaattccatctcaaaataaaaataaataaataaataaataaataaataaataaataaaataaaataaataactatctcaaatccagtggtctgcagcaagaggaagtcacctgaacaaatgccctcataaagccaattcattactccatttcacattccactaatgaaaagccacaggaagactttttttttaatctaaattttgatctcattcaggtccctccagcacatcttacctgccctaaatgacccggtatgtggcagactagtcataccaaagttggaatacttaggaagaaattaaacggctgtttgggcccaaaccttaaggctcctgttccaaatccctctcctaaaaccacctacatctccctcatttctcacagcatgtctatcattatatgtcccttttgaactgtaagctacacagggcacagatcgtatctgtggctgtaaacatatttgccttggtccccagcacaatgcctggtacgtgggaggtgcttagcaaacatttgttaaatgagaaggggcgagagagggaagcctggaggtcaggtggcaggcatcctagcttgagtttcagccaggtacgtgggaggtgcttagcaaacatttgttaaatgagaaggggcgagagagggaagcctggaggtcaggtggcaggcatcctagcttgagtttcagccacacgctgcctcaggaaccacgcagcccactggcagagttgagggttgacaggaattccgagactgcggtgcctggggcaatgtggtaaaagctatttttgtttcctcatgtctaaacaatgacatttgtcaatggacatatacagaagtgaattcaatcctggttagtgtgacattcttctacacgctgccggctcttatctgtgtgtgtactatagttctcctctgtacaaaggggatttaaaaagaggctctaatatcagagattttgctcaataactaaaattataagtgacctttttcagagttcctttagagacaaaatagcttgtatatacaaagttttgttaccattacatgtgtttagaagcgtttttacctttgaataatctaaatagttggcctcttataataatgatgtaaataatgaagcagtcaagtggagcggttcacagcatacatttacaatcaaagagacctgggttcagacaatttctcaaaaatattatgcaagataaaacaagcacaaaattgcaatcatatgatagtatctacccccacggtataggtgggaggattaagtaattaaatataaaaggtttagaatagtgcctggcacatggtatatataaatgcttgctgttattattttgcattttaaaaaaagtctgagagggggaggggcattaaaataaacataaacaagaaaaaaaatctgagccccaaagagattacaagacttgcccaagcttacaccgaaatattcgaagttaagcctaaaactcaagttttaacccccactcccggcaactgtactacataatgccacacagattatactgttttttttttgttgtttattttttgtttttaagtaactcgctttttttcctttgccttttgcattttacactgaacaataatttcctagctttcaggaaatagtaatttttaaatgcttaccacctgattatattcattaaagatttccaaaatagtccctagtctagcaaagtagaaatcacaccattattatattattacagagctgaagaaagagaatatatttctcttccaaaacttctatgagagtcaatataattcctattatactttctctgctattttattatccttttctttattagaggtttagatttgaagccactcaagaaaaaggataggaatggaaagagatttaaattgctctttgtccatattaaggccaaagctttagcagataagggcaaagggaaggttaagacacaatggtcaaatgctgtgacctaattacgtctggacttacttattttcttgtcctttcattaatgagaatcatctaatttagactcagttatcatgtaacaataaaagccatatatgtttaaacatatagctttgccttgatgtaattactttctaaatgggaaatatttatggagcagaatcatccaggctgaatcaaaggaaagagaacaaaagaaagttggtttacatgaggtttttgttgtgtttttcttttcttatatatgttctggcacttttatgtttaagccaaaaactggaggcagaaatgaagagaattctacagccagatgggcgcttagatgacagaatggcaagaagggatgtttgagataatcttatgtttcagggaactgacacagtttcgtaaatcactgggatggtgaatggccaggactagggccagatgccctgattccctatgcaactttccttccccctaccctggcccctcccatcaccactgcctctcccaccactcagcacctttgcagccctgctgggtcccattgcctccaaaacccttcttcatggtaacttctgctgtctggggctttattttctgatcattcgttgtgactcttcttcttaaaccatcatttgactctttcatatatatctgtctagcgaaaaatatacatgtatatatatttgcaaccctcttaggatatagtatagcaacaggcccataatgagcactgaatatttactgacaggatgagggaataaatgaattgctcttgatgtttgcagagagcactccctaacagttctctcataatttttcttctccacaatataattcataacgaatgctaactttacattttaccaaagacccaactacatctgtttatgttcatttcactacatacatgaagttttaagtcatatgcacaatcaaaagaatatttatattctctctgaaggaaaatatggtctcaaatataactgtttgaaagtcattcatcacatctctggaagaagtcctcctatagccatcctggtgctaggagtaaaattgctgaaagaaaatagaaatgtaccctactgcaaagataaacattaaaatacacactgatgcctctagaagagcaattatcctttggggagtttatttgctttaaaaaatacttcttgctggatgctttccccccaaatctgaacatatgaatatactttgaaacaaggattgggcatagatattgctttctttaatatgtgttctgaaattgactaaaggaacaggctggctgtggggataatatattcatattggatcctatctcaaacttgttactgtgaaacacttggtattctaagagtattagggtagttatataaaactagatttactctattttctcaaatgctccaacactgaagattcaagcttcttatgctgaaagtttatttttaagagattgcttttacattaaagggctaaagaatgaattactttcaacttcaaattttacataatgcttatcagccaatatacgaagattttcaatttttacttaaaatattgactatgttattaaaagcaacaggccaattaaggcctttgaaataatataaggtacaaaaggagaagaaaagaagaaaaatcacctgattccttaaacaaagtaacaaagtaactagttgacagatgaaatttcctcttctagttaggtattatgtagtctcaaccataaagagcaggtgaatttggctgtgttaaaatctaagtaaaaaataccttgttattcacctttaatattacccacttgtccttctttccattgaactacttgagtcatctcccccgtgccgctgtgaactgtgctcatactttagctggccacaaacgttaagtcaagctcttaaatatccgttctagtttcacatatgctactacctagctgtgtagcaaggacaagtggcttaacgttgtggttatcagattctttatctctcaaaaaggggatggattagacttgggctcctctccttgctcccatccccaactaccctccatatcgtactgcagggacaggccctcatccatcgtaacagcgacttgcttagacaatgcatggagtgaggctccctgagatcagaatcccaaaggtgaggcagagccaggaatggctgcatggaccaagctctaaggatccagaactaagccctatagttctgtaatgtgagcgccacctttacatcaggttctaaagacaatgctcttttttcaaccaacaggcaactactgctgtctatgagacatgagactttatccattaattaactatgtctattaagaacaggtacagcagacagatgctgtataagggatataatccctgttcactatcctaggttccccaaactctacctctttacaggcctgatgagcaaattaagcatacctggacaatttcagtgcacaagacaactgaaacctgcctttcctgctgaaatgccttctaagaattaacaatttaaagccatgattttggtctttacagggtcattagtaagaaatagccataaaatgcaatttataaaattcaaaataaactctgctatgctacctggtaccacttgtgttaagagccatgtgacaagcacctcttagtcattaaataccaggaaaaaagtacacttttttttcttgagatggagtcttgctctatcacccaggctggagtgcaatggcgctatcttggcccactgcaacctccacctcctgggttcaagcaattctcctgcttcagcctcctgagtagctgggattacaggagtgtgccaccatgcccggctaatattttgtatttttagtaaagatggggtttcaccatgttggctaggctggtctcgaactcctgacctcgtgacccgcccacctaaacctcccagagtgctgggattacaggtgtgagccactgcacctggcctgaaaaaaatacactttcatgagaaaattacaactatatgaataaccaggtttccctttccccacagctaacaggagactaaatgccaaatttaatgcttaaacagatagtggacattaagttctccataaaatattctcatctaatacatttctagtttataatttttattccaactgacttttttttaatgtattttttcatttaccactttagacatgcctgaagtaagtgaatatataaatatatacaggccaggacagtgtcacagggaaacgtaaggaaccgaatgcagtgttgactacacagcctcctccccactgggggatgggacgcaccctgccacccttggcagttgaggtcaggctgaccatgaggaaagaaacggtcatgtggattcaactgctgaattcaactaaccacaccagcacttcaacccaactatattcattcatctaggagtttctttgagctcagcaatgttgtttcttgatcctttgacaaaattaatgatgtagcaattcattactgacagggcaaaaaattttgccacaatgtttacaagctctaataaattatggataatttaccaaattaataccagtgaagtgaagcccgcctttttagattttcatttatcattctacctagctctttcctcccctccgcccatcgtctgtctctctctccatctctctctctctcacatacaagcagatagcgtcatttttaagcttatattttttctaaatcagcattctaggtcactttttgtgaaatgaagttgaaagtatttattaggttgcttgcacccacagcaacagtatttctgtaacagattttgacttgagaatcaaagtttgaatatagtataattggtatgttctagcttggtcccatggcccattaaaaaaaactagaattagacataaagtaatgaaggatcctataaaagaagctgagcatcattttttaaaaaagttcctaatatgtagtaaactcaccattgtgaatatcaaactgtgttgagtacctactgtgcagaagacagactcctccatcaagaaatttttaaatctagtgcaaaaaataaaatagaaaagagagcttccttttatacatttaatatttgggtttggaaacaatatattggtgtatgagcttataaagccaaattattcttagcatccagataatttcttgtggcaataatgggaacttttatttataatgtaatatttatattggaacagccagcattaaattactgagctgtttgtgttataaaatacacaaaaaggaaaggcctcattttcagaggattcacaaaccaacatgaaagtcagtggggtacaaaagtaatcacccaccagctctgcaacccttatgatgaccatgagagggatgcatgggttttctcaaagccatacccaattctaggggaagaaaactcattaaataactcctttgcaaagagcagggcttagttaatagtccatgctctttaaggaccaaacctttaaagagagatcactcttatttgctatttttgaataattccacactaacagcttatctccagctggctatcttcggttacatctgactttccccaagcaccccactttcctgccccatcattaaaacctgggagtcatctcaccacctgctccttttgtgttccctcctgtggtcagatgctttctttctcttccaagttcttgggacacctactttctttttattttatttttaaaagttattattattattattgtcattattttaagacagggcctcattcttttgcctgagctggagtactgaggctctatcatagctcactgcagcctccacctcctaggctcaaatgttccttctgcctcagcctcctaagtagctgggacaacaggtgtgagccactatgtctggctaattttcattttttgtagaaatggggtctcactatgctttctaggcttaggctggcctccagctcccggccacaagtgatcctcccacctcagcctcccaaagtgctgggataacaggcatgagccactgcacccggccatgctttcttttcctttccttgagtctccttgtatctaaatttacatccctcttgcttgcactgtggcagcagactcctaactgggctttcggtctccagtctcacctgaccttaagattattctttctaaagtgcaattctcaattctttgcagtcttgttcgcaagtcatcagaaccctccctctaccttcctggtacaaacaacttctcagtttatcatttgagaacctcctccttgggactactatttgcctccatcaggttccctccctcagtcaaagtggtctcaactactgtgctctacaaggattacgcctgctattttcctcctcagcctgcagaggggatgggcaggggctgggcaggagctagggaggctgtggggttggggagggacactctgcaggcctgttgcttcccaccctccagcagctgggtctatttacccaagtgtccagcataaatcattttctggaatatgctccaggcaaagtggcttgacaaattactgttaaaggcagaacttcttgtctctgtcttggctcctagccttccctccattctgcattttcaaaatcctgccatttcacacccttctctcctaagaaatccttcctgaccttcccgccaacatggggcttcctctttcacacatatacagcatttggtatgtgcttgatggtattagttgtatttgccctgcaattagcggatgatactctaattgtcctgtgtctgttattaggatgtaaaaggtattgtattccccaaaagcacctaactcataatacaggtacccaacaaatgtttgtcaagtgccaagatattgaagaagaaatggctgaaaccacagttggaatactttattttgtttttgtttgggtttttgttttttttttttttttttttgatcctaacagccccatctgtaatgacctgggcaggtccctgcagggcttcttacctgatccttgtcctcttctagttttctcaagggtcctttttcagatttaaaattattaatttgttaaggatacatggtaataaatgtcaaacattaaattatatcactgtctgatctaagaagtctttaactagctgaatgggttccataaattctgactctaagaactgaacataaagagttccaacttttcattcttagtaatcttaccacataccctcagcgtgtgtgcttggccagtaagtaagttgtatgtgaccttttcagggatttgtgctaaaagatggaaaactggaactattctagcaaacgtgaagaccaataatatgatatcattccaaaataaagccataaagaaagtccacgctggaactaattggcaccaaccaggaagtgtgatacaatactctcctttccactgaaaaaccttctgtggtttcagggtgaggatgaagagaatgaagaaaaacaaacacaatatgaaattcaaaccacaccaggaacaaaaaaaatatgcgctgaaagaccacagagtagcatttttatgggtaactttcaattttatcaagatagagttaggaaaatagtacgcatagctatgctatgtgacctaaatgccaagttttcattttgttttatattaatattagggcttctcatatttcatctctgtttatgtttacataaattacattatatcaaatccagatttgaagcatctcggaataaatacttgagtagttcttgctaatattttcatagttcaacttttatttttaatgttagtctgggaaataatgtttgtgtgtataaatttaattcaatcacattactatgctcctacattatgttttcatcatttgcacaacaaagtttgctgtttatctaatatatatacatatgttttatgtccatctagaaatatgtattttcctgttttataacagccaaataatgctaggtatatatattaaacacaaaagcctgcaagaaaactttttcctttataatattcatatttacgtgttaagggggcataaattatttttaacttatatggttaaatgattaaagttctataaatcacaaaatagctgagtgaaaacagaaaaataagagctgagtcaatctattttccactgttaggaagaagatggaggagaaaaagttaattttacatgacgctgcataattttactttagctgctgcttcattcagtgactaaacacattgttttggaatatccttttgtcatatgtacagaagggctttgctattgtccctcaggaaggctggcagctggccctgcactttgacccccaaccctgtctcagcaaggggctcattgatattcccagaagattctctcaatggaagaagatcatttaaaaaagaaaaactccaccttatgggctggtggtcccctcgctcctaccctctgctcctgcccccctctaagtgatggcacgcaggaccggtcaagcccaacaatccctgggccttcataaactcactatttttcatgtatatttgatgggtcctttccctcttattcaaagcagctttcacagtcatgttactgggtgagagccttctattctggacttacatttgattaatttgtggcattcatgtgtctaattttctacacacaaagggaatgaactagcttggactctatcgacgagtcatttttgccaggaaagttcaaacgtaaaggaaaaggctgtgtcagtggagatggtttccagctcgcttaaaaggagcttagaataaaacagtctgcttaaaaaataaaacacaaaacacagccatcatttccaatgcttttcttaatgatattttaaaacacgtaagcaaatacctaaatgctgcattccttgtcatgcatacatagatcttcacaagagggagcacccaaaattactgcagcttcacagacatcacacacttaaaaaaagactcctggcttcctttcaaattccatcagtcaacttttatcaaccataggggaagcagaggaggataaacactgcctgcgataccatttgggttttaggttttgggtttcttccagttaagtttgcaaaagtgtgaaagtactaaagaacagaatattgttcctcattcttactatacaataaatacttccaaatatgtccttaaatgcaatcctttgtgattcccttaattaatcttgactaatccttgaaggaaccatgatagcaaaaatttagtgtctagcataaccttactacagtttccctttttaagttctcatttgaatttgataagttaatatttactttaaaaaaatccacatcatttctattcaatggcacttgaacttttaaaaaatgtttcaaagaaattaaagctagatatgattggaaataagcaaaacgagaaagagttgtcctatgtgtatgtagcacaaccctccctgtgtcctttaataaaaagcaggactctggtcattccatgatgtcactggcattccgcaccaaaaaaaaaggtccccacagatcaaattccacttcctttcaataaagctaaagatgaaataaatctttaaaatgcagggggaagagaaaaatgtatataagttcttccagaaaatctgagagggcttgcaaggaataaggcacagaatcaacaaccctggcttccagttttgctgacttacttcaatgaccttgggcttacccttgtactagaggcagaatgtgtgtgggcacatgtacctgtgcatactttcaagctctggggcccgaaaaagtcatttatgtactctggagaggtgagagaataccatgacagacaaatgaagtttgagacacaggatcccatccacccacccctgccccaggttgggatgtccgaaactaagacacccaagactcccaagaaagggaagacaaaaggcagacattcatacacagggctctagcagcagcattctctcacaagagtagcaggaccattaactttataaaaacaatagccaggttccctgaaggctgcagatagggaaaacctaggtggaggtctatatgcatttctaggatatgccaagaaattaaggggtgtggcactgggcactggacatgtgaggcaaagtagcgagtggctgggaatgaagaatgtgtttctaatatttacattcaagttcttttttgttattgttgtttattttattttcttacagtcagggtctcactgtcacccaggctgaagtacaatggctagctagatcatggctcactgcagcctcgacctcctgggctcagatgatcttcccacctcagcttcccaagtagctgggactacaggcacatgccaccatgcccagctcgttttaattttttttgtagggatggggtcttgctgtgttgcccaggctgatctcaaactcctaggctcaagtgatcctcccacctcagcctccaaaagtgctgagattacaagtgtgagccactgtgcctggcctatattcaagctttatacaaacacacatatacccctctgcatatacacatatataccccgtagctatcaaaatacagacccatttttctacaggggaggggaagaaaaaaaggagaaaagacaaagaggaataataaagatcgtggggagagaacaacccatgggaaagccagaaaagagaattgagagacagttagaccagggagaagcctggcaattcctacagagaggacatgcctaggcaggtagtggaggggaagcaatggtgaaatcaggccagcagcagcactgcattaacacttgagtgatcaaacaaagggtaaagccatcaggaaagaaactgacagctgcagtccttaaatgccccaatttagagacacaatgactccttcttccattggccatcctcaaacccaagtcaggaacatgcagtgaggctagacatagacatagactttctagacagagaacatacaaataattgtggaacataacagaatcagaaatgccaacataaataaaacttcagaatttgtagggtttgagccttgtgatgaaatcaactagttgaaaaaacattttttaaaaaatttgatacagaatatcttatatataaaatatacaaaacctcagttttataaaattatcataagccctccatacttttacaaatccttctcggtcttcagattcagaaatggtgtatctataataggaactaattctgaaagcacttaaaaagaacaatgtcaggacagctaaatatatgacttataaaaatcactagttcctcccaccttggttctgttgaccttagtggccaagtccttttcctgagcttttaataaacacatgcctgtaagcaaagatacgcatagttaaatctatacttagcatattaacccccagatgagcataaagacatatgctaccagagatccaggaaacaagaatctgggttttggggctttctgtattgggggtgaatgttcaccttcccacaagagtctcacaatggtggctttcccagccctctaggaaggggcttcctcaaaaaaagtagcatctccaaacactcatacattgtgaagcaactcaaatttccaagtaaaaagatattaaatgtattaatagaaaggactgcagactacccttaaaatatatatacgtgtatatatatatatatttttatgtatatgtgtgtatatatatatatatttatgtatatgtgtgtatatatatatttatatatgtgtgtgtatatatatttatatatatgtgtatatatatttatatatatgtgtatatatatttatatatgtgtgtatatatatttatatatatatgtgtgtatatatatatttatatatatatatatatatatatatatatatatatattcccagctctttgggaggctgaggtggaaggatcacctaggtcaggagttcatgaccagcctggccaacatggtaaaaccccatctctactaaaaatacaaaaaaattagccaggcatggtggcatgtgcctgtaatcccagctacttgggaggctgaggcaggagaatcacttgaacctgggagggggaggctgcagttagccaagattgcaccatgccactccagcctgggagaccaaaaaaaaaaaaaaaaaagcaaacaaacaacacaagaggaaatgatcttctacaaaaggacagtgaactattaaaattccacttcctaagcaagtgtacaccactttttattttgaattaaaatatcagaagatcactgacagggaaaaaaaagtaggccagaattatctggattactgccctaactctagaaagctgacatagcatgaccaagacctacttaaaagctggctgtatctgtttaacaccaaactctgaggagagacctacctcctaatggtgaaagaaactgttttcacattttgagaggcaagacccataaaggaagggcctctaatttccagtaattaccctggtaccttaaagtccgtaattacatagagaaccatgccctgaactggccttcagttggttccaaacccattgcatgtaattagccttgattaatatcccacatttcacatcaacagacacagtgaatccaaatgattcccacgttctgctgcctccggaaacctcactgttcaaattctgtgcctttatcaagggaacatgctgagcaaatgggatcaaatgatgccttggcacccaccttggtctaactattcagagggaagtagcaatgcctttcatgtaatcatcttaatcccttgtatcaactaattaatacacagagaaagcttttacttgcatgtgagcaattatagcaacttcctggtcggtgtccaaatggattcacaatataattcatgaacaatgaggctctgggaaagacagctcctagagatgacttttaaaatgaaaaagtgtgtgtgtgggggtgggggcgggcaggtattaatgattctaatagtagaaaaagaggacagcaagtaaatctcagtttctgaaaaaaaattaatgttggaaccctattgtgcacatgactggcttaaacagaccaattgatgtgagcaaagtaagaaccaataaataccagagtttggattctatatccgtatatacctgaaataccaccaagttacttccaagggacttgaaaacaaacctgctgccattaaataatgggcttctgctaaaaacaaacgaaagtaaactcactctacacagacttctgaaagccatctaagatttgagctcagtgatttcacattcctccctggggggtacctgttgcagttgcacgggtgcactctctcttctctctctctctcaacaggaagtagcacatcagtattttcagctgcctgagaactaatccaagaatggggcccagggcggcaagggttgggaactgtgagcgagtgggggaagagggcttaggggcctacagaaaaagatatccgaagcatcagcacctgctgtggggtttctgctcccgtgtccgccccagccagagtgggaattgctccagcactggggcaacttgtaatccaacctggggcagagagcacaggaacctagtggctcaggcgttcaagaaaaggctcccagtcataaagcaccacattgtggtaacaagccccggggttgcactgtgaacttttcctgtgcagatggctcgctgtcggggaaaaacattacccagcaaagtccagtcaacaagttcactgaatccaagtttcaaaaaacaaaacgcttcctcaatcaccccctcgtgccagactatgctgaagctgcttataaattaccaagggtcatcctctttttttttttttaaagaataaaatgctaatggcataggtttgggctctctgaattaaatactgtactgagccaccctgggaaccagacactatcctctggctagaaggctaaagaatgagcaattgccagccgtggaattttcatgatccagtttccccaccttcctgtcgcatacccactggcaggaaccaaagggctgtcaccctgacgagagaaaacaaagctctgcactgcgttatgaaacaggtttttcctttctcgtagagacactcctttatggcgaggtcatgtaaaacagcaaaatgctcaatgaacacacttggtcctgttccctgcaggtgaccgtacccttcaacttgacctgtgatacagggagagggaaagaaaaccactctccaatttctaagtaaaaggtgaccagacggcagggatggcaaagcagagcctactgttaacaacaaaaagaaactgcaaacagcagcgtggacagacagtcatacaggtgtgggccgggaccttagagggcaaaataaaatgcttctggagtctaatcttgagccaaattgactaaaaaggacagcccggcagagaacgtgcgtgatgtgagttactctggcaccgagaaacctgttcttatctggcaagtacgccccctgctggccgcggtgctgaactccgcctcttggtcctgcgccagacagccctcggagctctctggtttagaccgggggaaggagaaaggagctctggcagagcgagtcccttgtaaagcacacaatgggagcaaagggtgccgtcacagcagtcaccgccccaaaccacaatctttgtccagtcacggttctctgcagtcagataaaatccaagcaagctgaaaagaatgaatacaaacctgcttgctgctttgcaagtgagaagtttagaaagctagggaggagggggccgccaaagggaacctgccatgaaaagattcttaagtcattcacagatacagtgcttgactactggagaaaatctggactaactgcccttttagaagttagagtttactataacgttaacagtaattatttaaattattagcacatggacactgcagcgtaggatcaaaatgcattcaaacaacgggatggaatttattgccaacaaaatataatactaaaatcagttttgcacttccattgtttttttacacatgtcttcacacggacattttcatgtttcttcccaagcttttgccttccttttcacctaattctttgtcatttttgttgctgttggggtcttgcataagcatgctgatgttttgtaagatcagcccgctgtcccttatgatgattcccttcagaattggtgcattcaatgtctttggcagaaaatcctatgtaatactggcttgtgtgttaagctcattcccatcatcatcaattggagacgcttacttaaggaaaactgccaagacgttcagctaggcgccatccgttaagacaaccaaaaagaaacctgtttgtaaaggcgcagtgggtctttcccttactggcacaaatgtcataagtgagtatctttagttcacattatctgcccttagtctcagtgagttcaccagctcaggctgaacttggcttctccctgggacctcaatctcatgtctgttcccagctctcaacttcaaacacagaggacagagaaggcaaggcatctaggcgtgagcagagaaatataatgggcaaaagaaacatgcttcatctcctttgggtcagtgggtctggttttcattttctggtttacatatgaaaccagggggtaagaagtgccagtggaatataggccccaaggacaaatgctctcatttcagaatttaaaagaattttccaaagctagatatctcagtgcttctttacttaatcctgttggccgtaatttttaggttttgtttcttcatgctccttatgcaagcagaagactgtccaggtaaaatgagagtttgtagtcattcttttatttatttgttcaagaaatatttattcagtgttagacctgttttgccaaaatatcctatgtggatagtacagaatacaacagcggcttttattcaccacttcttttagcttgcactatggatgtctatcccagggaataacatgattacgtgggtttccatgctatggtttagagagttcaacccttacctatcaaaaggtctgggaatgagtgtgtgggtctatttttatttataagagggggagaacggaacagttttagaacgaacaaaatcaatctgcaccagttttgggaataagcttctgctgtgaatagagctgtcaagacatttgcaatctgtttggccctgtgtccacaagaggctaaaggtttcataaccaaaaagtaaggatttttattctttaccacttggctagcaggagcctcataagacttggggtgattttagctgttctattacaccctaaagcaccaaaatgcacatctatatttatactcacatgcacatatgtgcaaaataatctgtaagaaaaacagaatcttaggctcactactattttatttcaagtatggggataagtatgataactatcaattggttttcttattgaatttaagacgtattcatactttcttcaataaagtcagatggaaaagagttatttggaagaactcagaggatttttactcatggcttcaaacatcactaaatggtggaaagtgggagtacaaggaagacttttatgaatcaaatggttgattttcgggagtactcagtgtctttctctcatattgtaacaatactaggagccctcccttgcaaaaaaaaaatcattcaataagctctgactgataccaaaccccctcagattaaactcaatatgccattaatatgaaaagaatttgacagtttacataagggatgtgacctggtgccaacaacctctggcttctccattctccagatggtagcagattagtaggcagcctttattctcataagaagatttttttccccccatggaaaaactataaaggccaattctgttccaaacttcaagtttccttcacaaatgtctacacaattctgggccttaactaatgctattaaaagaagcccctgggcttgaagctatatggaaggggggaaaaagactaaggcaaacttaactctaatgcctgtctttaaaagatctattgacagaagcagtggggagagtttgaactaatgttaacttaaagaaaaaggctggtgagattcaattgtggatgtgaatgcttgcttgagtttgatcttgacggggcttaagataagggagataaaaacctaagcctacttacatattaaaaaatgcagttgcactaaattcactacataccactgttctcaatttgatttatgcccatcatcagtgaagatgctgaaggacacccctgtctaatatgggaagaagccacagcagagggcacttgctctgctttgctgatgctaacgtgaaaaaccatttcctgacaatgcacgatactcgttctttcacattaactcttcaaacgtaacaaagaataaaaacggaatttttctttggtcctgttctgaggtataaatataacaagcagttaatcaaagagatccaagaggtgaaaagcagcctttagtctgtaagaaattattccaccaacagataagaagtgatctttaagtaatcaggaaaaatatcatattttgtaaacagactgaccttagtaacacttttaaggatcttcaggtgcactttaaatccagaaagctaagcagacactttcccaaaatgtttgggttgttttgtggtcatcaggacacataccatgtatcccaaaggagaaaattatgtcctctgaggggaaaaaccttttctagtaatcctttgaacccaccaagactgcttttcataccaattagttcataaaatgtgttagagatacttttcatgcagttttaaatgtttttattaacattttctcaagttggtgaaaatgtggtagatgtagcttggatttttttttccaggcaagttagtcatgatgactgagatcctgaaaactataaaataatctattgtagacctactgagctcaatgaaaacaagtagcacagcacatagtccttacccttgaggagtttacattccactatgagaattgggccacagaatgaaaagatttggtaaaaattcaaggtatcagggagaaagagattataaagaaaaaagacagcatctaggattccacctatttaacatgacctatttctagcagtttccaaaatcatttagttaagagaacatcagcatttgccaatagcaaatatacttagaggtcccaagaaataaaagttttcatggaaatctcaaaggcaataaaaaggaaaggcaggatttatttaatttcttttctgcaaactgcctcatttcctaaaggaggaaatgccaggcaaacagtaacttaaatggttgtattaaacactcacccaaggatgccattaatgataactgtccagaacttgtttaagctaaatgtctagttctccaaatgcatcggcagggtacaaaatgggttgttgtaaatggatgttttctagttttctgcttttcctacagtgttctcacagaaacaaccatttccatcatcattatcatactctttttaagtgagaaaagttacatccagtagaggaactatccccaatccagtaactgggaccatcacggcaatcacataacaagtttaggaaacggcttaaggaaatgagctaataacatgactgcacacaagcagattatctctgattgctacaaagaatgctattagggggcaccatgtttccaagtgatcatttttccagcctgttacagaaaggttaatctgccgtcctattcataaaatcaatttagaatcttgccaaatgcaaaagaattacatgaaaaaaatccatcatcaggaactatgccgacatttctttcaattgtcttagacaagactaattcagatattttcctgaccataaatttacccatggaaataaaggctgtatacatgactttatcaattaccactgcttatccagcatgttggagcagactcatgtgagaggaaaacacaatggctgtttataaaggttcttataaagctgctaacacccaaattatttactacatgagaatgagggaacacatcagagaagcttgccatactgttatttaactgcaaaaatactaagcctcctccctttagaatctcagaacaactgctgaagttgtacaatactaaggtgtgatgaaatcccttctctaatccacattctgacagtcaaattgttgcacatataaacccctccaccccatgaaggttagcattccagggttatttccagtcccaaaacatggaaatctgtttcaacttgcccacctatctcagctttagtcagagaattttgcctaaatcttaagtatctatatttcactcttagtttagaaagatctagtggccaactacaccagtttttcgcccttgccttgcagcagatcagattgtgaaatgtaaatcagaatacctttcacctgcaaaatgactaacataattgccaacacaaatttcctcaggccctgagggggttttcagaggcactttggccacctggtcactctgaaacaagtcaattgtgaacataaaactcaaatcttgcttgggaacgtagcctgggaaaaggggaaatttgccattcccagatgaagtcagtttctcggttgggctgttttgtctgtgaatagcatttcatagtttctgtgaaatctaaatttcagatattactgtaggctaaaacaaaaaggaagagctgtgtgccctttcagacacagaaaacccagtgaaggttcagcaataagggttaagatgcaaaaggcaggccgaaacgggaaatttaaggataccccactccagatggattacatccaaggcccacttatctgaaatggaattagaccaaatgtcaagaggaaagaatggccaggcttaccccttcgtgttttgggaagagctagtctgaatgttttgctgacatttgaagtataaaagggtcttattgtaaactctggacccccagaaggcctgcttctagagaactgtgaaaggagagattagttgggggagcctcaccatcggattccacccttcaatcacgttagacacagagctttagccacttctttgcttaaagtcatgcatgtggtcaaaagtttaattatatcaccggctgcatcagcaagcatattgtctgccatccacaggagggataaaccttttttggagcgcgggggttcagacattgctgtggaagacttcctgaaatcttaggttatgcctgacagttggcatttttttccttaactgatcaaagaacatagcctgggtcctgataagattataaaagatttctctcgaattctcaacttttggtgaggcctctactctctcgccaaacagctgagtttttaatggattgtgtctcaagacaatcaaattggcacctttgacataactgactggttctttgccagccagtcattcctccattcaatcaacaagaatttattaaatgcttaggtgctgagaagatgcaaaagtgtgcctctcctagagaagtctgcaatctaagcaaagcaccacgtaattaaactagctatgagtcaatccaactggttatgcatgtataccaggccaaaatccatgaagtctgaggtaactacaaatttcattttggaaattgagaaatgttgatgataatcagttttgggttgtggatttcaggggtggtttcgggcaaggagtaactgccctggacaccaacccagagagtcccaagagggggccacacgaggccaaaaccagttcccagttctaatcagtagaggaaaaaaagtgagaaatttctagaccttttaaatacataactttcagtttgaatctgagtgttctaaaaattgtaatatatgtaaaagaataccagaaaaaataaatgataaatggcctacctcagacttatcaggcaagaggcacccttataagcatccactgttcagagcatctgtccaattaatactgatggtgacagacttttgttctccccaaacacacacactcatacccatgtacatttgccaagcagaattctttttgcagtaaaaaggacatgatggcaacatgattcgcaaaaggaaatgacactgctgtctgaaattaaaagggagcctgcgatgatatggggctggcttctacgctggacatggtaggcccagtgcctaagaccccagcagtgttttaatttcttttaaaataaataaaatccagccttgatcacatttgtatttacaccaacacagtcataagacaaaattttaatttttttaatggaggaaaggacccataaagacaaaagtgcataaatggtgtccacatgaagcacactgtggccctgatcaactctgccacttcctgcttgcccactgcatgccttgaactctacataccctctctactcttcccaacaaccctggaagttaagcattaacactgtccttattttatacagaaggacattatagtgcaaaaagctttggtaatcatgatgcagaagaaagaccatagattttggacacaaacacagctggattagaattccggctcatccattaaccaactgtgtgacatggagccaggttcaactttccagagctaagagaatgaagtaaaatatatacaaagagctagtacagaataagcaaaaaatagtggccattactgtaatcattactactgtttgaacggctagtggctgaaccagcattctaactcaggtctgctgctgaagtcttttctttatccacagtgtttctctttagaactgcatgacagacaagaggctccaagaaacatatagttgtgtgacccagtcttaaaaagaaaaaagaaaaaaaaaagaccacccttgaataaaatcattccataccagaataataataataataaaagccacagttaatagtattatagtccttttctctctctctgtctgaataatagaaatgagcaacatgacttgataatttcagttcaaaaaaagcacagggtgaattcatcatttagttgaaatgttttcatccaccaaagaggctgcaccccaaattcacttccagcagaacttcaatatgccccaccttgctgcacgagtggcacttctgacctttgcatccttcagagatttcactttttagccaaaagatctctttctagttctttgcaatattttaactatataacaaagagacagatgtttaatcaactacaactcagaatatttataataaaactctttatccataaatctcttaacagtttacagtcatccatagcatttcctggactttcaaggctgattttatatgctttgggtgagaatttcaaccataattcagcccctcagaaaggtctattagtggactatataatcacacttttaagggtgcttgacaagtctatatagctgcacacaaattacattttaaagagttcttttcagtgaccaactgccagtgcaattgaagatacttaatattaaaagttaaatatctgacaagaccttatgaacactgaagaatgttccatttagagaacatttttataatatacagaattctacacctacatttaaaaattaggaacatttgcatgagaacagggtctatattttaatcaactcattttctccagctatttatttcctctcacaaggatcttcttctcttcatgatcatctgaaattatgataaattagggtgagcaactgcacagcacaatacttacaccctttcacaggaaaaaaaagaaaaacctgtaatcccagcactttgggaggcccaggcaggcagatcatgaggtcaggagatcgagaccatcctggctaacacggtgaaaccctgtctctactaaaaatacaaaaattagccgggcatggtggcgggagcctgtagtcccagctactcaggaggctaaggcaggagaatggcgtgaactcgggaggcggagcttgcagtgagccgagatgcgccactacactccagcctgggcaaaagagcaagactccatctcaaaaaaaaaaaaaaaaaaagaaaagaaaagaaaagaaaaaagaaaaacaaccacaaacaccacagaaaaataagcatgcgcccacattgtgttgtaccactccattagctgtgtccacacaaaagtgtggctgttttggtcaatttgttgttctccaaattgtagaaatcatggattttaaaatcagcatgttccaaaaaaacgagcttagagaatttcctgatctcagcattgagccagtacgttgagaatatgtttttttaccgtaaatttgtgctttggatgaaactggaagaagactttgaacaagaaatttttaagatgtgtgtgtacaaaatatatggttgtagcaagacctcattaaagttgagcaattcaggctgtgaacaacattgccagccaggctgtttaattcagatctagttccctcctccccagcatgctcatctgccaaaactgcattaataacttccagaaacatcgcatttttcaccttggaacaaactaatacaggttaaactgtttcataaacacagtactgaaagagacctcagaaataatttagtctacctctttccccacttgctaaactttcattccctttgtgatatgatcctgagagattattcattatcatggtcctttaccccggagacatgaaggaataacaaagagcaacagagacacgctgtgcctttagggatgttaacagccaaaaatagtgaaaaattccactagtctacagcacatcgaatatctgattaagctgcaggccagaattatacttcagtttcaatgaaaagtgtttaaaatcagttccaaagccatctacactagtgaccaagtgctgctagagccttcaccgccaggcccaaggctgggattgaatttccccagacagttcactactgcagacaataacagttgccacattcaagtttcatatgttataacaccctgtgatttagactcaagttccacttgtacagctgcctgcttagtgtgtaaatgggaacagggagtagaatctaggtccccagcccaaggaaaacagatccttttatatcttaagagacaaactggctgtcctgaagcctcatgagaacccaaaactcctatatcattttagcagcaaaaacatctctgctcaatattcagaagattttagctacacgttgcaggttcttcttatatgaccaacatcaaatgcaaagaagtaaaagaaaatcagagacagaaagcacctcaaacttctatctctacaaagaaagggagaaaatgaactgctttgcataggtacccagaaaaatcctggtgcctaaagtcttattctaagtacacaggtatcaatcagtcgtatataagtgaaagatgagtgtaacaaaaaagagactgaagacttttacaaaaataaattgttagtaactctaatagagagataaaatattacttataagtccatttttacttcaactagtatagtgtcaaatgtttttgatatgctaaagcatctaccaagtaccagactggaatataacaggtactcaaaaaatatgggtagaatgaacagatatttttaaactacttgtattcatgaattgttccacatatctacataggaaattaagttcatttggggctgagatgatgctttgttcactttagcaaatgtaagacaggatactacaaatagtaagtgattcaataaatgtttagagaacacaatatggacctcctgaagatgctaaagacctgtaaattaccatctttagtcagtttaggaagctaaacaagaaatgtggtattgctcaatttaggcgatcagagaccactttccactgaattctgctacaggccccagaatggaatattttggaacataaaagtgactcctccattactgtccaaatgatattccttcaagctaatgtttaaatgttatttttattttcatcaagccccaaaagtaaatgatttaaagtaaaactaaacataatttctaaggaatttatgaagatcttgtacaaaaaaaaaaaagtaaaaataaatgacctcactctcttttttccctttttctgttcctttcctcttctactctcaccagattaatgtcaataatcccacattccatttcaaacaacagatgaatagatagaagattagcttttcacagaaacagctgtaaataactataatctagttagtaggattcctttatggcttgaagggttataacaacaggagtcctaaatttccctgatcaaaaactttaattccctcctatagggaaacaacaggacatcttctaaagttcaacaacaaggtcatgtatacaacatttatatatatgaactaatcataaagaaccagggtaaagaattttaatcctataaaatttaggtatacaaagatccaaggatctcataactaaatattttctaacaaaaagtgagaggaaaggtagcttaacatcaatcagttctcaatgtcctaagagtgactttctctccctaaaaaatagagcatcctaagagaatgtccaaataagtctggctaaatttaaaacaactcaaagtgaagtaggaataatttattcaacaaaatattctggttcagactgaagtacctggaaaaagaaaatatgaaaatatcaggtttaatggcatagtaataatttggatataaaaatattaattgtgcactactatttactgagcgtcggcaaggcaacagaaatacaatgggcacaatttccctactctttaatgtgaacttgcttttccagacatcttcccaatgaatgagtttttacagaaatgcttcttgcttggtaagaagcaagagagcagtctgaagaactgggcccatccctttggagcatctgcgtgggttacactatggctagggagcaaagacagagtggacacaaggtagaaaaaggatctacataatgggacgtcagcactgttagggaaaattggtttatacctcagtagacagacatgaaaactgcttacttataacaagtactttatatggaattagacagctcttacccattagttcgatcaatcttttatttgatcatttcatgaggcacagacaaactgaatattttcattctctttaccaccaactgtggaagacacccagagccaaccagacatcacagacataggccaaatccaggtaggttttctggtgaccacagacctgcacacttaatctacacctcagagcaaagataagggccataatgctagttcatagttccagaagaatccactgtggatccacacaggctcggcgtccacaggggattatgtatctctagggaaaggtcacatgtaaacattcccaaaggttctaattagctctaggggatatcactgaggtccaggctactctgggaatatcaagattttccccacaggaccaatcagaatccccttaggaaatctacaaaacagaactttgtcctcaagagatcgatgagttgggcaataaaccaagaccactgcttgagttattctctgaggcaacatcaaactttcatggtgactgggatccagtattggccatatttgcctaaaccaacggcctctaaacgccaaggaggcaaactcactgaagatgaaccccattttgatgtccacacagccccaaattcagtcctttcagaaaaaggagtatagccaaggcacagtccaggtagctggctgcagcatttcccctgagatttatatattccctaaatttattatttaagcataaataacctttaaattcaatagttggacatttctctctcaaatattattttggatagtcattgccttcagaatcttgccagtctgtcttctgttgtgcaaaactcaaccattaagaaatttaatgggcacaattaatgtctctgatttgttttccttcccaggtgacagcatttactgatagttactgctgatgagcaacttgctatcaacttttatagttgctcctgcttgctagccatgggactttgtgtgaatttctagtatatagtaggcactcaataagtgtttgtggaacaaatgaacgaatgaacccagctgctgctaaaatactatgaggctccatataaagaatgtaagaggtttgacccattgcaggcactcagtaattgaggcaagggcagaagtggcggtgatggtggacaaggtaatcagagtggtcacaacgtagcaagtcttcttctggttattctaatgtagggaaaacaagcacatcaaatggaaaatattccctggtcagtagggaaagtcaattgctgatattatgggactagtgaggatcatgattacagatgggcagtccccatgggctacaaatggtatggaaatctaccctgggaataaatcccttccattcctgcaatggatggggataaaagtggaataggatttgaagaacacagtttcatgcaatatcaatggcaataagtaggtacaattttctgcttttcacttatcataagagttactggatggaaattctaagttaacttctagaaaataccaagcccaaggaccctctcataggcacccagcagctggcttattcctattgcactacatcaagggcacaaaggagtttttccttataccctaaatttctttccatttctgatggcagcaacagccaattcaaggcaagcaggaaagcagtttggggatctggaaagataaattcttctaaaagagggaatgatagctcagtgacagtactgataaattctaaacaatattaggccatatagagaaatagaaaaacctgtgaatagcacccatttcttatctaaaaagcacaaataagggaagagttttcagaaggaatctggatgagccaaattattaggccagatactacacccactatccaacaggtgaaggtaactacaagaaaaggggatggtagggtagggattttattgaattagtaaatcctttaaaatcaagtcaatccccaaatatggaaaagataattctctttccatgagagaagttgaagtggtgccataacagaaattagccctaaatgtttcagaactgtggttagaagttaagttacataagaacatctggatggcaatcaatcagtggaagatattatatggtataaagtaaaattacattttggggacagtttagttcactggtatgtttaatgctgctttggatagcacagtgagtaaaactgctgaaatgaagactactatgaaaagcagatcactcaaagagaaaaatcagactgacatcaaaatccccatcaaactaaagctagagtggatgcaatttttttaatgacttatcttgccactggtctgaaaaatattgtttatcgtgttttcctttgtttctgaattctttggtcaactcatgggattgctcgaattcagttatttttgttgtattcaatcatgctcaattaagaataaagcctgcctaagtaaaactcatgaagtaaagatctacaattacaataattgcagtaatggtttttaaagataccgcatatctagatctcaggaaaagtaagctggtcttttctataaaaaactagaccaaagaaagaaaaagatggtaaacaaatctccatccctaactagggctattgagtacacaactgaaatagccaacctcataaattcacctttataaagaacagctaaaagcatgagattgagggaggacgtagaactatgaacagagggtaaaaatgtaggacaagtctcttccatgcatctggacccaagaaaatggaccctgtgctactgtattccaggcatccctagagtgctttcactggatgactgtttttattacccctctacccaaaataattattatctattaatgcgtacatttaaaatccaaggagtggtttaaatgtggttcaattttatgggaaaatagctccaatagccttgtatttacagaaatgtaccaatcttaaaggaacatagccactcaacaaagcgaagtgtatctgttcagaaggaaaccaagaacactccttcaaaatgggttattttaaggaaataatttaggttaaaaattagagataattttgtcttcagaagttttcagctgttaagcatatcactgccttaccaaagaatacttcagagtctctatttctggaaaaataattgtaagagttaacaactgccattcagatatgactaggggtaatcttacatggacacagaaggatcaactagattattttctatggaatcttcccagatccatgaatcactgcacactaaatggatgtatcagatttcttgtagattgcatttattttcacctatgtctcagtaaaatgtagaaagcagggaatattagggaatgtgggttaattttctatctaaaatcctaatagcatccaaaacccacttaaatgattaacattcatgacatataaaaattctcgataacatgcttaacgaatcatgccatttctcttccccttctccccctcctgtccttgtctcctccttcttatcctagagaagtagtaaaagtggaagcctcttggcctccaaagaaacctgaaagttatttcaggactctcagaagacttcttgacctacttgtatgctgggaaaaaaaggagaggaaaagtggcaagaaatacgtacagtttttaaagttatgaaaaatcaagcatttacacttgaaactgtatatgtaacagttatcatgctctaagacaatgacatcagttttctccttgtttttgccacctatagtttttgttgttgttgtttttgagatggagtcttgcgctgttgcccaggctggagtacagtggcgcgatcttggctcactgcaagctccgcctcccgggttcatgccattctcctgcctcagcctcctgaatagctgggactacaggtgcccaccaccacgcccagctaatttttttgtatttttagtagagatggggtttcaccatgttagccaggatggtctcgatctcctaacctcgtgatccgcccgcctcggcctcccaaagtgctgggattacaggcgtaagccactgcgcctggcctgccacctatagttttaatatacgatgactgttcctgtcttctggggtcactactcccttatatctaggaaagcaatccaggtagcaggagatgcgaagacaagtggacccacggcatgctaaagcaacaactacaggctctatggtgccaggcaccaggctgcaaaccaacgtgcacaaaagaaagtaactaacccagaaaaattgggaagaaggctacataatttaacctgtgcagagatgaagctaaaaactcccaatgactctctcccttggctgatgtaataactcatacaaaaatatgggttggcaagaagttaatcaaaccaacccattatctggaaagagtgttcaaattctacttgctgcttatgttgtctgaattagtcttgaaaataaccagatattatttttcgttaaaaaaaaaaagcaacagagatagacaccaggtccactggcctattgttccacatttagagtacataactagaaggcccattctagtcaccccaattgtatccttccgtcctggaagaggatcttctcatgatttttcttttcttcaagtgatgttcatcccctatttatcctagtctctctgcactgacactaatctgccttgaaattggctgattccgctcgagccatgtttacaggaaagtgagtttcatcaggccatcctgttcatagaccagtttatgctccacagcagagagattattaaaaactatatattacgtgcatacactttaaaatgacttgggaaagataactgtatcgtatctgcatttcattgcctgggttgtagaaaggggccaggtagcattacaatcttgaatggaaattgtttcccaaatatattatcctctgtaagaaacatttagcaactgttagtgcccaggagacaaaggctaaggggaaacaatgtgtgtaatagaatgtagagagggataggaagagagaggaaaaagactcatttaaattatcaacctgagcattaaccacaaggagagaaaaacaaatgttctatcttttgcacaaacatcaattacgtctagtaatttagctgattcctctcactgaacaggtgcgctggctgcagtgcaaagtgaaaagcgtgcacaccactctggcttctataaaaggtaccaagggtcctcaacttgctctaaaaaaaggtttccaacatatcctggaactgccattattgacagtttaagccaagcccctacctgctatgtggcagtatgagagtgaaacccagtctagagacttgccatttcaagtggctgcaaattgggggcaaagagagtaaactcaaaaagaaattatggagatggacatggatttagctatgtaaagccaactgaattatgcttgacaagggaaagcaggatgactgaattaagataactacaaacgctaagcataagcaatctatttaacttgctcataagaccaagcccaaaattgcttaaagaaccagaattggtcatttgagtttcattcccagatccttttctattcagatcctaagaaaacaaagtgaccgaaagacctaaagcaagtagggggaaaaggtataatcaagagccctgctaataggcaagtgaattaagcggcttccaaaaaaactaaaaactgactataaacatatatacacacacacacacaccaacaaaggagtaagttactctttgccatagttagcatttaaaaactgcagaatgaagttgaaatacatggagtttcttctgcaaagaggtacaatgctagtgaatgaagcatccaccaacttgtttccctgcagctcccacaatgcggagtgaaagaggccatttatctgtttctttgttattttatcatcatcataagaaagaaaaaagaaggccagagacagcatcctttaacactctttgtttactctctaccttgattattgatgttgattctggaagaggacaggggtttcagtgaaaacaatggtctcaggtactaaagcatctgttccactgagttttacccgtgtgctaagaaaacttaaatgacttgggtttttcttcttctgcttttagttaaaattccaaaatatctccttctagaaaccctgccagaaaaagtgctcctgccttttctcaagaatgaatagctatattcccttgtcttatgtaaacacatggaccgcagagaatttacgtaagaccagagatacagccatttgtcttccatgactctcattggagacggtgatttggatagacaaatcatacttccataccttgtttcctcatcggtataaagagtagcatagtcatattgagccatctaccaaagcaggtaagaggacgaaagaaatggctaaagaaggctttcaagacctttagaaaaaaatgctaaaagaaacaactcatctcctctcttggagtaattccttcctatattctaaactctaccttccaaacagcaacctgaggaagaataacattcttggaatgcttccaaagcagttccattaagagacagaatttgtagttctgtgtcaaatgttggtgatctaggaactctagatatagacataatttttttttttttttagacagtctcactctgtcacccaggctggagtgccgtggaatggtcacagctcactcagcctcaacctcctgggctcaagtaatccttctgcctcagcctcccaagtaactgggactaaaggcatacaccactaggctgagctatttttttttctatttttttgtggagacagggtcctactgtgttgcccaggatagtcttgaactcctgagctcaagtgatcctcccacctcagcctcccaaagtgctaggattacaggagtgagccaccacacctggcctcatggacatgattttatcttaaaggtaaatggtgtacacacataaaggaagaatcttacttgttccatagtcataaagctggacaaaactcactgcaaccacaactgctttcagaaattgttttgagaaataatgcaaacataactcctttagtcatctggatagtttatgtgcctgtatttatgtgcattttccacaccaataatcatagacgcttgtaaccagtttggttcttaatgcaaaaattttaacagttgtgtgggtgggtcaagaggggagtgtatgtgtgaagcaaagctatcattgtacatattttactaccatctgttgtttcaataatttttaattacttaacatggaattctcagtgctgagaataaattttaaagtaagctaccctgatcaaatgttttccacgtgtttgggtagggtgggctgggaggcaggggagctacaaagatcaaaggtcacaaagagccctcagccaacataggtatcttacacggctggcacataatgtttttaaaaacttgagccaacatttaaaagtcaatgtggagatggcctaaaaatttaggtaactagcttctcataaaaatatggtagcatctggcaacactgtccatattaacattcatgcccagccatagagctgaacaccaggtacccctggaggtgggagctgtactctccagctgaccacagtccccacctctccctattctttccacagcatcctattttcttcctttgtgttacctgctttgcctttattggcatgtatgagatcccctcatatagatgaaggaatttaacccatggtagatgcttaataaaaatgtattgaggccgggtgcagtggctcacactgtaatcccagcactttggaatcccaggtgggcacatcacttgaggtcaggagttcgagaccagcctggccaacatggtgaaacctggtctctactaaaaatagaaaaattagccagatttggtggcgggcccctgtaatcccagctactcgggaggctgaggcaggagaattgcttgaccctgggaggcggaagttgcagtgagccaagattgcacgactgcactccagcctgggtggcaaagggagactccgtctcaaaaaaatatatatatatatataaaatatatataatataaaaaatatatatataatatataatatatatattatatataatatataatataaaaaatatatatataatatataatatatatattatatataatatataatatatataatatatataatatataatatataatatatataatatataatatatataatataatatatattatatattatatatattatacattaaacatatatttataataataataaattattaatttttaataaaaatatattttatatatattatatatagaatatatagaataaatgagtcaatgaagaatcaaacattaaatatcattagagtaggcaagcccaaaatatattccagtttatttccaaagcagttactttttgtactataaattttataaatgtattcaagtatattttcaaatagatttccaacatttaaaaataagtttgtataaacttcaattataccaatgatcaatctccactaaatcacagtacacttttggtatataaatttgaccaagaagtcaactgatggatgcaaatacacccctcattcttcagtaaagtgaagcgaaatatcacatgattattggcaacatggacatgctttaaatagtctatgaatactctcatgtttttaatctgaaaaaaagacctctctcaaactaggcttctaaaattacttaaaaactggtctcgatgtcgaggaaatgagacagaccaacaatatgttatctcttagctttaaatttattccatgcaggttaggggagcaccaggccgcagtcagaacatgactgccaaagagatgcagggacaggctcttcagaaaaggaggatcctggagctggaataggaccttttcaatgtgagcgaatcggcatctgtgagcagtgcttgcagtggagctgtacacagacagggaggtgaagtgaaatctgtgactgggagtaagccatcacacttcctaatgtctccacccaaatgacaagccggagagcccactgccattcttttctgcgaaggaattcagctcacaagccatagtggagacaggaaaagccaagcttcttttgactaatttttctaaatagccatgaggaagcagtgatgaggcaaaatctgtcaaatttaatgtttcacaaaagcagcagtgcaatatattaaaagagatgtgagaaactaacctccagaagggattgtggcatgagatctctgctcatgctcctagttagcagttcttatgtaactgtttgctatgtccatggctatacatcagcacctgttttgaaacagctctgagagcagctgagtgagcccatgactggaagaagatactaatcagatacagagactcgacccttatgtgcactcctcattgtcaatcatccatctgggactgtcaaaacaaggccagtctgtttccaggagcagcatctgcccagcacaggaccggacttcagtatccaggcattctgtggctttgcaccaggagaacaaatctgttctttctggaaggagaggagatttccagccaaactgtttgatgactctaacgtggtcgataatgccaagactacgataggaaacagcactgcttctgacttaaagtccaacctgcttatggttcctaagacatgtccagttttgtcagagatgttcaaacctcgagagcagaggggctccacgctggctgcacatcagaatcacctagggagctttcaaaaccaccaacagtctggcctcacctgactcaaattaaatgaggctttctaggggtaggtgctagcatcaccctcacccaaggtgattctaaacatgcagccagcattgaactatgggaccggaaggattaaagtgaaaaaggaaatagaaccagaaagaaaatgttaaaagaaaaaggcagaataaaagacagaatgttgctataaaaggatcccaccaccactatcaaataattacaaactcacccaagatctcccacaatagctcagatctaattcctttcctgacccagccatcatcttctttccacctgaaaatccttctggtatttataatccttttatttttaagctactaaactagaattacattctgcctactggagaatacttgcttctcataaaatagttatttgattagttaaaaaggtgagacaagtcaaggtatgtgcttgttctctcattccttttcatgactggctcttcaaataattaaacttgaatggaaaaaaggcatcttgtttcaaataatactgtaacctgggtatatctacctcatcaatacaaactgattcatctgtgctaaaaatgccacattcatgatagtgttaaaaattgtgaggctcttttatcaaagaccagttaggaaggtaagatggattgttaaagattatgtatgtagacatccattcataatcacctttttaaaaatgttgtaactgaatgagccactaaagctacaccaggctcataatgaggggtaaaaagaagggctgctggtggtactgagaggcacagagacaggaaaaggaagacagaaaggcagtcttccaaggcagggggcaggaggagaggaaaaactgagccaggtcactgcagggtgtggcagtgagaggtttggataagtgtgccagctgctgtaatcaccactatccacaagccaaacccttacacataagctcagagattcaacttttttcaaaagttaattttttaaagcaaaacccaagttaatagaatgttccagtaatcccctatcatcaaattttactcagttggtggtgtggaacttcatttattcatatttttagctacaaagtcagggcctgctttctcccaaccattttctaatccttccccttcacacagcactcccctgacaggccttataggcctggggaaatgggagccccctgttttaccccgtatgcactgaccagcaccggtgaaattacaacacccaggaatgaaatacaaatcattattcccaaatacagacagcatttaggcctttccattgctcaaccgttcattctcatgacctggataccaaagcagaccttctggccaaaacagcggctaagtgggtgtgccacttttttttattactgtatctcatatcagatagtttaattttgtgtaatttgtggtatatggctggattacaagaaaaaacaaaatgaaatcaaagaaaatatagaagaaggaggaagtggagtcattggtcccccctttagtaaccaaaaaagtacactataaaaaccaagattgaacctttggtttaatttttttttttaaactttgattacacagttgggtcggtttgagaatatggtaataagtataacctttagaatgaaaggcaggatgagcagatggaacctaattaatagtgaaatattattaatctgtctccctaagaggaagaaaagtcagtcatattttacaaaggaatttctctgtacaaattaataaaatcagacttactatacaacaaggggctcactatgaaacaaatatgtttggtataaacctttaccaaaccccaataattaaaatcacttcaccctatcctataaagcttaaatataccattaatatgaagctcagttgttatatatcaccacatttttttacattcataatttaataaatattatttacagaaaaagaagcaataactcatttttgggaagccgggaaagggaaagataaaattaatttactataaactcaactttataattttcctgaaatcataaaacttatttagaaaagtgttcacatctgagtagcttccctgcaatgccgggggtaacacccattcccctcagtgtccacaagggattagaagcccaagattcggaatcagacagacccagatttctttcttgttttgctactgctagctgtgtgccacatgcaagttaattaagtctttcagtcctcaatttactgatctctaaaatggggataaaatacgcacttcaaagtgtcaggcatctacatacccaataaatgatacctattcagagaaaaagatatataaacctaaaaaagcaaaaatgaaaaagaacacatattcatagctggcaataagcaaaaggcttacatttactccaaatatttatttttttaattgcctcagaaaaaaatattcccttcctcctatttcttgtcaaaacaagatagaaaaataaaattcaatgggaagcagtacagctaacattttacttaatactactttgttacaggaaaattcaattttcttgtattattttttattatggcaaaaacataaaatttatcattttagccattttaagtgtacagtacagtagtgttaattatatgcacaatgtttccaacacatctctgaaacattttcatcagccaaaactgaaactctatgcccactgaacaataactccccattttccccttcacctaatccctggcaaccatatttccagagcttgactactttagatacctcatataagtagaatcatttttctttctgtgtctggcttatttcacttagcataatttcctgaaggctcatttgaggtgtagcatatgacaggatttctttttaaagagtggataatattccatggtatataaatatacgccacattttctttatccattcatccacggatggccacctaggttgcttccatctcttagctgttgtgaataatgctgtaatgaaatggatgtgctatttcttttagaaagtgatgactttccttttttaaaagtaatttattaataattttgataattcaatctttggcctgcaaatatatacaagttatttaacctataaaattgaaatgtctctctctcccagcaaaaggaggtagatggaattagcaggttttgacaacactcctccattctccccgtccaaagtagacatgaggaaaaaaaaatactgaaaattctatttttgtcaccactgagactttacattctgagaaaatcaacaaactgtaacagtcctaaaatgaaatctcattggcacttcactagacaaaacagaaagtcagttgacaaaaattgaattaggtggatcaggaccccaggacccaagatccaacatttagctctggtacctaataactgtgtggctttgagcaagttacttaccttctctgagcttacttcctcacctgtaaattgaggtttaaaacactcatttctttcaggactgttgcactgataagaaccacgcacataaaaactgttttaagaaatacgtcattttaaatttgattacaatattttaaaaagatccatcaaaaatatttagtaaagggaataaaaactactatttaaatcatcttaaagcctaaaattagctatcgaagtgaaattatgtcctatatatctacataccataaggtatgcatgagtaggcaaagacagataacatacacagtctcgtcttggtcaaatttggtttccatcagacaacctaacaaattccaatgtaagcttccactcagccaacattacttggaaatggattcatcttccgcaaaattatttccttccactggcactgacccatcaccacaaaaacatcatctagttttttcagagcactgaattagtagctggatgcaagagctgaagaacgtcttgaaacatggccatattgtatcacacagaatatagcttggaaaaatattacttttcacaaacaaaaaacttggctagagaaaggggggagagaagattaaaacaaaatatctcccagaaaaaaagtgtagaaaaaggaattgaaacaaaaacactgaaaattaagtgtactcaagccttgtgtattgttgctgcttccaggagatgaattctgaatataacaagatgaatttcaacagaccgtgaaccagagattttcaacatgataaaggggaaacgatatatattcaatttttacaagcactgagtgagcagaaaactgaaaattcttcagctgctgataatgcgctgatagaagtgcatcccccgacagaattcctaatgaactgccagaaaaatggagaagtattaaacaaatggagagacctaataattatctgtaagcacactaacatggatctctaacaacttctgtagtcattttcctatttttaaatgagatactattaaagaccatttgaataatttattcaaccatttacgataactttaagagtcttcaaagataatagaaaatcataaagtaatatatgtaggagataatgtagaatacctactatttattgaggtcctaccacatgtcagatacaatgataggtgcttcacattcctccccactacccctctctcagtaacaaagaggaaaagacacagtgttattattcacattttacagatcaggaatcagaggagttaaataattttccttactgcagtcctgccctgagtcctgcataatttttaacatcttatccataatcactggctctgacaccaaattgagtggaagagtaaatactccaaaagtggagaggataagcaaaaaactaaatttctctatgaatggaggaaattaaattataggaaaagactagttatacttaatatagaaaaatcaaggttcatagtggaccacagactctgtgcaaaaccagatgtgatgagaaataagaaacaaaagaaagactggacaatgaaacagaattatttacttgaaaagtttataatctttcctttggaaggctatgtacccacaaagcaacttctgaacccataaatacatacagataaacatacaggtggtcttataaaggtcagaattcagaatcagaattatgaactcagaccagtatactatgacactaattttttgctcacggccagttatatttaaattctctactcttaaatctcaatacaacattttttcatgctttttatctaacatgccgaatgatctaaatgaaattttaatatttcactgtatggcaaaattccacaatgtttaactctttacatctgactgtgaaccatttcttttgaattacattcattctctcttagcttaattcactgagttaaagatgctcaaacagaccaggactgagtcaaatgaaacactaaacgcctggattgggggcatcctacagttcaaagcatggcttccctagtcaggaagtcactgtggatatattaagggaaataaaaacatgcatatttggtttttctgtgacttaagaagtctacgaggaaatgggcacgggaaccagaggataaagatcagtagacacatatttgaaatgatgtgtgtacaaggttattcattacagcattgtttatacagcaaaatactgcaaacgatccaagggtccatcactagggagctcctaaacaaactatagcacatctatacaataaagtggtaggaagttgtaaagaataatgaggaaggtctctttatccaggtatggacatatttccaatttaaaaagcaagatacagaacagagatatgctctgagtatgatatggtttaagtaagaaagtagggattataaaacatatatttgcatatgcttgcacaaaaatagaatactcagaaaactaataaaagtggcttcatatatggggcagtggggaatagggtaatggagacagggacagaaagcaagatttctcactctgtatctttttctatcatgttgctgtttgaaccttctgaatgtattaactactaaaaagtaaaataaatagatctacagccaattagaaatcgatagaaaactttttataacatgtagtaatcataaatatcactgcagtctagaaagatttgttaaatattttatgaaaagtagctacctatagggcatggaacaaaactttaggaatttgatgagaaaagaagaataattgccaaagtatgcttctaggaaaatcctactgtagtgccattgctaggaagactccagtgagttgctctcattttcagaaatgcatctccgaggctgtgccttgcagacacacaatggcagctgcctttaggcaggtagttggaaaaacctgaaagtacctgctattgtccaaagcagcagcttcccttcaggactctcctcaatctcatgaataccttccaaactcagtaaaaaggaatgtgaagtagacagattcaagaaatgaaaattacaacaaaacccagaatgacagaagaacctggatgctaaagttcccctgatgtcatccagatattgaatatgactgatcagtgccattttgggttaatcacaggctacttcccagaggaagtgaatttgagctaaggtttgaaggtgacagaagggaaatgaatgccaagttaacaagagatgaattgcagtaagatttcacagagctatgtgaatagatagaacagtggcacagaagctgaaatgtgggcaactgtaatggcatgcatttaagggaaatgaatataaattactcttggacgatgatcagttggctacaagatgtcagttacaacctaagaagaggaactgttggccactgatgactattcactaacgattacaacctaatatactgtggtagcccagaggccagcaataaactgaaggtaatcagctaagttaataaaaaatgtttctctttttttttttttggccacagagtctcactctgtccccaaggctggagtgcagtggcaggaccttggctcattgcaacctctgcctcccaggttcaagtgattctcatgcctcagcctcccgagtagctgggattacaggcatgcaccaccatgcccccttaattttttgtatttttaatagagacagggtttcaccacgttggccagcctggtctcaaactcctgacctcaagtgatccacccgcctgagtctcccaaagtgctgggattacagatgtgagccactgggcccagccaaaaatgtttctctcttaatatacaattctgaagtatgtttaatctggtatcccatcttaaatctggacctcaccccgtgaaaagctgaggacaggttagaggagagaaagattccgtatcttgattaagatacagaaaagcccagaagacctataaagattgaaagccctttgtctaaaataatgaaagctgagacaagcaatgatcaagttcttgttaccttcaaacctggtaaatgtgaaaaattaaagctagcagtccctataaagtatgtggaaaacttagagaactcatcatccctagatgagatacatgctgaatctacaagtaacttcgaaagaggtttagattgtttcataggaaaagcattcataacatattattactagaaatcaggaccattcgtactatgttccaagggaggagatctttgactgtccacaatgttttggccgcattggcaaagaactcatgacgcaatcttacctctatctcagctcctatgtcagctggcagggctgacagtggggacatttcaaaggaagataacgtaacccataaagcagagcgttagggaagcacagagtaattcactgccagtctctgcccaccactgtactgggctgcaccatcttcaggactgtagaagtaagtgtaactctgagaaaacaaccaaaatgaatcaagcatacaaaatcaaaggaggttaggaaatctatataatttaatcttaagaagagagcaaaataacatgaaaaatttctcagttgattaggtagataaggtaatgaccatctttttaaagaaaataaaagtccttaagagttaaaattagaaagaattgcctgcaactgacattaataatacttgctaagggtaagtgcagtaactgaacacttattagttgctagacattgtgcaaggtgctccaaattctttaactcatgttttttccttttccttttgatcgttacctttacagaaacacacaaacaaaaaacaaaaacacctagataatttgtggaggtaagctggagttctatgaatttaacttcatgatgatgactcgttgagacaataaactatgtatgccacaatattcactaaagaagtaagaagtttcctcaaaaacctatgtttttggagtctttcacagctttctaggaaccaattattttcccctttccaggcttattgcatgtatttaaactatcccttaatttactgaatactaacaatgagcattactccgaatttaacgctggtgaatctcgggaaagagacgtgagctcacagaggaggcaaagaaggaatggtgatttatgatcacagaaaatgtgcacgttattaatgggactcaaagcaaaaacatgtttcatatgaggagctgttttcagtctccatttaatgcaggagttaaatttggaaaatccacaggtacctcacttatctatatataacatggcttttcataaaatgtttgtaattctgaatattgatgaggagtatattgatgagacagaatttgggacttcattacctcgaaacaggcctgttaatgtatgtggatgtatcatcccaacaaataaccattccaagaaagaaaaaagtcacaataactatggggtaaagataaaaatcagagcctattaagcctgccattagaagggaaagtggaattgcttctcattttttggccaacaattaggaaacccagaacatcaggaacaaaacaaacgaacattcaagctaaatgaaaacagcagtttcagagcccttatactttgttcagcagaacagaggtagagtgagctgtgcattttcccctccatcccccaaacacctcacaggctggggacaggactaataatttgacttaattacatggtaatacttatctggattcaactagaaatcctcaaactggtcctagcttacaaactgagaaaggaaaggaaagccgatttgggattctggaagtcagagcaggttcccagtcgttagacgtggcagaggagaatagaaatgatcacaaaggaggaaaaagaaagaaagaaaaaaatactaattagaagagcacagtgactagaggccatgggctttgggataaaaagccctagatactggcaggaggcaggagacgtagccatctgggaaaaatcataaagaagtcaggctaaacctacagacctcgaaggctcccgagtgcattccggtattaccaaggagttcaataaatggtgttcttaatgagggtcctggttctttgagaaaactcaccatacttagtcaaatcacttcttgtaatgactgtgacattttagaacatttgcaatgagagcagttataactgtttcattgtttaaaggattaagcagatttaagccgaactcctccttcctggacactctagatgaattagctactgtaaggaagggtgtagttcaaggtgcatcaaagagtcactactccttttaatggaattttcccccattccagtcttagcttagaaaggaaagaatatacagaattgactgtagtttctcaaggaaatatcatggcaatttttatccctcactttcatataaatttagaggcttttctaagtgacaggataaatcactgtctctgatacatgaggatttatacttaactgagattagtaggccatacctcaggagaacagcgttctcattctgaacaatacgcatgaaccaagggaaaggttccattttagtcattcacttccataaaatgcaagttcatttcaattactactgtggctcacctactaacgaccagctccaacaacataaaaaacattaaatcaccaaatttgtcatcagtgttttacatgtgtttcccatgcttggtaaagtacgtttactgagagcaaagaatgttagaagtggaaacaagctacagacaccactctcgtctgtcctgacactctaaccgtgaggagctgtgacttatgttagcaagtgaaaactggtaggcatgaaatttcttttacaagagcaagccaaagtgatagcagaaatttactttatatgtatagctttacagaacggcaatgtggttcctgctcatagaacaaagtgagttaatctactttgcaagagacaatgacctttcaaagcaagctgtgataggtttatcccttaccttacaaaaagaatatcagttctttagcaaaaccataaggacaaggtaattttgtaaggactaattcaggtactcctttttcaaggtgaagtacacacatttctcaaatctttggggacgtgaaccaatattattctgcaatatgcatttaaaaatcagataattattggacagctaagcatctataagagaatggctattcccagtcaccaatattaatcttttatttatttattttttaagagacagggtctacctctgccacctagatgggaatacagtggtgtatcacggctcactgccaccttgaactcctgggctcaagcaatcgtcctgcctcagcctcccgagtagctgggaccatgtatgggcttgcacctggctctgatttttttttttaaccaaaccaatttcctatcttaaaagtcacaagaagagcacattggttgtgtggctttcatgtcttacttctcaacagcaataagaaataaacatgagctggaagagagaaacagaacactagtctcagtgaaggaaataacttaattcagcacactgctctacaagcatctgtctttggtctcactgcattcaaaaaataacatggaaaaaggaatggagacatgagtaacacatataagaaaaaaataattagaacttaaaaaaataaatatcataatgcaagttgcaacccacttgccgtgcagacatgtcagaacacagatctgtagtatctatattcatcactgccaggcgtattaaaatagaggcagaatgtcagtggcaggagttggcatgtgtacgaaatgtttaagcgccctacatgattctgatctgccccactaggtcaaaaatcactcatctattcccatcacggtagttcactcagcggttcactgtctcacttagtgcttaattgcgggatgttttcataggtccactggcacctaactaggttcagactgttttaagtctctcccaatctacaaatggttatctcctgcctattcataggcacctgcacaccagcagcctaaagacagtggcctaaactagttaaactagttgattcttcataactgtttgcttttgatcaaaaagggcagcaagaaaagggccagtggttccactgggaggaaagccatgtgggacaaattaggtgccgctgcaagatttaaaagctcgggggtggggatggggggggaagcagagctaactagaggcagctgttaggatgtggtttctgtgtttatattcttctccttccccctaatgcctcttatgggtattaggaaggaaagcatatatatgacccagcagagaggatcagctctcttgactgtgcatgatgccgagaccataactcagcacattaatgacaaaagttacctggcaagagaatgaggtaaacctttatttgaaaattttttgcaatcttcttttatctaaacacatgaatacagcagaaaattgcactgttagcagacggctgtcatgataatagtgagaaaccttataggagcaataaacctgagctacctagagatttaaggctgacctaccagtctgcaaatggtacatcctgttgctattacgacctttacccccaccccccgccaccccgacaatttcaccttcaaactctcaacccaaaatttcaatatggttcattgccagcacctttctctttttttggggtgcaaaagtggttcgttgatccatatgtatttcaacaggctttgactgagaattaaagtcacatactatttaaacaacacagagattgcattgttcttacaagaacctcccttttccctgcctgccccaacctctcttcccttcaatattgtcctcaataacaggctttcttccctccttgtaaagcccatatggggcactgggaggaagcagggggagggcaagtatttctatttctcttggcactgaataaaatggttttccaggggatggagtatcactctcattttaataaaactcctgtttcctgtataatatcactcaggtcacttcaaggtgagaaggtgatcaaaaacagagacgagcagtggactacacttgtgaatagcactcaacagggcccacatgctccaaatcaatgcagcatgaccaagtcctctgcccaatcatccagctactcaagtattgcaaatcttaagaattctacgtgctcagacaaatagctgctgcaaatacttaatgcaatgaagccactttttacttgactttttttttaaagtcctttcccaaactgtggtattattacctgtaacataatgaacattaaaattgattttcaccagctcatatgatttgcctacacataaggctttaatgcagagtaaagaacagattagaatagcattggcctcaacttttaaaatagcttttctcttcctactgggtgaatgagtacatgaagccacttgattcacacagggaaacttaattccttcctcattctctgccatctatccatctacctgttttgtattatttttaattgctttgatgctgcactcctgctactctacccaaatcatagacacacacttgcacgtacaacacacacacacacacacacacacacacacacacacacacacacagagctagtaatgcggtatagcagaatttttatctgagccacatattagctgtacgactttggaaggttacataatatctctaaaacttcaatttcctcttccataaaatcaagatgataattcctgcctcatagggctacaaaatatcacagctgtagtaggcgctctataaatattagttcccatcttttcccctctctccgtgaacaatgcactctgatatcctttaaatacagactttacagatcaatgaatagaaaagggtttctcctggagtttgctgatgccaggaacagcgccctaatttttttctctccattgttaatttctttttaaaatacttcttaccccttctttcacaaatctgtattctcctatcctaaggggattgatattttctttgtttctctatccaatctttctcaaaggtacagagatctaatataactatattaataataggtaaacaattgaaacaaaaacatgaatatggtcactctgccattagccttgagtttcaaagttgtgtttaaaatgctaaaaatctgccactgcagtgaaagccaatatgaagtgtatatcctaaaagagattgtctgcaaatacaaatgaaaacatttctgaaccagactgctatgactaataacacaatttgatacattagaatagaaaatggtggaggtttatgatccttctcccaccccgggtgggaagcacactcgcacacacttaaataaaacggcgagtaggctaactcgctgcctgctagagagggcactgcacacatttcttttccttcttcaaacatttgcagtagagtttgagcccagttaatcaataccttaaaaaacctgttttaagacaacactgtctagtttgctttctggccatttcaggtacaaacctttaaaacgaattatattttttttcacagatttcagattttactaacctatattacaagtgacttttaaaaatattttgctactgtttaaatcaatactcatcatgacatagactatgtatgatatttggtagctgaacttgtatcttttcagctaaaaattcaaagttggtcttctttttctccttcacctctcaacacagtttcttccaaacttgctgtgaggagtggagggggagaggaaggagggagtgtatgaccataggagggaggaaagcaaaaaacaaataaatcttcagtgtcacaaagggcctcaccttgcttacggtgcatgacccacatctataaaaagacctggaccagacaaacctattacatccttcagcatttcctcctccccctaacacttctctcataaccttccaaagctgccaccttcacaataaaatgcagataagctgtcagagcctggtagtccaagcgatctactctccatctgcttgcaaatttcatggaaatttttaaaattcagcaccatatgaggaaaacaacgttcagcaacgtcaaaacgaacacagactgagttattctctgaagagggctggcaatgttacatcactgctgctgcaattaattctgaagcatgagttgtacttatcatacagaaatgtgtaacttcccctgaagcaaaggcttcaaaagctaaatgacagatgccggcctctaggtgtcttgtttgctgctcagaatgcttgcttttcagttcagtccccaaatggctccgccattctgtgattcacattgtacctccttttgagcaaccgtgttaggagacttgatgtagccatcgatgcaacaaaatgaagacagattcccatgctgtggtccacagtctcatacacaacttaaaatgttaagcctcattcatcgtaaaaattcactgctcaaactctagttttccttcttgttcatgcagacactttcaaatgttatgtcccatgtagacagatctttctgcctgcctatctcagctgaatatgttctttgcaaaatattccctttgtcccctgcatgtcatggtgccgggaggccaccagcagcaaggtcctgagctcccaagagaggtgccccttaaagcaggagatggaggcaccaagtcaactataacttcatggctgtgctttatcttcctactgggcaagacacacccacgacttcatggctgggctcacctttcacaaagtgtcagcagagctgcatgtggccacagccttcaccctttatccacaatggcattaatgatggccccaagcaggctggtcccaacgctcggtttattccagaagctgaataaagagatcagtttctgtgaatgtccaaatacccagccaacagaacactttactagaattgggagggctctaggctttttcattaaaccctaaatagtggctttctaattgtgatatattcaataaatggagcactacaaaacttcctggttgctctcttcatctactgaattctgagtgttatagttcttcctgcaaaacatgggccttgcatattccatacacatacatatacagctacaataatttataaaagaaaaaatctcaaatcatcaagtggctgttaaattaagtaagaaggaaataggaagaagaccaactaaaattatacaatgtaattaaaagggtatcctctctacatttctaataaaacgcacttggttgttatcatgtatggttgggtacagtttctaccccagcatccaatatcacacaaagaaacaaaagcaatgagaatttactatcaataatttccattcacttaagcaacaactaaaatctgtcattattaaaattacctataagactggtaattaaagctaaccgtctgccatgccagccctcctcctgccttcccgtgacttggcctcctttgatctttctctcctggttattaacattagcggcaggagtagtagatccacgtcaaaatcagaaaaataattcctaagcagaagaggtcttaaaacacggcaagtgtacccaatgctgatccatgcaaaaacagggaagaaaaattgccgctgagcccacgtgagagctggaggctgcaccaccaaagtcgcctcaccctgcgtccaccactccatccacagtgttatgcagggaaaacggatctctgctaaaattgtttcttcctaaatttacctgcaccatactagccatgcttcccaaggccacaggcctccaaacacacagtccttgtgccttccaccttagccctcctccagccaccgtgcccctgcccgccgccgactagaataagatgactgaatggtgcctcttgaaaggtcgtgataacaaatccaatttacgattatcaaagggacaaaaccaaaaggtggaagagtctgaatcagtgaaaaattatattatcatttaattgtattcatcaacaagatcacctctcatttaagaatgagacagataggaatgttcaatagaaagggaagggggaaaattgcagggtgggaatgggagggaatcccacctgtccttcaaagtgtaaccccaagttaaattctcttctattatttccgtccttaaaatagtcagatagcaagatgttcaaaggaacacaaagcagtatagtagagctgccttctttcaaaggggccagagcagcccttcgaagagttattcaggtcacagggaaattacacttctttacgcatctataaagaattcagagttttccatttttattagcattattataatattgaaggttttcaggcatatcatgaggggagcatttacagagacaagctgagcagacccagcctcacggcgcacccgccccgcttgaagaagttccacagcctggcagacattttgaaaagcctaataagcacatagcacttcgactgttagtttatatactaatacagccaaacacgttacgtgaaaaagccaagattcagttgtttttgtcaactattagactcaacatgatactttgtctctatgaaggcagactacttggggccactctattcctttgataaaactgtcatgctatcattgaatcatcacaaaacgtatctctttttttaatcctttcttaatttttgcaattgaaaaactacaattaccttttgattatttttcagtgcatacagtgtcaaagtccccagttcctgatataaattccatgaatatttgaaaaattaatacaactgtgtcacccattgttcattttattcacatctcttctcgccttctccctggcactttttctagcagccctgagccttccatagcggcacggaggcataggcacatattcaaaggtagaagactgaaaaggtcatatagcaagcagagaattttctagcaacgcaggtttcgatctttgctatttcagtgttattcccgctgagcctcgcgtgccaagaataccactggcgctgttcagagacactcatgatgactcaatggagaatcaggcgacctgggcatttaactatgcgcctattcccaatgatattctgtctcaaatcatttccatcctcatagaaacatgaaagtggggcaatgacagatatgaagcccagcatgaactgcctggaagaactctgcctagcaacacagctttatcactccaccacgcatatgaagccagagcccaccgacaaaaataatgacataaaaaccaagctggaaatgctatagtttaagaaaagctacaaaaatcgtatcacagaagagactgtttaaaatcattttacattcaaccagtaagtacaaatgaaacattagttgatattttaacctacaatgaagcaaatactgtgtcagcatacacctttttgctatgtaaaatcacacgtttcccacaaaaacctatgtttgtaaaattccacgggaaacaaggtaaaacggttcgctcaagtcttgccttagcgtattcctcaatatagtaaaagagggttgggattactttgatgacccttcaagtccggtatgtaaatatattaggttttctttattctatttcagtgacacacatacatccagaaggttatttcctttatttttctctttgaggattctgggttctaattgtgaatatgtgaatatgacaggacacagagcatgagcttataatttttattcacaggagatctaagtttgtgctactatagtcacagtgatctttcaactggttccaaagataaatattggtgaggcagcaggccagggctcggatgggcatttttagtactgaaaaggaattaaattagctagttgaatgcagcatgaacccaagtccttgacttgattagtaacacaaagcacactgttagcagtgaaggaaaaaacgaatatgtaaggagtagttatttcaaatcattttctctgctcgttttcatttatggaaactaaatgggtaactgcttctgttcctatctgcacaataattttgacaacatattaatataatgttaacataggatggaaagtgggaattagcaatgattaacagatattcttcaaatatatgtactttcttcagaagttaacaaaggatttgaacataaattctaccatgtctcaaatagcaccattcaatagaaagcatctgcacaaaaattatctcaggttattttactagtactacatttatttctcttattactttctgatgtttcttgggaggcaaattttactgataaatatgtaaagttgattaattatactttctatatcatgtataatgagttgcattataacaacataataaaattatatagaatccagaaatacatgaattattgaggaatgtcaggtaagaccatcttatatggcctcctctgaactcttaaaaccagacaggttacaaccaggaaagcctatttgttgctagaaactgcaatcatcaatagcccaagcaagcaaaacactggtcaagtaaaaattctttttaaaatataatttgaaatgcaatttaaaaaaaaaaagttcatccaaaatatctaccttgattagacagtaaacataattggtaactgtcaaggtccatacagaattagtattaaaaagttatcagtgagagcatgttctttgtttagtcaggatatagaagcaaacagaagcatatcactgcaatgcacagtgaagaactggaacaaagctgtgagcagctctccaatataaagaccagggttgtgatattcccgtcagtcactgtattaatacagggaaagcctacttaatgaactgctgagaatggaacagagtcactatgagaatacattttgtgtttaccagactgtaaaatctgcaataagatcccagaatcctcttagatgaatgaaagttaaaggaaataaccttctagacatagaaactcagtagcaaaacagggaataaaataaatagtttccaaataaaatttctaaaagactcattgctttggcaaaagccaaaaaaattgcttcatcatctacgaacagtgatacagtaacacagaaaactaaagataatttcctgaaagacttgaaactctataaatttaacaattttctttcgcaataaaaaaaaaagatgaaggaaaaccttgggaaaggctgtgattttgtacattttattaaccaagcaacataaacttgaattatatcactaagtttatttgctagttactcatttctaagtgtcttacactaataaaaataaaatctcaagtgttttataaaagtaatgggcctagaaaaaattgctgagggtattttttaatatcatctaagttgcttttttcatgcctatggggttaaagaaatgatatgtaagttattaactataatatggccaatgtaattactaccaccaaattaaaacaatcttcaagatgttttaagtatcctaaaatggatgaaaacaccaaaaccccgttaaaaactgatgcttggatggcatagaatgacccttgctatatgaacttctgttctctctccatttcctcctgacagatcatgcttctagagtgaaataaattaaaaacaattttcaattgattgatagctttttaaacacagtgcaccttgaaggaaatcatttacataaagtatttcaagagttacattgctaagttaaaaatcaaagtaaatgaccccaataagagattcctgaatcactaagtaatttcaaataaatgaaaagagaatgaaaggcatttttctcactggatgataagactcctgattaaatcttcttctgacactaaagcaggccttgtagttctaacagctcttcatttcaactaaggtcatcatgaaaagaatgattatcagataaacccaatcagaaaagactcaaaagttttcagagcctccaattccatacgatttctaggcatcctgattgacagttttgtaaaatataaggataattaaactgacatgaaaatcagtaccctgcataaatcctaaaagcagtttatctaaccttttgatcctcagagaactcagtcgtcctagaacctgttcctactcaccatctaatgaaccttcaaaaacagattaacacccaactatcacaccctgtgtagtttacacacataatccatatccccacaatatcattgctctgctcattacacggataatacttcttgctggaactagttcacagcaacttcagtctcttccccaggcataagacaaaactggatggatcttccagaaggaagctttgtgatactgagaaaaaaattaaaattttactcttaaaccataaaccaactgaatattcgacatattaacatagtgttgacaatgtttaaatttcaagtgttttcataacatcaggtagtattttaaagaatgtcaaatcatatacaaagtattaccttatgtaaaatgtgcaatttatttttaaattatcatggaaatatactgttaaaaaataagttagtcatatgagataacactcagctttagatggttttctcccaggtgaaggtgttcagaccatttgtcatgtgtccatttatcattctgcctagtttgaagacaacacacacataccatctttgagtacctgcaactccctctggagaggagtcttttctccaagaccaatggttgtcttagctttcaggatagtcatgccaagattttcacatgaatttcttgtaagactcctggttgtgtaacattttctctctcaaaaatccagaaggaacttttgagtatttgtgccatattaaagcaagaaaggcaaagatccaagtcatataataaacagatcttattaagaagttatgataatataatgagcactatatataaatgtttaattctttaacaactattttttaaagtgatacaaaaaaatatgccatatgtttagaaagctcagcttttattgtcatttccttttcagacatgggattttactttatcttgttctattttaaacaaattatttaggagccacaaatgttttgatgttggaaaatacctatgttaactgccaaaagaaaattaggttatctactagattttcatgcaaaaagtattgagagaaatggccaagttctgctcctaaaaagaaattaccactaaccttgtttctcttccacctttaaaaaaaaaaatctttaaaatgacaaggtaatcacaaattggagttttaaggggcacctgactggcttgtcagactaaagtagcatattaactacactcattgtggcaccatggaagcctcagtttttatcatttcgatatcccctctagggtttcaatcttctctcttggagctcaatcatgctctgtgatgctctgttccatcatgaggatgcaagagaatttctatttaaaaaaacattcagggggaggggggagtggtatcaggcactactgattgagaaggcattccgtgatgatccctattttcagttaaaatgcgcacttacagttttggatttaacacccctgcctttgcagtcagacagtcatttagctggagtcaatcaagcgtatgattagaaataataactcacaagcaatgaattcaaaaagattagatctttgccgaaatgcacaagtacagattcccattatgcatcctttcctctctggtttctagagagcagaccaaaaaacaaacaaacaaaaaaattctcttgcactctaaaagcttgcttcacttaaaatctgactaatcattcttttagctcatgacgagaaacctcagtcagttggagatataatcaacacaaagggaggggtcgctcgtccatcttttcttccctccagttacagcaaaagctgtattttacactgaatgaatgggtcagaagttagacacacacaccttgtttacataaaataagaaagataaatagactatggttaaaacccaaagatacttaatatccaaaacaagaaagaacaattctgcatttataaattattcttcaaattatatttcatttcaagatctggtattatattttaagcagggggttagagagacagaaaaactatgtttggatttaataagtattatattgaaatcagtaacccaagttcaataaaacctttccatgtagcatctttgatgaagtcaataggatttaatttcaataaagaagtttggagaatgaaagcgaattataagattttattttatgtggtactttatctttaatcagagcacatataattcatggtcaagtgtgctaataatgggtagaatgattccaaaggggaaaagattgacaaaaatgataaatgttttgctttagaatataatatagaggggatgggtcgatttgccttcccagctatgcttggtttaggctgcactaccgcagcacacactgatgacactaacataattcatacaaatgatgatagcagagagcagcctgggacttgaaaaatttctgcagataaatcccaaggctgaataaaccacatgtgggtaactgagagctgatgcagtataggaaatatacatgaataaagtccatgcacattctttttaaaaaataataaataaaaagaaagctccagagctgctcgtgtgtgtgtgtatgtgcgtgtgtatgtgtgtctgtgtgtattctggacaaaggaagaaagaaaagagccacatttcagttgctagtagaaagtatcctgtcaattataacaagtatctgaacagtagctatatctgggcagttagcttcatcagtaaaaactcactacaagttgtaatcttacaaaatcacactgtgagaacttttaggagccaatcctttttactcaacaaacaaaaatcacatttttataaatccaaatattaatttgaatgagttcaggtccttttgattacatctgaaaatagccagacctaacatttcattttcttccaggagccaatcaggggatcaatttctactcctttgcctgattgttatgtctaagggcagagagcacattagcagttttgtggaggaaactctgacccacccttaatgtacttttatggaaggatcaccaagaaccaaatctaaaggcttttgcccactgcatatcttcagctttaacacagaaaatattaaccctaattcagcagataccgctactcttatcctaccttaccataaatttaaacccataaaaaaactaaacattacacatacttacatgtgcacatacacacacacacacacacacacacacacagagagagagagagagagagaaagagagagagagagaaccacagagtctccaaatacaggagaaaatggaactggaacagtatttcctactcacttaaccattaattctaggaacattcattcagcaccaaccagatgctggtcactgttttaaaaacctggagagatatcaaagttgatagaatagatttctgcctgttttggggaagtttgctttctaatcagagaagcaggtaaagagtcaccaccagcaccaccacccaatgctcacaacagctttccccgccaccattatctgcaatttcagacatgacaatgaagcgggaaagtaagtaaaataggaagaaaagaaaatgcgtattgagaggcaagtttgcctgaagagtttccacttgttcaaaaggaaataggaagaattaataactattaataatataagtactattcttcttttctaccttctagtgggagaacttgagatgggcaatgcaggatttggactgaagtgctctgttgcggctagagtgaaattcaaatagaagtggaaacacaatacagtttaattttttgcctgataggagggcatctacttaaagtaagtggacctataaaaaactcagattcaaaaatcatgcacttcaagctgggcacagtggtgtgtacctactataacagctactcacgaagcggaggtggggaagactgctagaagcccaggcacaggagaccatcctggacaaaatagcaagacgctgtctctgtttaaaacaaaaaaaatcatggatttcaagaaaaaaaaaagacccagcacacaacctacaatctttcattcattcattatgcaaagattttctgagctcctactatgtaccatgcccattcttggtacaatatctttatgtgcatagtatatatgcaatccaaaatattcagcctgatcagaaattctcctctgtttcttttgaaaaagtaaggccaaagaagaaatatttgaggctttcagtgctaatttgataataaaatcttgatgtatttctgttacttgataatagtaaaaaaatgtgtgagcatgaaattctaaacaaaattcattatatgaacttgtgacattctcatgcactgggttttttttcttccatttccaaacactaattgacagcacttgaaaacagtgattcagcttccgcatgtcatatgattcctagggactgtagctatattcctcaggccagtagactgacaaatcaaaagataagaagtacctctcagcttcaatcaactgaaatgtgtcagaaaatacatttggcataatcttcagaaatgtcagatttggcgatgacaggataggcacagttttcctgacagttttagcacaccaaagtttcagagtccgggttagaatgagaaggaaaataaccacttttgtctgctattttggagaaaacttatacaaaacaagaggaaatctatgacatgccacttgagtctctgactaacatgttataaaatgcctgactgcctaattaatggaatacacaacttgggaaagtgtccactaagattaaaaaggaatgaggtatcttttcatatttttgcttagaaaaccatcctaactccttcttaagggatatacccataatcattcctcttcacattcccaatgtgcctatgccagttgtgtactcttttttttttttattttgagacggagtcttgcactgtcgcccaggctggagtgcagtggtgcgatctcagctcactgcaagctctgcctcccgggttcatgccattctcctgcctcagcctcccgagtagctgggactacaggcacctgacaccacgcctggctaatttcttttttatatttttagtagagacggggtttcgctgtgttagccaggatggtgtctatctcctgacctcgtgatccacccacctcggcctcccaaagtgctgggattacaggtgtgagccaccgcacccggccagttgtgtactcttataaatatgtgtctcatgagtgaagtaaccaacagcattgagagaaactgttgagaaaccaaaatgtaactgaatatattacatagcatacctccacttgaccttgcatgtcatccatgcaagccttgccaaataaaatatttaaaaaatcaaagcaaattaaaatgcaagaaggtaaattctaatctaaatcatgctcctttctgaattctacatcagctggactttctttttttttttttaagacagagtctctctctgttgcccaggctggagtgcagtggtctgatctcagctcactgcaacctctgcctcctgagttcacgcgattctcctgcctcagcctctcaagtagctgggactacaggcatgctaccatacccggctaatttttatatattttttagcagagacggggtttcactatgttggtcaggctggtcttgaactcctggccttgtgatccgcccacctcagcctcccaaagtgctgggattacaggcatgagccaccacgcctagcctatcagctggactttcttctgtctttcagtagcatcacaatccttaggcccccacacacaatcatattctactaattgtgaattacagaaagaacagcttactcgtttctctaagagacagtacacagagctaagacctttgtttctacctctggctacaaaactgtgactcctccaatttcccatttgtaaatagatctccaaaagaaatcagcccgagggcactaaatggctacagatctctgcagaagcactgtaggctgacagtagcaaacctcagtgagcttctcagataggagatacagagtgccttattcagacacttccttccaagccctctaacaactccagctctgtcaaccttcatctgattttcatttataaatgaagttgcacaaatctccaacaataaagaatattgacaaaatctttgttaacatttggcatttctcattttctaaaaaacaaaaacaagattcccatttgggcaactcctaattgtgctggccacgtttcatttactttcaccaccaattcagcagcaatctgtcaatatttgtaccgtaaattaccaaatactctaacttacttatttcaaactgattgtgcatttacatatttatgaacgttatacacagaaagttaagattcatttctcttttgcctaagtctatacatacagtctcccaatgagagaagtaccaagtcagctaaaagagatggttaaaaaatacatttttttctgacttaataatgggttctgtattttcagtattgcttccttttcaagagagcaaattgtttttcactatatttggcaaatgcaacataagataacactgcaaaagacccttattcaatgtattccaagagttaattatttcaggatatgtactctttagtgaatatttcttaagtatgaactaagtgccccctaccatgcataattaagaaaataggatggggtaaaatagagttgaaaagtccctcctattaacttacaggctaaaggaaaaaaatacaggcaaataattacaatataaaataagtactacgataatggagttttatgtgcaaaactttaggtgcaaagaagcaggaataactaatgtgacctgagaactgaagaataaacaggaaccaataaggtggagcagaggagtaagaaaaatccatatttggatcatcacgtgtaagagagtgagaaagaatggaacattagggaagggaaagtaatttgttatgtctagaaagtagtggatgggaggacaatggtaaatattaatatgagaagatggggctagaaggtaaagaatcatcctttaggaaatgtggaacaatccaagaattttaagcaaaagaaagatgtgatcatattcacacttctgaaaggcaactgtggcagacaggcctggcagaagataactttagcagaaacatctaggagaaaacagactggggggctggagtaagagaggacaaagaagcacaaagaagctaccagacaggcccagggttgggaagccggcttctgcttccagccctcagcactggcaagaatccttgcaacagaaagcagcactgggccattctctgcctagaagtggtcattcttcacagtagggatgggtacctcattgaagggcaaaagaaaaataaatgctgagactttcaattttagtctctcaaccaaaaggatccccctaaaacaatgtggcctacttaaagtccagtcaacaaaatttcatatctgattatatgagggaagccatggaacacaaagctgtagaaaacgcattttgagacaggcaaatcctgaatccatctcctggctccacccccctgaggcagctgatcatgagagagctactttccagtttattcttatgtgtaaataggactaatacctaattcacaggtttattatgaggattaaatgagcattaaactagaaaacatgtaattattatcaccatcactattaaataataatggataaaataacgggggatttaaaaagaggaaggaaaagaggatgtcacaggtactattttggtagattttagttgctattaacataaaagaaacaagatgtgagtttggttttagatgagctgttttttaaggtgaaaagagatgggtgttgaagacagaggcatttaaacaggagataatattgtcctcctctatttgactttgccttgatttgatcattttcagaactgtaatgtaaccatgtatcactcttctactttttaactgaatgcataactgccttaagaaaaaaaaaaaagactcaattttataggttatttcccctggcaagtaggtgatcaagtatttaccaatgtgacaagtctaaatatgggacctactagagggagggaacatgttcctcttaattcttttttctatcctgctgcctagaaggtaagtctgatgtctggagcccaagcagccattgtgagccataaggacataaactacatcctaaggaatggcacagtagtgggattctcaactgctttgctaccctagctgcacagaatcacccacgaagcttttaataaaatccccatgtctcaccctcaaatgtcctgactgaattgctgggttggggtcaacatctggatatttgagtatgggtattaaaacctttccaggtgaacaaaaatatgaagctatggttgaaaaatcacacatcattatcatctaatattatttagtatcttattctatcaagacttctgctagaatggcataactagtactaaaagggtaataatggctaccacttactgaatatctccattatgctactatgctcaactccttgcaaatcggtttacctacgttctctaagtcaagccttgtaacaacatcctgatgtcaatattattattttcattttactccttagaaaattcaggtggattgaatttcagtaatagacgtggagtctcaaaagttgaatactcggccgggcgcggtggctcacgcctgtaatcccagcactttaggaggccgaggcgggtggatcatgaggtcaggagatcgagaccatcctggctaacgaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaaaaaaaaaaaaaaaagttgaatactcacaagtattcaagcccagaactgactaaatgcaaggcagtcctaaccatcacacagtactgcctccccagatgggttttacttccttttatttcatctagaggtaccagtgaagatgctaatgagcagtgagatggtggggcagggaggagaagaaagaggacacgtaatagttaagattcatctctctgaataatcagtagttaacctgacttcttattaagagtttgcatttgttttcatgcaaatttatctctgatctagatccagaaatgtaccaaatacagtttaaattccaatatatgagaagaagcaccaaatccttacctattttcagcttcctgggttataaatttaaataaatcatgtgaaatacatagaaaaactctttctttcctaatgtttaatgataatttatagccctagaacatttgtaaatttaacagcccatcaaagtgtctgagagcacaccagttctaaggactcattaagtgacattaaacataactttccatgaagtactgtacagcatgaataggtgggcaggctggtgaacagccatcactacaataatttattgtttgtaatttttgccttattacttccaaaaacattttttaaaagaggagggggagattcaaaaaaaaaaaaacaactaccactttgccaatactataaatcacaaaggcagaaagagcttttatgatcctaaggatgtgctaattctttctccagtcacccaaaaaatgacaagaaagaagttttgtggtaaagacttataggattttaaaaattcatttctttgaacagggctgtattgtttctaagtcacctcctccccaaattccaaagattatcagtaaaatgaaactaaagaaaggtagaattttttttccaatacacaagtgggggagtcgcctacttcatccaattcacattcttaaaatagaatttcttttgctctagaaatatgcagagttaagacccgaaataggccttaatctagtatatctggattttacaatatcactaagtgtcaccctagttttgtcagggcattcatcctaccttaataagtaaaatgaggacactaacgatctataattaaaaggtaatattaactcaaaggcaaaagtgacccacagactaagttataatgacaaaagtcaatggctgaagtttagccttccgacctgcataagaaacatccttcacacattttctttaaaacagcccaatcagacagtgaggaacattatacaacattcatggttttcattctttcactacatgatggcagacataatagaattcaaaagttttaactatcagtgcattaagcataatgtaataattatgctgatggcacaatttttactataaagtagatcacttatttggtttaggcttagcctaaaagattgtttttttcctctttttctagacatgtggtccagcacaggtgtctatattcctttgtcaaattctggttatcacttttactaatttggttgactaaaaatattctctccataaacttcaacaacttgatagtgagtatctgcagcagaaatagtcttcctgtataaaagtcatggattaactccacctcaaaagagcagccattttgaaaatgaacccatcaaaatcacaaataaccttagctaattccctttagtgttcttatgctaagtaacaacatatataatagtcccaaaaaaatttgtgtctagtatatgtgaggtattcattgtttacctttaaaacctcctttctgaacaacattaagagaaaacaatacggttttcacaaaaattatattttatatataaacattcatttaccaactacttaatacaatttcagccaaacaaaaatagcttcagtaatttgtactgggttaactttaacattcctgtagctttctgtgtttttatccagcatgcatgcacaatgctggccttaacgcaattcaaaatgtgaacatgtaaatatgtctgagagatttattaattgaaagtagcggaaactcaccaaaataacttccaaacttacgctgtagcaactaatttttgaaatactatgcagagctaataaagaaggaaactttttaaaatttttatttctgaatagccattggtttgactcaactgagaaaatttcattggctgttttgacattaggtggccagctggtatatactctaatttcacaggtgaggtttttgagattgtctatgcattcttatatgcagctaccaccaataagtaagaaagaatgattattgaattcaatcaccaatttctcccaatatatatgtacaaagcagaacaaagaaaaataaaaaaaaaatcaccagcaggcagcatgccttgttgattattttcccatcactaataacaatttatataaactacaaaacatgttataatttgaagcaatttattcacatctaaaattattactctaattccttattaattggtgttaagtaagaattaccagattattccaaagctaatattgcataacagcaagcagaaacaggtttagcaatcatctaaaattagcttattcactggaaaataaagattgaatgttaaggtataaaattattctaaatccccaaacacaccagaaccaattgtgaaattaaaatatgacactttccataattcaaactacagtacttgattttcatctttctcctcagctacccctaaattaaattagtcttattgattataactcagaaatccctgtcttgttactatgattttcaaattttaatgaaatgtacaatttagttgaacatagttaagttggttttcttaaattacaatatagaagattaagtataggctcaacaaatctcctcattactatagctacagacacattgaaagccaattcctttgcttgcttatgacaactgataaattcatgcattacaaacctgttttcaagtctgtcatgacagatgatcactcactgaagtaagatcttatgaactgattatcagtgttatttaatgaagcactggctgcacctaggtactggagtgaaatagaagtcctagtccaattaaaatgtggtgctgtgtacaaatggttgttaataactttagtaaatgcagaaccaccatttgaaattcacaagtcatcatcctagcaaacagaatagtacacagtatgtcttctttttttttcttactatttttttgagacaagttcttactctggctctatcacccagagtggagtgaagtagcgcagccatagctcactgtaacctcaaactcctgagctcaaaggatcttcctcccttaggtagtagctaggactataggtacacaccaccacacctggctaattaatttaaaaaaaattttttttagagatgggatatctctatgttgcccagactggtctcaaactcctggcctccagcaatcctcccacctcacctcccaaagccctgggactgcaagcatgagccaccatgcccagctatattttctgtaaattgctaatgagaatgaaacatgtatgctgtggacagaagccttgttggacctagcgcccatgctgggtcctttgccttaataaaacataactctggcattacatatataattaacagcctcaaagaacatgtttctttattaaactctgactgtttcagcattattttcagtacatttagatttaagtttggttttgattttttttaacttaagtgaaaagtatttctttcttatcagcatttctttgactttcacagttggtggtgccctgagcaaaaatgaatggatgcctagaccaccccagaccattcctccttcctccccaaaccaaagctgtggaactaactcttaactgtcttatttgtaaacagtggctgtattcatggctaatattgtaagattttctgtgtagtatcatcaaatttaataattccttaacaggaactgttcattaagggttgctttctattaaaaaataggtatgtgctaccttttcaatcttcttctcataatatttgagtgatttatttccattttgaatctttctgtttgttaactttggtgaaattaatatactattactaaaaaagcacattagagtaactggatgaatgacttgagctctcagctctcttcatcccaacaaatggggatgaaacattcattttcttcacatagatataataaatgttatcagccagtttctcacctgaggaattgttactgagggagtgctgagcatacaaattcctatatcagaactatcttctttctcaacaaaatgcaaggcaagtcttcattaactactgcctggtcatttacaacacacaccaaaaataaatgaggatgctatttaagataagaatacaataatgtttaaagagtattaagccacatcagatgcggtggcacgggcctgtagtcccagctactcaggaggctgaagctggaggactgcttgagcccaggagttcgaggttgctgtgagctatgattgtgccattgcactccaacctgggtgacagatcaagaccacatctcaaaaaaaaaaaaaaaaaaaaaggaaaaggagtattaagccattgtcataagtcactaattctcagctgtaaatatacttaaatatatttaagtgtaatctttcatttgttgaatcatgtattttatatttgatgaatttccatttcaattaccacaatgatgtttacacaagttgcaaacatttgtttttactagaagagactaagtcctattcattagcattgctcactgtcaattatgaaatacatttattatctccatcagagctatacgatacttagtttcaaaatacatgtcattactcaatgagaatgaattaaaataaagcatcaagattaactaggctagatctatagtaatatatcattcaaataataaaaattaatgcttattaatttcttactgcatgccatgtacagtactaagcacttcacatataataactcaatgtcatccataaaataacactgtgagataggtattgttatcatatctattttacagataggaataacgatgcaccaagaaggtaaagaacttgattaagactacacagctagtggaagataattgcttctaaagcttatgttctaacatctaaaataagccagttatgtcatgatgcctcttaagaagtctcatatgaatcaaatgctctatattaccagcacctggagaactttaattttaaaaataaataggcttattaagttacacatattgtaatactttagacagttcctgttagacatagcctaaaaatatattatagcatataaaatgaaactcaaaacaaaaagtacctagaattaatattttgctccactttccccaatccattcattatgaaaatttgtcactaagtatatagaacattggaagtgggtttttttgttactgtttcctatttagactataagctagacatagtctagaaaagtagctaatctatacattattgaaaataccacaacatattataccaggggaaccatagataaatactaaatattacattgataatgagtaatgggctgaaagcaaaactacaatgtaactcaaagagggaatatgaagccaaaataaaatggatgtgaatcccatgcaagctgtcccttagtcttctgaaggctgtgaaaagagaaggccttatttaggacaaagaaaggtagtatttttgaggtctggggaagatgctgatatcacttctgttcattattacaatactaaaaacaagtcatataaggagacgaagaagaaaggatggacaaactatctcatataatcattgtattttctgcaaatacagaaaataaatggtaagagctctattttatctgaaactgtagtttcttcggcatcctaagtgattttcctaaagtgtcatttatttgtctctagtgaaaggaaggaaagaatgttcaaaggcatagaatgtttttaatctctacctttgaacttccattatattgtttaaaaattactacgtgcatgtattacctattagtttaataaaactaacattttaagtgtcagtctacacacacaaaaaattcatcaaacccaatttaaagttagttatttaaaatattaataaatgattactaaatgattctaaatattctacatttaaagcaattacccaaggagaaaaatatgaaactgtatttaaaaaatacattaagccctgtcctttccatatatatgttaatggaatacaaacaggcacacacacacacattgcattttgggggcaatcaagctactctgtatgatactataatagtggaatacatgtcatcatacatttatccaaacccatacaatgtacaccaccaagagggaaacctaatgtaaactgtagactttgggtgacaatgatatgtcagtgtaggttcatcaattgtaacaaacgtaccactgtggtgagggatgttgataatgggagaagctgtgcacctgtggcagcagggagtatatgggaaatctctgtaccttctgttcaattttgctgcaaatctaaaaatgctcataactaaagttgtccaacctatggcccacaggccacatgtggcccaggatggctttgaatacagcccaacacaaatctgtaaactttcttaaaacattatgagatgtggctaggcatggtggctcatgcctgtaatcccagcactttgggaggctgagaagggtggatcatttgaggtaaggagtttgagaacagcctggccaacatggtgataccccgcttctactaaaagcacaacattagccgggcatggaggcacacacctgtaatccccgctaccagggaggctgaggcgggagaatctcttgaacctgggaggcggaggttgcagtgagccgagatggcaccactgcactccaggctgagcaacaaagcgtgactccatctcaaaaaaaaaaaaagaaaaaaaaattacgagattgttttgcaatttttttaaagctcatcagctatcattagtgttagtgtattttatgtgtgacccaagacaattcttccaatgtggccagggaaggcaaaagatggaacaccctgctctaaactatagtctgtttaataaaaaatcatgtgtcatttaatgaaggagaaatgttctgagaaatcattaggtgattttaccactgtgtgaaagtcatacagtgtacttacacagacctagattgtatagcctactacacacctaggctatatggtatagcctattgcttctaagctacaaacctgtatagcaagttcctgttctgaacactgtaggcaattgtgacacaatggtaaatatttgcatatctaaatgtatctaaacatagaaaaggcacagtaaaattatgttataaaaagattaaaaaatggtacacctatatagaacattaccatgaatggagcttgtggaactggaagttgctctcggtgagtcggtgagtgagtggtgactgaatatgaagacccagctctgtacacttctgtagactttatgaacactggacactgaagctacactaaatttattaaaaatattttttcttcaataatagattaaccttagcttactgtaactttttactttataaacttttcatttaaccttttgactcttttgtaataccacttagcttgaaacacaaatacattgtacaactgtacaaagtattttctttatatcctctctatcagctttttcatgaaaatttatttttttactttttaaacttttgttaaaaacgaagacataaactcacatatcagcctaggcctccacagggtgagaaatatcaatatcactgtcttccccctccacatcttgtcctgctgaaaagtcttcaggagcaataacacacacagaactgtcacctcctatggtaacaacgttttcttctggaataccttctcaaggacctgcctgaggctgttttgcagttaactttttttatatgtgagtacaaagattatactcaaaaataatgataagaagtacagtacagtaagtactaggcaataggcatttttcagctccattataatcttatggggccaccattataaatgtagtcctttgttgactaaaaacattgttacatagggcctgactacaaacacacacacacacacacacacacacacacacactctctgtctctctcatatgccctgtccttttcatatatatggaatatttttacacatatatatgaatgtacatttatacacatgtacatatatatatatatacatgtgtctttcatatatatacatatacacaaacacacacaatatacaaattttgcctatggtaaaactaaaagagtatccttgtagacactcattgagcaaatagtttttctggataccaaaaaattattgttttatatgaaaatacaagaacaactcttcccataaaacactgatggatatgaaataagtaatttctttatataattgtataatttttgagatgtagacatgtttattttcctacaaaaaacataaatatttataccttattaaattatctttatagcataaaatattctgatcattttcaatttaaaaaagcattgacataaagtattaattttctcctagaaagaaaatgggaggggggaaataaagttatcagaatagtttatcaaggctttagttgaggtctgctttctcaaagtaatacatatatttggatgttttgtatttatatgcaatttattaggtttcaatttgatttttttcactgctgcatcacaggatggttgctggtttagaaaggaagcaagtaggccagccacccaaaaagaaaccctcgctgtacctcccaggagattcttgcaacagacagatgctggccacacttcacagccttccagccaccagttgcccagcacatggctgagagggaagaacgagccagtaatggcaggcaccagcattttataaacaactggttctctaattccttctcatctctctcttttctctttacttacctctctcccgtctcctttcctttctctcttctcaacagccttgccatttcccccatctttatctcactattcttacttcattcttattcctttctcctttttctcctcacttgctttccgctgctcccttttccagtcttttttcctctcctccaacatattttatttgtaaattgcatccatccacaaaaactctgatatacttataagaacacataaaaaaattataacacgttagcaaaattccaacaaggaatagtgtggatacattaggtaagcaagactcacaaatactggacctttcatcattctctttactatacctccaatcccccatcttgtcaactatttacttttttactctttaacatactgttatctaccttctcatctattctcccctccagcatcctttccccgtcttccttgttcttctcttcatctttattattctagttcaagaacatcctttcagtaaccaagtgctccacaacctgtcccttcaaatgtaaacaaaatctcaccaaattttacccagagaaattttgttttctcccatctccttgcctctccttagcaagcctataacagaaaattcagaggctgtgtctcaaacactctccttatgcatatcaaactttttaactattataggagatctccaatataattgctgaggatattctttgaaaatattttcctaatctactaatgcaccccaaaatatttacgttttaaaattatccttttgaaataactccaccaagattgcattgtagaattcaccttataattcagtattttacttttctttctatgcctttaatctgcactaaactaattctggttacaagggcacttttgtgtacaatgcagatttttttttatttcttgctttccaataaatgacacacagagatataacaagagggaagtccttcagtagtctaaattgaggtcattttttaaaatgcattctgctttttaaaaatttcttcctgctttcattatttgtgagtcatttgttatccttaataccaatggggtcaagactcatggtcctttcccgaagtgaactactcctccaaaaacattatgaatgtgtttttcatgatgaattacaagtaagccagccagttctactcaagagccaggatgagacatgcaattaggctgtaaaaacccgatgtgctctttccacctttcctgtccctttcagcatggacaaagcaagaagggaaaagtctcctgacaagatgccaagtaagcccaggcccttctgaggcatcctggcggtagccagcagcagcccatctctgcattgccctcactgccggggccccgcgcctcatggcactgctgcgtcacattacttccgcttttctaacttttccacttgtgagcaccatcaattatgcactagaataacaggggctggccaggcagtgtaacataaaggccgattatgatgataaataatttaaacacctgcgtgccatgttccttttatcagtgacaggaggccaggggaatgtgatgcacaatgaaggtctgaatgtcccagaatgaccaatttggggacagcagggagcacattcacccatgaacctcctgttcactgcccacagggaggaaaggggcaaactgaatgaactgttcacaaacgtattcacacttgaaaaaactagctaagaatcacaggccacagatccaaagaacttttctttctttcttttatttttggccctagatctagcccaggaagtgcagggaacaatattttagcagtgggtggcatcttatatcttccagaaaaaaaagggaaacaattccatacaaaaagattttaagagaaaagacatagtttcatgtaaagttattcagactttaacaaaattcagacttgatgatctctttaccacacagtatgtttaatggtaaagtgtaattgggagctggcaggggataacagatacagtagaggtgaccggtctaacccccttttaaatgacacctcaccatttctcaactgtgatgcagaaattcttcaagtctctttattagtatcctatttttttaattgtgatttgaaaattcataatggtgtctcactcgtgtaatccaagcactttggaaggccaagctgggaggtttgcatagaggctaggaattcgagaccagcctgtgcaacctagagagaccttgtctctacaaaagattagaaaattagctgggcatggtggtatgcatctgtggtcctagttacttaggaggctgaggtggaagatcacttgagcccaggtgtttgaggttgcagttagctatgatggcgccactgcactgtagcctggacaacaaatgagatcctctcacaaaaaaagaagaaagttcacaacaaagaggaaactttcatatgttcaaaaacttccaggaaaacaggtaccctcctaccaacgccctggggagttcaaaactcagtaacactgacagtatctgatatcaggtggatgttctttacccacataggcagactaagttttaacctgagtccttaagggcgtatacccacaccaaaaataatgacagtatttcaaatgggagaagttcagataactgtctcaagtctattgatcttcatggagataatttccaaggtataatgcaagatttctaatgtttaaaaaaggtagaacaaccccaatagcatatacaagagtgaaagggaaaggaataaaactagataccagtaaggatgttgacaaatcaaaaagtgaccttaaaatatacgaaattcaaaagaaacgcatttaacttacgtcaaatgatagtcaacttcacttctggaatgagacttccattatctagaaatattccaaaattaattcttagtctacatgagagctaatattacatttctaaatgcaaattgatgaaaactctagggggaaaaaccattttgaactgtggtttccagaaggcttcaggtttagtcatgtcaaattaaagcggagcaaagcttcttaaaataacattcttcttaaatcgcatccatatgatttagcaaattgatacggccaaagtcaataaatcatgatgccgggtttttactttaatgtataactgcttttattttattttttgctttgagccaactccttataatttttagcccaaagttaaatgtatattcttgtctaggcaaaacaagctacttctcacataacgggttcctggttttcaatgtcaaaccaccacgaatgaaggaaatcttcccccagcggttcagcaggacacagagctggctgcctctggttgcaccaacatgcaacccattaactgcttttcagttggcagtatttgaatttgtagattttttcaccacttttcaatgtgtaagtgcttcttttttcttaaccccagggatttcattttgtgctgacacatacccaagaagcaatctccatgaaactatccttttaaggcaagcattttgtgcactccttaatgatgggtgtttaagagaaatggtaattatgatagattttgagccttaggtaacagacagcctcacagtgagagggttcactacatttaagaccaaactcctcattaagaaatggagatgtatcaattcagctctgtgcagacacactgacagtgaagtccaggttagtaaaagcattcatccttaggatggatggtctcaggagtgagccaacattcaacaaggtcatgctagttcacccagattgtgggcaaatgaaacttctcagggacagttaaacctaagggacatgggttgaaaatattattaaagcatcaatgcttaaaatattttctcctttcttatcctttttatgactttaaaatatttttgtttaaatgagtcacttaagctaccacattagatattctgcatgctataactgatgctgaaatcagagtatcagacaaaaggcatctaaagttcttaactaatgctagtaataaaactaccatgaaaacatattttatatatgtgtgtgtacataaatctgttttgcatatatgtgtgtgactcctaagactctcctcaagaggtattccagattaacatcactgttaaatgagaaaaaaaaagtccttgaatcaagatgcataacttcaatcccctccccacacgctgcatatgcgtgcaaaagttttcctgcccagcttgcctgcaaggatggcgaacagaatttaatatttcatggagcccaaagcacaaagcatgttcaaattcaatacaagaaaatgctttatcacatcctttatagattaataatccaaaacggtgagaaacttcaggaagccatgacaagttttaaccaaatgacatgtaagtttcttctggacaccctcaagctattaatgaaacagaaaatctgaaagatgtgtttgatttatctgtttaaggtatgtatttccagaagagttaccatatcccatcatattatttattatagctaacataacttggaatatcttatgcagtttttcttcaagaagatcagatcatgttcttgaatacagatggcataagccacgtatcttgcataacacttcctctattaaagctaaacccatgaaaactgtttaaagggaaagagtgaaacatgggcaaacatggtcccataataaccagctgtgaaggtgataaggttctggcagggcagtggcgtgatgacacagggcaataatctgtaaaccattagaaacgagcatgaaaagtatttagtgttttacaaatatttcagagcaaagcaagcatttcaggtttaaatcaaccagatttaagctttctggttttataagaataacctactataaatctttctaaaatgtgcctgctttttgtttatttaattttattcaggccagtaatgaccatgacaaatacctaaatgctgaactaagcaagaattctaaccctaaattttgtgtgggaggcttaaatttcttttataaagccaatgacagtaaatgagttcattattggtcactttcttttgataaaccataaccaaaaataaaatcgtaatataattataagagaaatcaaaagtccagaaaaaacaagagtacagccatatcttctccaatctttaatccactcccaagaatgacttttggttaaaataagtcatttcaatctataatatttagaatgacaagagaagtcctttgactccagcctgcttccagcatctgtcaagaaaatcacaaacctaaccctcaattcattggagaatgctaacaggagatgaataaggcttcagagagagaaagcatattattagaaaggttcaagaccaaatattcacagcaaggcactgtgtgtgtgtgtgtgtgtgtctgtgtgtgtgtgtgtgtgtgtgtgggtttgcttttcaagtatggtactgagtttttaaagtatatggattaggttatttttagttgaaatttttcaaaataaaagatacatatagtgtatgtgtgtgtgtatatatacataaactgattatatatatactatatataatcagtttaaatttaaaagcccctacagattatatataatatataatttatgattatacataatatataatcacatatgtaataatatatataatcagtttaaattcaaaagcccctacagagaaaacaaaaaactaagctaacagtttatttttatttatttatttatttatttatttttgacggagtctcactctgtcgcccaggctggagtgcagtggcactatctcggctaactgcaagctccgcctcctgggttcatgccattctcctgcctcagcctcccaagtagctgggactacacgcacctgccaccacgcctggctaattttttgtattttttttttttagtagagacggggtttcaccatgttagccaggatggtctcgatctcctgacctcatgatccgtccaccttggcctctcaaagtgctgggattacaggcttgagccatcgtgcccggccaacagtttacttttttagtccacttttgcatttcaactacttctaatcatagataacctaagggttcctgctttccaatccacacaagaaatcttatcagagatacaacaccgcgtgatctcacttatatgcagaggctaaaaaagtagaactcatagagagagagtaaaaagatggtttccagggactggggcgggtgggtgaagaaagtagagagatgttagtcaaagaacacaaaatttcagttaagtgaaataagttcaagagatctattatacaacatggtggctacagctaataacaatacattgtatagagttgacctactgcaaccacaaattcaaacaggcatggatcaaaaatatttttaaaaaagtaagatataacaatacaaaaatgcaaaatttaaaatacagtatgacaactatttacatagcatctatgttgtattaggtattataagtaacctggggatgatctagattatacagaaggatgtgcatatgttatatgcaaacatgataccatttcaattttatataagggacttgaccatctgaggactttggtatccatagagtttctggaaacaatcctccacggataccgagggatgaatgtacttcaaaatttctaacagaatagatcttaagcgttctcactatacacacacatacacacacacatatacacacacaaaaaaataagtatgtgaactaatgcatatgttaaatagcttgctttagccattctacaatgtatacatacatcaaaacattgtaaaccataaatacatagtttttacttgtcaattaaaataaatggatttaataaaatagaaaaaagatacatgtggtgtgttgcagaatactgtaaaagcatatagaaagcactcaggtagtaaaaattcagccttcagttataaaagcgtttcatttaaaacacaacatattacttcggtgatttaacattttcccatttttctctatcccatacccaccacacacagaataacctacataagttagaattttaaaatggggggttattatttacattttctagaatacaactaatttggaaaaagtcagaggagcagcagtgaattggcagcattcatttggtaaattcggtaagatgacatatacctgcttaaacaatagtgctagcagcagaagctcagtgaagtgcttaagagcacagactctggaaccaacttccacggttcataattccaattctgtcacttactaaaggtgtaactttcatccaataatctctcaatgccttggtatccttaactgcaaaatgaagatggcagtaatagtacctacctcatagggtcattaggcaaattacatgactttacatatgcacagtgcttgaaaagagactgacacatgggaagtgctatgtaatttttatttgtttatcttaaggctattgtgcagactataaatgtattaagtgcccagcacagggctcaactcagcagtgtggtagctggtagtagtattttttttctaatggcataggttaataagagcaagcgttaccaattattagtgcctttgtaaacagtaaacaaataagcctccatttcattatcaaacaaatgtctattaaaacacattttttgtttcttaaaaaaaacccagtgccagtaagagtgtaatgaaactataaaccgacaatattactaagaattataccatgttaatagtttgatcccataatcctaatactgcaccctagagatatactaaaatataagaaaagctttaagccaaaaaaattgtttaagttatttatgtgtcacttatgaaaaactgaaaacaatataggtgtctaacaataaggaacagtaggtcagtatttgaaaataggaggtttgggatatgcctcatataactagatttctccatcttggtctgtcagtggttattaatatatcaaagatactgagaggctgagacttaacgccattttttaatctgcatttcccagacacactgggtaacggaaactttgggggaaggtggtttcccattgaactaaagtgcccaggaacaggatggctaatctcgatgataatatatgcagcccttgacaaggatagttttcagtatcattcagcctgcttccagaagtatgagaagaatactcattatatcaatgttaagagaaaaaaaaaggctagactcagtcaattaatagctaagcatatgagaaaagctcaaatcccaaaatgatttgtagaattatgtgtaaatgttattttaatgtgaagctacttctatagtgaaaacaagttcataatcgtgacattataaaaccaatgtgatttagtgatagcaagtcttctgtcttcctgatttggaagtacagtttgtttatctggttactttaataaggcctgaggggcgaatccttactgaaagtgaccagtaacaagaacacagaaaacaaacagagagatcattcagcttcaccagaggaatacatggaggcagccagccctgtcaatttggaagaggctaatgaaacattatctgcaggtgagcggactgtcttgcagtattacagctctaagctacaaatgctttcctaaccacagaggtaaccgctatacagatactttgaaagacaaatgagaatgctgccacatgcaaggtcaatcacaaacaacctgggtgtctctccttccccaggagaccaggacctagggagccagtgggtatacccaagcaggccacaccaggtcacttctcttacatttctgagtttcaattttagcaacctggtaggtaggtaggtaggcaggtagatagatagatagatagatagatagatagatagatagatagatagacagacagacagacagatagatagatagaatgtatggatatgattaaaaataggctgggcacggtggctcacacctgtaatcccagcactttgggaggccaaggcaggtggattgcttgaggtcaggagttcgagaccagcctgggcaacatggtgaaacccatctctactaaaaatacaaaaaattagctgggcatggtggtacgtgcctgtagtcccagctactcgggaggctgaggagcaggaatcacttgaacccaggaggcaaaggttacagtgagcagagactgtaccaccgcactccagcctgggcaacagagtgagactctgtctcaaaaaaaaaaaaaatgtagaaataaagctcacacacattctggaaactgcttttccttgtgtcggagaaaatgagtaatcatcaatttccagtgcttataattttctgattaaggttactatggtttcaggaaatcactgtatgcacaagagcatggtaggctgtggactacctacaggggagaaaaataaaatcctagtaaataatagacagttcacttttgtctaggaagtttattaatacatcaactcccaaggtattctgggatgatgattttatttgatgcaatacattctatttaaggattttctttttatgacctaatgatgcatttaatttttaattaaatttcattttaaagtataaatatgtataaaagccaaagcaagtgtacagcatctgttcattgcatctgcactcactaccacaaaaattagccttaatctaaagaggcacaaatgggtttttataccaacaggaggcccaagtatttaaaaatcaatgactgtccacccagacaaagaacagctgtttcctatattccagctccatatcaagcccatgctcaacccaatggctagcctaaaactgcccatactctcgttttccccagtcaaaactgtcaaaaaagggcagtatctaaaagccatgagctggattaagtggagacaaggcagagaaggcctggcccaaacagatggcattttaagagacaccctctatcaccatcattcaatgacttagtaaaatcataatcaatcttatttcctgtgttcccaaatctacttaatgagacatttcacttttgtttaaaaggccaaggaggggactgtagggattggagagattttggtcaaaggacacaaactttcccttagacagaaggaataagttcaagagatctattgtgcattatagtggctatagttaataatatattgtatacttcaaaattgctgagagcagatttcaagggttctcaccacaaaaaataagtatgtgaagtaatgcatgttaaatagcttgatttagccattccatgatgtatacacatatatcaaaatatcattttgtagaccatagatatatacaatttttgtcaactaaaaaaaaaaaaaaaaaagccaaggaatgtcaagagtgaatcgatcgattctcaaccctccaaaacaagacttctttccctggaacgcaagtgagttctaaaatatttcatagactggagaatatcaccacttaatcaccacttaattgggcagttatagcattctctaaaatatgtgtgtttttactttcctgaaggacatgaaaccaagatggtagaagatggtatgaggagagaagaaaaagtaaaatgttcgcaaaatggagagaaagaaagaatacggggagtggtcatggtttttaaaggaagctccttggcactaggattttctattaagtcttttagggatcactttaaacagagttccatggtggagagtaggaagaagaaaaatcttagaaattatagatgagaagacagatttgtgttttgtgtgtcatctaaaatgtcattttgtccatttcctcacctgaaaaaaaaaaaaaaaactaatctagacgatcttgaaggccccatgtggtaccatgtttatatacttttcctgattgagtctcagaactaaattttaaaaggcatatattgagacaaatcagtaggtaatataagaaaactattaggagggcctcaaaaaacaacaggaggcaacagcacatttctcttctaacacggatgcccctgcaccggctgacttagtcctttaaataactcctaagtagatctaacaaatgaaatcagaatcttgccatgctagtgcccccattgtgcaggggtgggggtcccatcataggggttctgataagcactggactgtatggactttagtggtagcaattctggctggtcatagattcaaatccaaccatttacaggaggatttgtgggttgtgagtcaagtgggttgagaaatcataggaagcaccctctattgactgcacagaaacccatccctctattgattgcttcctgatcattcaggcccgtggacaccctgcttcagtgatctgccatctgcagcacatcctggggtgctctccagacacaaccatctgggcccccaaaagggtcccatggtcccagcctgaaaggtgattgtctccagaagcaccttcactgtgtttcaagcatcagggcttattaaaaccccgaagggaagtaatccctgaatgccactaaaagatctccagctggtaccatttatgaagtaagcttgacgagagggggagtgaatgggggagtggggacaggaaggaccagaagagagaagaatttagacaagggcaagttatccaaagagagcccccatcaaaaaagagtcatgttttatcagcttaagctttcctgccttctttcccaaaggtatttcccccctcaactctcattaattcttctttatagctgtctattttctttaataataataataataataataataataaaggcagcacatggctagagaaagtctgtgtgtgaaaattagaaagacttttcggatgaattacctggaaacaactgaacatgtcttccctagaaaatcagggaggaaaatgtttttttcatggaaaagaattagagtagctctcagtatctgtctctcccttctccattctttgggaaaagtcttttcatctcattaagttaagctgattaataaaaattcagcagtttgcccatggatcctttagaagtggcgatacaagctgaaagatgcaggcggaaggtttttgtgctggagacaatacaggggatgacttcttaaatccgtcgtcgtcatcctccattagtgataaatagtcaccttggctcagattcgtcagacaaatactatattgctacttgttatcttctagtaaccttcagaaaaactttagtgtttacttaaaaaatgaggaaaaaaaagaatcattatgtagaaaaaaatgagaacattttgcttcgtttcaaaaattatttattcaaattagtgaacaaaacatggtctatcggaataggctcattaaacagaaaaaatacttgcatccaaagaaatctcatatgtaaatagaaacttgtatattttttgctgtaacaagcagacaaatccagttattttttcatgaataactgtttattttgtcatcaaaaaatctttgttaattacctagttggtaactgacacataatagatgctcaatcaagagtttaagaagtgaatttcctcaacaaattttaagtgactactgtctacttttttctgttttgttttttgtttgtttttttgagacagtcttgccctgccacccagtttggagtgcaatggtgcaatctcggctcactgcaacctccgtctcctgggttcaagcaattctgctgcctcagcctcctgagtagctgggattacaggcatgtgccacaatacctggctaattttgtatttttagtagagatggggtttctccaggttggtcaggccggtctcgaactcccaacctcaagtgatctgcccacctcagcctctcaaagtgctgggattacaggcgtgagccaccacgcctggcctgttctgtttttcaaattttaagttctgggatacatgtgtaggatgtgcagggtttttaggtaaacatgtgccatggtggtttgctgcacctatcaatccatcacctaggtattaagccccacatgcattagttatttagagtcaattatataatgccatgacttacaaatgtcttcagctatccagacatgggttaaatacatccagaaaatatatatctattatgtgaaaagcttcaaacaaggggacataaagatcagtaaatctgccttgtagaagttgaagtaatttccgggctacctttaaacttgtgtagcactaaactgttcacctgtattttatccaaagtatttttcccaactgaccgaattaaatttgtactacccttcataatttgtttaaaagtccttgtaagtggcattcactattcacatgttaataactctgccaaatttatatctagcaaatcttggtatgtataagagtgtttttagtgccatttaaaccaatttattcacactatactgaatcaagttttatagtcaatctagtcattaaatttaccctaaaacaccagaacaaataaatatttttgtctgattctcacttcagaaagattgggcaggggtagttcttttcattcacatcttatggatattacatatacttaaagtcatgaattctttacagaacagcccccaaatgtttaaaagtgttaggcatgtttaaagatgcaactcttgatttggagattgctaaaacaacaataaaagacttattctaaaccttgatcaaattagctacttagctattattgttttctccagataaatatggattcagtaccagtaatagagccaaactcatttgaccacatattccctgtggcctgaagccgtcacctgttttgccatcgtcaatctatcttttcaaatacctaagaggctgagaccaatgcagctgagagaaacaatggataaggatctatttacacttctgctgtgaagaataatcataggttagctctggcttccaattaacaaataaaaaattggttaactaaagcacagctctttttctgtgaaatgataggtgagcagaatctaacagacactatatgcttagtaattagtatctaaggtataggaaaagagtacgcagttgcagtctagagatggaatgtacagcatgatgactatagttagtaatattgtgttgtatactgaaagtatgctaaaagggatagattggataaactgacttccttgactatggtaattatttcactctgtatatcaaaacatgatatacatatatcatggtgtacatgtcgtacatcttatatacaaaatatttttgaaaaatttaaagatactatatgcttaaaggcattatcattctcatattttaaaaattctacaacatgcctactgtgtgccaagcactatgttgactactgtaaacaaaaagaaaccaagtagattataagtatctggtattaatgtccagtgaggtgagataaatattactgagggatagtaaagggtaatactgattaaacatgttggtactagttcttccttttacaaatctacttgagttcctggatctccctgtaaacactgagacagaaagggtcacacatattgactcattttgtgcatatcttattgaaatgggaagctgttgagaaaacattcaactgcttctgaaaaaaatatttacatggtgagggggatacttctacttactatcagtgggtactatcactgaaagtggttcttaatatagaatgtccttgaccacaaataaatttttttaaagcttatttaaaaagcttcattgtatgggattttcctgtatgagaaaagtacagacatttgggtcagttctctaagtttctccagaaatagtattttattatatatattccactgaaattgagacttttgaatatgactgtcagtacattgtaggcaactattaagcatattttaaataacatatcaaagacaattatgaaatgcataaagcccctataatgcaaaattttttcaaaaatagcatctctgtgatgttatcaccctgacaatataaaacacaagaaaatgaaatatagttgataagattatgtaaaatgcagtatatgtatgtatttaagtaaaatgatttattttgcatcttaacaaaatatcaacctatttctatcatattcaattctggaaatttaagagccagacaagcaaacttcttggtgtaaatatgtagctactatatacactttcttcagcatctcacaatgcatcgtgggtataactgtctacaataaattaacagtaactcaatatttataaaagagaaacatagttcaaaatcatagccccataactggcattgcaattataatgagctcttattttatgaatatctttcaatgaaaatagctatattggtaactggaaataattattagtaaaacagacctactttaatgctcattctgataatcaaaaaatttaagattacagaattataaaataatggagaggaataaaatagattccacaaaagttcaacttggattaagttaagttgaacagcttttattagataacaaggaaatgaaaaacattcagttcatgtccaacaaattactaaatgcagaaacaccagcaaacacacattttactgtcggtaatggctgctgctcacaaatcaatctacttggatgagaacaagcctaacctctaagaggacacatcactgtgctctgtgactgtgattagtccaccgaaaactcacactgtcacaggaaatggggtgaatccagtccaatttacccatgaaactgattaggaataatttgactagaaactgcagagaaaacagaccctgagtgggccaggcaactccaataaatgaggtctataagcaaagctgtccaaagcaagaagggcattaaacaggtggattagataatatttaggcatttctgtttatatatctatttctatacttaccatcatcttgatgcaaacgcatttagtaacttacttaaagtttcactgaaaaaaagtttaactgattttttgcctaaatcattcttgcaaagagaactggcatcttggaacttactttaaagaaccaacatgtcttattcacttaggttctcactgattattaaagcaagttttgaaaagttcatttcatattataaagtttactatgacattatttatatatttttaataatcacatgaaagatatgtataaaattagttgagctttgtcaaaacatgcaataaaagggtgtgacaatggagtcatatttatgtaactaaaatacttatattgcataattgtttgctgaattaaaatactatatacaagtacccaatgtttaaaaattcttattctacttcttacttccttccaaatgcaaagggaaaacaaatgaaaaccaaatagtttcaacttgtggtacattttatagctgtgaattgaaaacattttattctaggctcttctttttcttcttttgaagcacttagattttttaaaaccatttttaattcttagaattagtctaaattaagagtttactcagatacagcacagttgcgatctccctgcgtcaaacttcaggattcaactcatcaactctgataagggatgttggatggtttgggtagttgaatatatgtcacacattatttttattactgactaattgtaacttcagtgtggttttccagatataaatatttaaagccatgtctgaaaacaaaacagaaaaaaaaatccttttaataaaatctttagagtcatgtttgaaagtaaaaaagaaaacttctgtgtcctcttcaaaagtttacacaatgtaaatatgtatgtattagttcctcttaactgaaaaaacaaagttggagggttggggagaagtaaatcataagtttttaaaaaagaagttttaaaggctgatagattaatgaagttgaaaatgacctcccagaagacaacaatcccctcatttcacagatgaggaaacacgacttgaccaaggttaagtgacttgcccaaggtcaaacagttaaatagtgtcaaggccttaccacatctcggatcttctaagtgagatgctctcgcctaagagatcgactaattcaatcaccttgtaaagatgaaaaacagagtcccagagcaatcgatgacttgattaaggtaaacatctagttggtagaaaataaaaaacctgactccaggccttggtatttttttaaaagatattttttcatcttccaaactgataaaatcaaaaagaataattttctcacaaatcaatacatgaatttagttaggctggcaaaacatctggcaacaggtagccaataaattgaaatgaagagaggcacactatgggcagacaactcataggctaatcgtcaaatgactaattctccatgttaatgaatcagaataataaaaatgaataatatgtagatttcatggatccaaaattatgcaccatgcattttacatgcgtttactttctcactgaatcaacacaattttgcaaattatacatcctattttacataagtgaaaattgagggttggagaaaagaggcagcatttgatcccaggtcacctcaactctaaagttagactatgctctctctttgacatatctctgtataattatatggtatttttatataataatacagaaatacatttgaaagtattaatagctaaaatttattgaccacatactatgcgccaggcatttttctatgctttatgtttaataatacatcatttaatcatcacagtaactctatcagacaaatagattagtatttccatatataaatgagaaagatgaaacagggaatgattaagtaacttgtctaggaccacagcaagtagtcagtggaggagcagagaagtgtacccagaaccaacccacctcaagttcttaagcatcatgggccagcccttgagtatggtgtttttgccatgactcaatctctgacctcaagaatcttagaatctagtaatgggaacacatgcaaaaatgcagataacatatataaactatagtataactcatatactaatattacccatataaacaactaaattagaagatggggtaacaacttccactgcagaggtacaaacagctatgctaaggaatgaattgcctaatgtttgcagacacgcaattcaacgaaaagacttgggttagtctggcaaagcagagaggtacataatggataaagtgtcaaaccctttcttccccttacttgttgtctctctggagattaggtgagaacctgatccactcactgcctatcaggagacttctgtctttgaaactaatcaggaagaatttactggctgttaaactctatggcaagaactcttgtgaaggaatgaaacaaaaggaagggaaactaagatgaaagtgagggatttgggacacaaaataacgcagagtcacttcaagcatctatgtattgttccctatagcttaaaaatgattatttcttgctcaaaatgtgcttataatacagaaagcaaaatctgcatttaaaattcttaagtaaaggtatattgttattatgtaaaccaaaactgactttaagtgaaataatttaggttgactatagaggaaaatttcctgactgtatgattgctaaattctaaaacttttattcagggaatatccagaatttcttctgaacgtcttcaaaaatagctctatacctttgccagccttcaggaaccaagcttacctgcatgcaggcaagaagggccagtggtatgtgaatccctagcaatttggttgtatatacagattgtacatacacatggcctcacaattagctccaaagaaccagtccacgaaacatttaacctccggttatactagttatttgtagtggatgccaaattatggcttgctacctcagtccattaaatgctcaacaaagaggaataaaaatgtgcatttttaatgctcttttcatattagcatatagtccctaccattctcctccactacacctcctcggaaattctgccccaaggtcacccttcaacatttcatcaagttctgttagacaaactgtatcactccacatagcccagctgagtggtaagggccatttactggccaagggacctttggctagtataaagtatgtaaaaatcagttttctcagcagcaaaacaagaattataatacttccctcacaagagcttttgtcaggatttttaaaaatgatgatttagtctataaaggactgtgctcagacacagtaagtgctcaataaatgggagctattcaagtcaattcctagaggggcacataagtacttctgtggcctataaagcaaaaatgaatctcttccacagcattgtttctattcgcccctaagtaaatgccaaagcctgtactctaactaggaaggttttgaaaacatgattcaaagagccatagggggtcctcgcaggcctctcaagaagcctgggaacagagcacagccgaccgcccaatctctccaactacaacttgatgtttgcttggtggtttggcatttgtttttccgttttacacattagactttcgctaatgatttttgtgaacaatggttttttggcaaaaaaaaaaaaaagctttgaaaacaattgcttaatccacatgtcagggaaacaattcagatataatagagcaccctaagtttcatctggaaatattaaaattactctgatttttatcatctcaccacttaaccacttacaaatgaagcctaatttgaagatcttcaacatttaccagtattctgttatatttacaaagcaattaaacagtggctaagatatacaacagtgcagaacaattctaatacatattaagaccctgttaatccatctgttacaaagaacaatgcaatataatggtcctccttcccctactaaaaatgcagcctcgtgtatgtgtgggagtaggaagtatatgagatatctctgtaccatcctctcaatattgctgtgaacctaaagctgctctaaataaataaagtctttaaaaagtcaaaaacaaaaatcacaaccttaaattcacactccacaacttgaccaacctacctcttcagcccatgctgcaggtactttcactagatcccctccaccctgaataaactactttctgtttattccccaaatccatatacaaggttacagccagtaggcctttgctcctgttcctaaggatccctggaatattcttcagctacttgccccatctcttttaaaatcatatccattgttcaaggtctagactaaattattcctctccagaaagtagtttctgatacccctgaacagatgtgctttctctctctctgtccatagcatttcatgctttattgtgacactattgttctaatatattagtggcctgaatgaagcagaacagtttgatgattgccttggcagtcaaagaattttctaattgtcctggtatttgcctgcatgtggtctttagcactgatatgttcacatcaaatatcacagaagactacaaatttaaaagcatgcttacaatatcagtggaaatgaattaacaatccaaatatgctattggttttactgtgtatttattaacaattactttgtagtcaagacacaataatttctttttaaggatgtttacttttctagttagtaaatgtacgggatggttttcactaaaacataagtcagccagctgtttgtttgggttcttaaactgaatggtaaaaatacaagcagctttttctcaaagtactccactttaaacaagggaatctgttccatatttaaatgatttaattttctttttctaaaaaaaaatagtttaaatttttcatataataagaacatctcctcttcagaactttcatttcaaatggcatatggttctccctcacccatctgatgccccagggatgccaaggcacttaggagacccaagagagtgtgtaatccgacatgacagctgaaagagggaaggctgacagaggcatcagaacaggtaccagggagggagaagcatcattctggaatctgagggtttacccttttactttcttccaagttcaccaaaatgctgcaatttacatctccttgagaagacagcatcactgacccaaaggtttcactcagaaatgggctggacccaccaagacaagcagctttgtgtaccttaaacttcactaaagcagacagactggtcagcgtttctgcacttcagtctcctaagttctccataacccagtgtaagctccagctggctttgtagtcagcttccctttcctctatatggtgcatttatgagttcggctgtgggccctgttaatttccctccacagcctttcttctcttcctaacacatgcatacttgagcccgctctggagtgctgactaaggaggaacaataggaggctttgagcagggctcaagccccagacccagtcaatatttacttcagtttggaggcactgttttaaagctccttccaagcacaactcaacagggggagtccccagaggtttctagattttattttaactagagggaagaggggtatggagataaatagattactgtccaaaccactttctcagagaaaataagagaggctgttcaacaaaacaggttagattttcaatactaattagcaatttataacaagaaaaaccaatcgtcttccaacactgattattgcagtcttaaaactccatattcaggctgcagtgcaaatctacttaatgtgacccatgtatatcttgtgagcagagtcctgatcctatcaaccactcaagagcttgccaatgtttgcctactctgcccagaatggtaatgcaagagctctaggtgaagttaacccaaactccacgactgaattccaaaccaggtcttatgtatactattaatatgtgattacaaaatgaagttgtgattaccaaaccccatgaattaagagtatgctatgataaacactagtaagtatgcctgttatctttgcagtagattggaaaggttaatctatggctatgaagggagtgactaggaaaaaaaagtcacaaatactctcttcccaccagtaaaagaggcttactatgggacagcatgtgagaggtaagatggatagtttgttctaataccatattagagccaataaagcttccctgtgggtttacattgccttctgttgacataaatatagacagaccttctatattaaatatgaaactacttaaccataaggatttttgtatttgccagtgggtttaaactttttttttaaaggtcaattgccatagaactaacccaaagtgacagttgggaaattttactaaaatgattaaggctatataaaattactaaagatttgttagatacctaaggaagaaattcatagttgtctgccataaccaactataatactcattattccattcaaatcattaagtagactttgttccttttgcttaaagactcaactgtatattccattcacattttgcaacatttccataagaacagagccaaatgatctaaaaactttaaaaagagaaattgaagagaatttacaactgtccaaagttaaaattctagtttatgacaaccttagtactaaagagcatcttctgtattttaaacatgtaaaatacattgacataactcagcctttcacaaagagaaatagagataattcaacccattcctccctccaaaaaaaataatgaggtaaaaggtgatgcaccaggattagcctgttcaactgtctaaattcatcacatgcactggaatctgttcagctctagcctttagtacattatttaccatattaataaaagctgaataattaagctgcaactcaatccaatcatttcaataccttaaggaattactggatagctatacacatgcaatctgatcaatcaacatgcgctcatggaaaaaaaaaaatgctgagtaagcctggctaagatgcagtctttggctgatattctttaactgatgtacaagaatataaggaattagtattttaataacacaaaatatcaataagtaagttatcaaaatttaaacttcttgactacccttttgccaagaaagtaagcctggagcaagggagtgactgtaactaatatcattcatcagacatggaatccaagtaacataaaattaccaagcttcaaacttgaaataaactcatagcaagctcattcccttgacaaattttaacttccaatttagcaggaaaaaagaaacctgcttttgtacaaaatgatataagagcaacaaaggtaaatctagctttcctatgagcacagcgattgtaaatattaaaatgctgtacttttaagagaaatctgttatgcagagttcacagtgttctttcaaataattttggtatggcttatgttagacccagtatttttattactagtggccaagttctgcccaccaacatcactaaatttctgggtacagcgcataaggatcattgataatttcccttatgaattactttttcctggcataaatgaggtttgtaccttcaggagtaaaacaacattacaaaatgattatgtaagtatatgatggaaattttttaacaagtaacaggcatatttgctatccatctaaataactataaacataggaagtaaaattggctttgaataaccacctgacaatgctataggaaagcagccctttggcagtaatctattactcaggtttcaatgcattaaaatatgtgttccttgacaaatcctgtttcctttctcagctacatgttgttatgatctatttatacctctaacatcaatgtgtgtataatatgtactaagtttaagatagtcaatagcaagagttctcaagcagagcgtcaagaggttaaaccctgctcttctggcagcagaattcagaaaaatccaaggatcccagggacagcccagctgcccgtaaggagcaggcccagacaggaattgatttgtttcaacaagctcctcattggaaatacaagcattctccaagaggatgtcggtattcattaatttctcctttgagatggagatatctcattataactatgaagtccaaagtagaatatcagggttttagaagtcaaagaagaaacaatatagcagagacaaactgagaggagaagggaggacattaaaaataaacctggccaattttacaaaggagattcaaaatccctttcccgggaagaaggtcctggaagacttgcctctcaagagtcagtctttacacattattactcttttagaaatcacaagataaaacctaaaatgtaaattcctttaaataaaacccaatgtaaatgtacaaatcatctctcaggaacaacatatattacaaaatgatacaatttggtctaccttttaaaaattcaactcttctgtgatgcttttaaaataagttttatttgtaagaatgtattttctatgcaacttaccagaatatatataaagtgagattcacaagaatatatataaagtgaggttcaaagtgaggtaactccccttaaatctctatttcccccccaatttattgaagtatgattgactttattctttttacaagttttatatcagtttttaaagtcctgccacatatacacattcctttaaattttcacaagtctgagggagatatttttattatacccatttatttattagggtgaagaaactgaggcttagattcaccactataaatggcatacttacaactcaaatagagctgaaatttaattagctctgaaataaaaccaaaaaattttaacagacaagtgacaaatctaatctgatataggttttttaatatcttactttctgagtccttgcctatccaacacccaaacaaatttaaagtttgatctgtaatagttgctactgtaaaaattcaaaacaaaaaagtacataaacacaatgtttttactatacgcagttaaatctgtataggaacatatattagtatatggaagaacttggttacaacctattaatatgatgacaagtcactgttaataactttgagttaaataaaaacaatttaatgtgcttattttctttttttaaaaatggaggtgaaaaacagtattaagaactactgagcatcttctacttcatctaaaacacaaatcttaggtatatcaactctattttcaacaaatccattcctattcctaaatttaacaatctttgaagcatatagcatagttcttttttaggagccacttaagttcacacagagtcacagaaggttctagcatttcaggatctatgagaatcataaaactggaaacgctaagtgcttgtcacccccaaattcactgtttgagaaccctcgtttacaccacagtgaacataaacataaacttacaaagaaaacagtactgtcttgatttactattcttaataatattcatagttattatgaaatagtacccaatgttctaattaaagccattgaggatttaaaaagaaaaatatttgcttctgttttaaaattaactatcaaaaattgttggtaaaaatttctttttaaaataaaattatacttaagtggtcactgtcctgttcatctgtttcctttcataaaaatacacctgacttaaagtacaaaccgttttatctcttttaaaaataatcattccatagaggtacatttcaattaagtcagtctacttaactgatgctttcaaagacttgaaagttcatttagattagtaatattgtatttatatacacagagtgaagatcagtaaaaacaaaaaacaaaaaacgcagagtaatcttctgaatttaactagttccattccttacttgttaatacaaagatttgctttgaaaaagcaaataatacatacgctgtgaggaaagcagaagcatatttgcagatcttatattacctagactctacaggagcaaaagtttctcactaagactactagaatcatagaactttacagaaagaacgcattttgtcccaagtcttttataactccattgaaattacaggctcctgaaagccacccacaagaaacccagacattgaaagtagaaaaactgttagtcatcttttatgttaatgtaaaaagaacatttggggttaatttaaccatacggatttaagttggaaagtgttaaaaatctgtttctgcggtgtaattctggcattgccacataaaatacatcttgggagggtttgcttaatatctttagacatttatgacaggatcctccttaaactttttggaccaaggtagtatttttattccagtggaatttgtctacagagaccaaatcttataatgaaatccctgtcccattacctttgttagtggtgtattttcaatgaagcataaacttcaatgtaaaaatctgttttatttgtctgagttttgaaggaaagtggttagaaaggaacattaggcattctgggcttcttaaatggcaaataattttccttcacataaatacggagccattttagaaactgcagaactctatgaaaagttcagcgcaaatacaaccaagagtccttgaagaagagccagaagtcatctctctcccacttaattttatctagaaccttgctgtgcaaaccacggttcatgggccagcagcatcaatgtcatctgggagcttgttagaaatgcagactgtcagggccctatgtagcccagacccactaaattaaaatctgcatttcaacgaaatctccaggtctgtgttcaccttacagtgtgagaaacagtgacctagaaattactaaccgaatgcttcatgatgacagggatgctgtatatatgctgtttactgcagtatctccagtactgagaacagtacctggcccacagtggacacctgacataaatatctgtcaaataaatctacatgtgcacatttatggtactattttatactctgtaatataattatatgtataaaattattatatctgcacaatggtcttaagttccttacaggtgcaaatgttatcttatccctgaatccactgtatgtctcccagtgttctgcaaatatcactcaatagtttatcaatgataacttttagatattcaatataggaatatagaatttcttcagtgtgaaaactttggaaaaataagttcaagtcaacatgtaattgctgaattcatctatttggctttggttttagatacagctaagagtgctcaccctaggaatgaaaatagtaatggaaaacattatataggaccaagttctgattctatgtggtaccagagaacagggatggcgtggatgactgaaatccaaaattgattccaaaacttcatgttattcaatagctttaaggtcttcccttaccaaatcttctatccaagctgctaaaagtttgagttttttgggttttcctttttttttttttttttttagtttccttttctttctcaaatcttccataggtctacaggcccagagacaataaaatggctaaaagccatcaaaagagaaaaatagcaatagagagatttacataataaatgaagtgattagctctcaaataaccagatgtcaatgaaaaatctagagctaagtaaaaaaaaaataatttgcaaaagacgtaatgataatagtcagatatgttaatatatgtattgataacaagaccatgccaaaataatattcaaaataacgagatattcagactcacagatattgctggttctctcagttcatattacaaaggaagaacgctaaaatagggagacccttcctaacaaagaactgcattttttcattttaattaactaaattaatagtcctttctacattttttttccttcagagaacagaggatgaaggtaaaccaataggtatgtctgaccttaggtgtacatattcttatggaatatcgtgtatacatatacccaccccctcaacacacaccacctctgtcatgttgtcttcccaagagtatagttgactatggtgatgtcaaagtgtgtaattagttttcattgttcccttgatagctatagttccatacaagaccctttgcttttgatgctgtaaatgctatggaaaaaatacactaataacaggcatttaattatggttctagcaaccacagtgggaacactgccagaaaaagactggaacctctgagatggcaaaaacatatatatatatatatatatatatatatatatatatatatatatatatatatatttggcaagtgggggaggttctgttcttcaattacagtaattttcaaaatattaatgacaagcatatggtgggaaaattttaaaatgtttccttgaatctttgttgacaataaagtatgtatacaatgctacacccatactgaaaccaagaagaacactatcatgtctgtaactaaaatattaataagaataaaggaattgcttattaatcagggaaatactctttagaatagctttatattttgatactataggtaaagagtacaaagatttcatttcaaattttgttttttgcctggcttttcacagactttaaaaaaattatcacttgtgatacaaaatacctgggtgctacattctctgatgtttaatttgttttatacagtatttaaaataaagtatcccaagttgctgcaatggcagacaccagatctatcactgaggtcccttctctccttattaattagtaattgggagacacattttggcagctttcgtttccccattattttctctagtttgacacaaaaccctgtcagaagcaccactatttgaactgtacccctcttagtgctgggtcactaaattttaataaacggagctcccgccagaaaactactgaaataggcgtaaaagtttattgaagcagtaacagtaaacaaatatatgaagaaagcactgaatgccacagtatctaaaacattaatggtctgtctgaacccaggggttactggcgagattgcagagcagaggctaaaagaaaaggcctttaacaaaaccactgctttcatctgtctgttaaaaaaaaaaaaaagaagaagaagaagaagaaaaaaaaagtattagctaaataaagcaggcaaacactttgctgcagcagaaccatacatctgagcttcccttagcctccattatcccaacatgttgaataaaattattgggaggcaaagatttatagcgactatatggacagagaagccatccggaagccacaaaagctctgtctgagccaaagaaacattttcataaatggtaaggtgagaaacttaaaatgaaaactaaaaagactgatactttggaggtctgcaaatagctacagaatcagtttcaagatctccatctcaaagtgtcagtcacttcaaaaacgcatcctgctacgatggtggctcaggacacttgtgtgccagggcagtggccatgctgtgcaagtcagaggtcaccgcttccacattccgacatctgtctgtattttcttgccctgaaacaatagaaggggaactaggctcatttgctcccactttgtttaacctaattgttagacacaaaagataatttcccatacttagaattattttttccttttccccccattctcatttgtctccataaaattaaaaactattaaaaatgtaagcacgtgaagttgtctatacattattgagttcagtaaatgtaacaaagttgtatatcccactgacatctacaaaatataaaacatcaagtatcatgtctgtcatcatcacaacctagataacaatttgcactataattatccaacctaactatgccataacctcatttaattcaaaccacaacactgcctgtttcatataaaaatactttcatttacttttataatttccagggaaagaggcaagagctaattcttaattatagtttttacatatataaataattaataaattttaaaatggaaactctgacagcttggaaacagcaagaaaaaaaacaaaaggtatttgttagttcatttaaaaacaaaaggtcactttgaacattcaagttattttagtcttctcactagccaaagaaaaacagatgctagatatcagaggaaagttttctgcgcaaaaatggtcaactcgtacctgaactttaaccgcgatacatgtatctgttattaaaacatgcatttattgcctttacactacatctacaaccacccaaaatcctacctctaatgaactgaagcagtttttcataagtgacataagtaatatttcactgtgcccagcttaatcaggctaagtcaggttacttttgaaattaatcttacggaagctctgcttttactgcagtacatgagaataatgttcccagccatcatcaaacacatgcagtagtaagcagtatagtataaatttttagtaaagtttattaggtcacttggttttccaaatgtatccagaaatacaaaacatgacagaaaatatagcagtcagttgatatactctcataatttttagtaacaaatatgaatttacttgtaaaataatctatgagaacccacaagaaagatttgttctaatgtgataggaagagcctatatttcagagacaaaaaggctctgacttaatataacgcatcttaaccccaactgcttcatatttagaggtacctatactcttatcagtaccttttgcgggagaaagattccgggtagacttgagtaattaaaaaaaaaaaaaaaaggcaaccaacaaataaaaagaactacttagcatagtcagaaaaatgaaatcaggatttgagggtggaggtgacaataggggctattaatatatcactttgaagttagccataaagtataagcttcgagaaaaaaatatgtatggaaacatggtacagcccaacatttaacattaatatataatatgcctgggtttaagcatattattactaagttaaaacatccttttctgtcaactaaatataagaagatagcattttagtaagttcgcaaataagatagcgctttaaatgtagagagccctgccaaaatgatcataaagtggtttagtccttttctatcgtccatattcatttccgaaccaatttcacgaaagaaataaaatcggtcttaaaacaagatggctgcttctaggggggaaaaaaaacacgctgatttaactgaaagccaaaaaacaagcttttctaaatcaggaaataagcacttaatcatattttttctaatctctaagtaggtattcatgtgtttccaacatggtaatccatatattatactgcgtggttattttaaatcattaatagcaaagcgatttttaaaacaggtctaatcaatgtgtactaacaacatgattgtccaaggcatatacatatttgctaacatatatgactgtccagagcatatgccaaaactcccacttttagttcacaccagaatcgtgatcatcagtcatgaaaatcaggtcacttgataagctataatagaaagaatatttatatcttatatctcctaagaatccaatcataaaacttgcagcaatatcctattacaatcaaatcaactgtacttgactttttaaaagtaaaaatcataggaactttactgttagacgatctctccttgagctacactttgctgaccctccctaaagcaactggaagatcaattctgatatgcatataaaaattaagagcattttatccatcttgaaataattttaaaatagatttttaaaaatcattcaaacgtatttttattcctcacttgagtggaaaataagacctgacagtaacattttcttcaacctgtcaactgtcaattgtatgaaggatgtttctaaagatgacaaaggtttatttttccttattgaaaatgatagaattctacctgaatgaaagctgagctaaccatcactgtggtacactactgtctctcagcaactagctagcctaaataagagttttcaatattttaaaataatgttttcattgaactatatggtttactgtttgaaaattatattcagaagcctcaaaaacaagaatttgcatccactcaaatttttcaattagaaaatagcacacggatttcagtttacaataaatcctttagagagtacaataaaaagtactatcaagaatatgaagatattaggaatgattttactcaagatcatgcaaaatagttgtagtcagaaaaaacttgattaatttttaattttaagctagatggtcctgtgtcattgtgctcctttatgactgactaaattttgaaaacataaatgcagacaaatttaagaggaaataaatctcctagtagtgagtaatatcctattcagaagcactggaagttcacattaatcacaagaaacttttctacaaaacagctcaggacataggttgaaaagcagactaaaatataaatttgataatataaatcaggcccttaaaagagacagtaatttattgatgtttggctgtctaagaccaccatcgtaagacaaattattaaaagtgaatattaatacctcatttcttatactcctctttgaggattttatacctgaaaatgaaggtgttatccatcacaaatgatcaaagggcaatttttttcctcagttcagaaagcggatctgactgagttgtcctgggtaagaggcaaggaccttcctcactgtgcttagggaaattgaggcttcctttgcaacatggatattctaatccggaatgctattttaacagtttgtatactgcttctgaaaagaaaattgataatatagaatcgtcaacacagagtcgttcattatttcaaacaaaatatcacagctttttaagtctttattgctaccgaagttattcaacacatgcacaaaaatgaggaaggttgagtggtatcttataaaaaatttttaaatttatattgaaaacacaaaccaataagccactagaccaaatgctacccaacatgtaaaattctattcttaacatattctcatattttgttcatttttattttaatgctttctctctctcaaaggtaaattttctggcatatacttatcccaagctagcaaaggccagaactcctgaaggactaattgtattcattcattttcttggcccagcgtgaagctggtagcttgcttggttcatagcaacaggggagaaaaggaggcgcccatctttatgtccttatccaacaggaaaccaggccagtggacagaatgcagtgaaatgcctgttcagaaggtattctgcaagattaaatggcaagaaattcacaaggttaatttgcacccaagtaactaagtgttccctccaaacctgatcctcagccttcaaaggtggaagcttctgaagctactgtcagccacaacacacatgacaacaagatattagttcagtgagctgatggtttagttattaccactaaaatcacctaacagagagtaataaactactgaagactctgatacttttaatcactagtagtttactgaccttggtcttaccctgaaaatgccaaattagactgtatagccaaatctgcctcaaatagctctaatgttcctatcatctaaaaatcagacagttgagtatttctgatagtttattgtgaatatataaaataatgaatcaaataggtagaacatatcttagtagctaactctgcttttcaaaattctatggaaaactcaccaaaaaacaggaatcatacttctcttttacaaatttctagattaaaaaggggggagggtcaattcacgtctcttataaacatataagcataaaaacatgggttataaacctcaatcatactgccttatttttagcctggtacttgcataaattctgatctaaatttcagagtaacaaaattactaccaatacatctaataatgtgatacgttacactgaggcttaaagttaatgccttttacttgaaaaacatttatgtttctaacatacaaaatattacttaaaatatttaaaatttcaaaagtaaggacaatctaagttttgtgatgaaactcattcaagaccaagataaactttcaatctttactcacaacaaattcttagatttaaaccatgctgatttcatttacttgtcagtgaaaaggtcacagtgccggcatactggtatacatatgtcaaaatgatgatggctcagattttttttaaatggagcaactaaattttgaaagaagaaaaatactcaagggaatatgattaggaaaaaaaaaatgttactacttctctcttcttagccacatacatttgacctgtactgccagaggacttgggagtgttgacctagaattcacattactttcacaactccaagattacgtgttaacaaaactaaaaggtgtcaattacctgctactctaatatgaaatgtttaatatacaagtccctacaagaattgaaaaagtccaaagaaaacatgattaggttaaagtttagtaaatccttcatgacttacacagatattttcctcttaagagtataaccttttaaattgatgatactcaaaccttaacagaagcaaagcaccaggttgaggacgactggtattcctaaaagtgtgttggtcatatttgctgctgtattatttgactattgcatcaataatgccaaccagtaggagatatgtttaattaccctaatatcatttcagcaaatagtcaaaataatccaagaagaacttagaatacgcacatgatgtttaaaagtatattcttattagaagcaccaaactgcttatggcatacttcagatgaagaggcatgttcttagtattatgactctctttataagcatagctactaaaggagaatgtaaataaacttttattactggaagtctttttaactttatttaaaagctttttacattcttaaagaaattaaggacaaatagttatattcttcttgatgtggattttcattactcaaagttacttggtgacattccagtttagaattcagaataatattaaaaggatgatttgattatttacacttttaggtaaaacttatacaagttttcaaattttggaaatatagaagatctatttaggcaaatgttatcatatatttctattcaaactgatagttctgagtggctatttcacaaatttgtgccaattcaacacataaaaaaatcagtttggtcccctatccaataaatactaccaactaaaagttatcagcatttgaaaactcagtatccacttctcagaagtgaatacctgggtacatagattgtaacagtaaaactattctgacagcaaataaatttaatattttttcccgtgaaactacatctatagatgctcatttatcaatggagaggcagtaatgaaactccatgtagaagataaactcctaccagatacacaagtgacacaagttacacagtaagatactgtacttaatccctgtgatcaagatacatttaattctgattttacctaaacataatttcaaattgaatctgttagtataagctaaagtagatttacttcgtttagacacagtgtacattatcatcagtttaacgtgcccactgaacatattatattctgagggaaaaataaaaaaaattatttaagttgcaattaaagtcctctattcttttttcaaaagattgaagtcttactagtttagcaaaattttaacagataggttctatataaagacacaaagcatggctagcttactttatgaaataacatacaggaaaaggaattgcacaacagtgaatttataaaatttactaaacccgtggaaattttctgaaatattttcttactattgtttgtggaaaactgttagtttttatttttaaaatacttatttggcatgtggcctcttatatccaagttgacttttcttaatgcatcaaaagagcaacatcttattcaacacttcagagataaaactgcctacttttaaaatattgtttttaaagtaagtttttaactgtgataacataccaagataaatgtgtccataaattcctaagaataataagtgttagggctgtatctcttggggttaagaggggtacatcattctttcttttggccattatcaaactgataatgatcaaatagaaaggtaattctacaaacctgaagttagaataccgatttagaaatactcttggtattttaaaattctgcagattaactttgtctgggcaggttcaaagcctccatggcatcctgagcagaagagttttctgcaggcagggcagatctattaaaaaacatgacctgtgacaaaaatcaatgtgctaatctcaaaccaaacaacagtatcaaaagcacaaaacagagataacctaagataaaatgtcctcaaactaactcagactagcttgacaggttaagaaggggggttaaagtaggggtgttgctggttctttccgttttaacccaggaagactggaacacccaagtatccaaataaatgaatgccatgagaaaaagatcacaatgtggagcttggtgtgggaaagaaaagacaaccgagagcaagatatcccaaattcaaagaaactatttcagtgttgctttatttaataaggtgctaaagttcagagatacaaatttctgcttcgtatatgctgcctaataaagcacaaacggggaaaaaaaactaaccaacataatgagactggcttttaacaccatcacaactggaaagcttgctctatttgtcttgtcagctttaataaaaggcatctctcctctggcaggatggcttctttttctcttttcctaatagtggtaagtggcatgtcaaagaagaaatcgcttcccattccaccacccacctccaggagactcttgttttttgaaccaaactttcaggaatatctccactcctgttcagcggttcatttaggacttgggcggctacctgagtaagactatcttggactagcgggatagggggaactccctcctggttctgtaaccggcggactgcttgtggggaaatcttcccatcttcatctgcgctgacattattcaagcagggaatccctctcttgcctgcatgctgaggggaggctggaggcaggcggagagggcccgcaggagatagaaaaaactggaggcgcccaccgataccctctctcctggagcccggggcgcgcaccaactcttaggctaacccctcggcctcccgcctctctcttcccaacttccactccagcccagtgaaaaacctgtgactttagatgcaatcggtactattaataaatagcacctaggagggcaccgagaccggcacacagctggaagctagcctctgtcccagagaaagcagtgcggtatgggcctagcggggccgacttctgtgcacaggccgggaagcaataaaggttcggaactgctccagacccggaggaccccgccgggcactctggataacctccccactccacttccagggtccgaaaacacgggacgtctgcgactggccggtgtccagcacgcgcactaggaccgcccccggcgcccacctctagtctcccgcatacccggcgggcttcgggacgcctacaaatcggttccaggtaatcgcgcgcgttcctccggcagcacatcgccaggccgcgggcgaagggctcccacctcctggctcggccaactctggcagcttgttctgcacacatgacgtaacccggcattagatcaaactttctggcaccttgaacccactggggtgggtggagggatggagaagatgggagaatcctctccactgccaggcgcgccgggcccagactgactcaggggccgaatgatttcctcgcagttgaagaggaaaataaaaacctaaagcttccgcttcccagcccccctcacttcccccagcccgtgcgctctctctgcgcgcaccgggaaaagagaagggaaaattaaaattaaaaaaaaaaaaaaaaaaaaaaaaactttgggggatgtttggcgggttctctccgcagtccctgcggacccacgctccaggaaggagctcccggctgcgcacactgggggctccccgcgccgggaaccggatgccagccagatgccggggctgggaagcagagaagtccctactccccggctcccgcccttttccgagtctcccggcgccccgcagaagcagttggtctaggcagccccggggactcccaggggtacctggcctttccgcggcggcttaacaaagaggggcgcgacgcgagcgcttcccgccgacgcctcaagccatcagcgcccgggcgacgcaggctccgagggtgcgcgccgccagcggttggtgcgcgccgatccccgccgccgctccttccgcagggccccgaggcccgggtagccctggctctccgcctgttatcggcttacctggggttgctgctgttccagtagacagcgtagcggtcggcgacggccttggagcccgggtcctggctgaacacacacatccagagcaccagaaacaccagcgtcaacatctccacgtgcaacatcacgcctggccagcggcggagcccccgacgcgccactccggggagagagcggggatccggagggagggaggcaggcaaagggacagagagagagcgggcgccaaataaatatgaataaataaaaatgaaagtgggcgagaaaggaaagaggcgcccaccaagctggggaggggtaggagagcgagaagaaaagaaggcggtgggatggggggtgataaagacaaactcgcacccccactggagggttcaggaggaaaaaggaatcacaagatggagagaagc

SEQ ID NO: 2438 - DNA, 374612 bp, Homo sapiens
tcccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaaggtaagccaggtaccgcgacgcacggagctctgccccgcggggctcacgctcttcaaagcacgttctcaccgaagccttgcacgtcgggaaggtgcctccgaatagagcagtttgctctgagagtgaaggaaagatgtgccttttttttttccaactgtcttctaaaacacttcaggagataattttagatggtctaaactttgaaaatgtgtttttaatctgacaccatttcgagcaattaccttgtttgccaatttgagcagaaagaaagaaagaaaatcctccagcgttgcaacccagttatgttaattgccaaatagccaaggcagtattttattttctaattatgaccatgtggtactccgagaagtttgaaagaaaattcagccttcctctctagactctttagtatgtttaaaggtaatgacaggttgttcctacttgggatcatggcatttatgaatggactaaagggaaatcagagtttgtcgaagcggaggtgcgtgtttatggtgcaagggctgtgttgaagttgtgtgtatcccgccaggcaatggtttgctctatggtacaggttctaaagagcagcatatgccacattaacgtaagtaatatttgcaagaattacaataagcttaggttggattctctttgtttaaaggcttatatacaaataggagaatgtatttaatgaatagtggatagctcctgggaagatatagtaaataactgaatagtagattaagagagaatgttcatatgcagcaaatggcatttccttgatgttgtgttatttattatccttgtaatgagcattaattccttttcagtgggttaaagtgcaaacctaatgttaaggacaccaatgtgttctataagattgtgtacttaatacatacattttctttctcctgtattccttttgtgatctattcttgtgaatacagtcactaactcgtaaaacaaacttctctaaataattgattagtgtaaagccacacttacaacattaatttcctcttagtgattttgaacttataacagtaacatttagcaatttattttgcaagttaacaataccgagcaactgatgtgcaaacatcatgttatatacatcactccttagaaaatatattgtcaagccaatactgttgtatatgtaccttaattttaaaaacacgagtaaaaacaaaatacttagaaagttttttattaaatgtaataactgcctgatactcggtgacctactttcactgctaatagagcagtaatttatctccttccttactgactgcctttatcaatttggcagttttcattaaatgttctgaatcttttttctaaataagaaaatgaaaattctaaaatataaggatcaagaaaattatcttacccacaaatgactttttattttacaaaccaaattaaaatgtttatttgaaagtaagagtcaatcattcttcctgaatgaaaggtaagagtattcatttgtataacgggtaacatgtataataggtaacatatcaataaattaaacttaatgttttaaaaatttttgttctttgcagatattaaaatattgacaataactagaaaaatagtattaaaattcccacattgtcatgataaattatattttccagatagaatggttatgaactatgtagatatggatattactgaattaattatgcacaagaatgtagctgttagtcagtatttttgtggaaaacaacctttaagtaaactgcaagagaaaaaaaaagacaccaaactatttcacacctatgtaaaattaatcagtattaatttaatgaaacagagttaatcaaatacaaattgcttttaagcctcacctcatgtatgtttggggatataatgtatataattatacagacaggtacacattaaccatatggatatagaaaggtaaatatattcagaaagctgacataattgcatttaatttgcttggatgaaagtttatccatcattcatgggattattccttccagattgtgtcctatgggtagtgtctcttttccttcctgtgattgtgaagggaagctttaaaacaaatttaagatgatttaacttaggtaatacttgagtgagattttaaatattatccatagctgggctctcagttgagttgaataacatgaaaagtgaaaatgccaagtatgtgccaagatttccgtgcaatttttctaacaatgtaatttaaatagaaagcaattcttttgaaaatgtatatatgagaggagtggtgatttaaaaatggtattaatgtagttttctgatataattttttaattttgaaatatgaaatactagactgtatttaaaatattatgattgaaatatttcaacactgtaaaaaatttatgagaaatttactgaaacatatttactagaatatattcttcaatctgttatgaagttaggcatttgagaaccaaagagaacaaaaccaggccattgacttaattgctaggacatttgcagttgtgtgatgtgttttttaatttaagatttaatcattaaacatcaatattgaaatgccatgggtccctgataagaaaaataacttagaaaatgtttaatctgaattttccttctattaatgtatttacaaatatctctcttatatgctttcaagaaaatgactccaggtgataatagggactcatcaacgataacagatattcataattccaatgatcacttgactcagcaattggcctatatacttaaacagaactttataaaaactttattaaattcttatcaggtctctctgtttacatggcttaagaaaagacttttaatgggagatcagctgtttttcatggcaaaatatgattgctacactacgtattattttaaaagttcatatacttactcctagtttccataccacagggatgattaatggtaaacagaaataacattggaacaaagttaaaactggatataaaataaaattatcaactgtggttacttcaaccctttcagaattggtaaaaatactttctttaaacacttttatacatttatggcagtctggggtacaatgcactattaattcatcagcacataatacactaaatcattttttctatccaaaagagttcataaattggattaacatttacctagaaagctctttatattgaaaatagagtatccaaaataaaactgaataaaattaaatattcatatttatatactacttttttaaagactttttttagtagctaagacactatttctatgaaatgcatttccctaaatataaatattctaaatactagaggaaactatgcaattgtttaaaacttaaaagtaaaacttgcatatgaatattataagcttccctttgagtagtaggcaaatgttggagaaaataaataatcaattttttcatttttaaaaattacaataaattggcatcacttttcatatataaacacttttcctcaaataagaacacactgtgattaaaacattaatagagaactaagctatcatatcatctttataagtttttttggtttggaagagggtttacatttgcttttcatagcatttcatcatgctagactaaataattgaatgcattatacatttttgtaatttaatagctctcctaatagctcacccctacatcccccccccaccccgcctccatggttaactgtgctatttgcctgaaggtaggagaaaccttattttcactattttataacccacaacagttaacacttgacctaggtcattaacaggattatcagcaaatttgtttaagcttttactgacaatctgaattgctacgataatattttgaatgtcccgtaaagaaactttttgtaacctctcaaaatctatcacaaaattaattcattctgaatctatatctttgtaaagactagtatctataataataatttgagtggtgaaaaggttcactcggatacctcaatctctttatttttatgtttcataatcatactattccagtccttgtcataaatgagcaattataaactcttttagatattacatcttctagtaataacaatagatttatcaatacaaaacagtttcactgtaactatcaatatttttaattttatatttttaaattattgttactgtagttgatagggttttctttgcctattttaaggttaaaagttagttggatatacttctaattcagaagtgactggacttataaaaggggaactacatgtaataaaacaccattgccacgtgttagatcatggttgtattttatataaagttgtctttccatgaaacactagaaattgggagctataatgaaaaacactttaatacaaaaatttaaaacaaaatattgtacagaatcagatcttagagagttatttttaacattttttagtaggtttaggaagtttttggtaaagtttttcatttcttgaattgaattatggttggctcgttggtcatattaacaacttagtaatctcacgttgctcttaataagtttattattaaataaatgatttagtaacattctttatgtattgcctacatttaacattcaaactttggtgtgttccttaagggtccgaccatttttaatacttttccacaataaatttctttctaatgttaaaatcctttcagaaatttaaatttttttcggaaataaaatatatgcaatttttaaatatcaaatagttacttttgcaaatgatttttaaaggcaaaatatatttccaaaatatatttgatttactaatttcaacacaaatgaaaaaaaaaagaagtgttcttgaaagttacattttccaagtcataagatcttcaggaaaatattaataaaactttcctcaaatcatcaaactcgataaggttttatagacatttactaaaaaaaatctgtgatctgggctactttttatttgaatcattctttcaatgattcggtttggcataaatactagatataaggggaaacgtgtatttcttggaagaacattaagttttacaagttattttctgtcaagatcctcaactttattttttagcctgcacattttttctttaaaatatttaataaaccttgttcctttaattcctgtttgagagaagatttagaagaacagatgcaggtgtctccttttgggttctgttttcagagatctggattttatcatcacggaaggtcaataaagggcttttaccaagtacacaagtagctttccacagattttttaaataaagggttgaccagtagtgtgaaacattcattatattattcatccagttatacagaaaaccaggattagaaatttacttctcagaaatgtggaaaccttagctaactcttctgtaacaactttagaaatattagtaaaagcaatattgtgacatttataaaatgcaaagtcttccaagtcacaaatcaatccacctaggaagacatccctcagtgtgttcggggtgtggatacatgtgcgccacttgcttgatttcattaagtctgttcccagctgcttggtatcaggtagttcttggaacctggcaggaggttttctccaggaaaatctgaaagtcagcaagttttagtttgcctcctaccagcttcctttgtacaaaaaaaaaaaaaaaaaaaaaaaaaaaagaggggagggtggtcgattacaaagaaaaaagtttttgcaggagaaaagaaaataaaaaaagttgattagaaaactggagaagtagagaaaagcaaaggttttaaagccaatgttaatatataaatcatttgcttaaaagaaaggcatttatcacgtaaaacatctggctaatcaatttttattaaatccctaaaaaccccgcacacttaaaatggggttgaggtgggggggggctgcatttctttgtttctcctcaagtttacacacttttgattttttcccagaagaaaatatttcatccaggaaagttttaagagtgacagccaaaaaatgctaaaatgcttccccctttgaatgtctggacgaatgcatgtggaggggtggacagaatcaaaatcaattcagcaaataaagcctcaaatttgaagtgatgttattaaactagaagccctgagtgtgaacatcccccaacccttcattttctaaatcatgtcccgctgttccagtcaaagcaaagggtgaaaatccacataatccaaaccaacatggtgaagtgagaataataggtgaggaaggaggaggaaagcaagtggcagcactgtacaaacaaactgttgtgaatattcctcgccatggacaggagtagccacaggaggggataactgcctttcttcttcttcgccttacactttccacatttgataatgcaaattcattaaattacaaaagtgtgtcatgcgaaattttagcacaaagcagagccgtacgggtagagacagtaatgtggcaacagggagatgagcaagtgttccttgctgccaccacacccaccatcagggtgtcttaaccacaaactattctccgctaggtccaggctcgttggtgcaaagggaaaacaacggtgtctctcaacagttcactgcttgctcactctgcatcaaattaaagatgagatcataaaaaaacatctccgggtgcgcgtaacgcagtctcagccctctggaggccagtgggttctttgtgcacaagtctctccgcgcctggctgcccaagtcagttcccggagcgcgaccagggtgccacggcctccgtcccgaggtagggtgggtgggcgagcgcagcctgatgctcttttgctccgggtttctgcccccgggcggacggtgtagactctgtagcgagcggagagcgaaggtgcaaagttaagcgaacacgagcgccaggaggagactggagcgcgcgagaggcaaacgtgcgccctctgcctgctgccgcggatctgctggcactgggagagcacggcgtactccttgccacctggaccctccttacctgggcgtcagtaagacgccagagagtccatgcgccttggacgggcctggcaggtcctgacctgaggaatagactttaattcaggatctacgatcgccctgccgcctttcgcattgctgtcagctaggcttttcagtttgatgtctggaagtggcgtgtctcttttccatccattttcatgggttcaccaggtgacagccaggggaaggagatattctgcaaggttcgctgccggattgagaaagcatctcttactgggtgcgcttggttgagactcacaggagttgcctcatacgccctgttgtgcagcttgctgatttctaaccctatccctttactatttcttcatcttttgggcattcaactcttttggtgtcgctagactaaaatgaagaatatctttttttttttttagaaaaattttctttaaaactacctgctagtgccacctttaggcccctagtaattgctgaggggatgtcagtaaacttttcccctgtgcatattcaaaagttgtctgtgttctcccaaagcccgtgtttgactgacaccattttattaaaacaggatttttcctcttccaatattgggagtaaacatggaatgggcaagagagggtttttgggagctgtgctatcgagatagcttggtgggtggatgatcctgatgtttctgtggctgtgttagaacttcagtctttttcataaaagatgattttgttaaatcctgtagacttcaagactaatatatcctcagtgccgtgttcaacactgagaaaataattgctcagtgctctgctggcaaatagatttttcccttacattatcattcacgacttactgaacctcatttaatcgttaaagcagccctaaaataggtaacataatgtttcccattgttacaactgaggaaactgagaaaatggatcataataaagcggtaactaagccaagccctctctcgtctttgtcttttgattttaacctcatatgttttctcctagacacaaatgactatgaactagggaggcatcattgtcaggaaaagcactagcttctcaaccttaatcccagtgactgtactaatttgtcttctgactttgcaaggataatttagaaacattcagaaatttgtagtgaaaaattgaagaaaaccatataaatgagggtactttggaactgtagttacactcataagttatgattatctgcgtgtgggggggacccactaagaaactaagttaaaggaatttgttgtggacagaagagtagatgaaaatatctgtgatgacttttcttcacacgttcttacctctgtgttcctttcctgacactcaaacactcctttcatcaccctggaaagaagattttgtcaggaattccatacatacagatagtgaggaaattgtacaatataaccagagtgtgattatttagggttatgtgtaataaaaatgaagtgtgaattaacaattggaattatcttaaaggtcagtaataggagaaaatagaacatggtccaaaaagtagactttagtctctgtggaaatttccccccgtttaaaatataatttttaaattgcttaagatgagaaaataaattttagtgatttagctcttctttcataaaagcacttgtattctatttaactcctgccattgagaaaaggtagctaaaacaggcttttgaaaggtagcaaattaagttgggggcaattatatttttcatgtgggtattttagcacatatgttttgcattaattgctgcaataaattctgttaacctggcaaagagcaaaaatagcatattgatgacatcaggcttccaaagcagaaagcagcttttagtatcttgctgtcttcactgtaacattaaaaaaaaaaaaaaaaaaaaaactaatgtggtggttaaccaaagagttagccattctttcaagctattggcatattttccatgaacaaagtgaagaattagcaacaaactttttcccccttacttccagagaattcatgtcaattactcattttcctgttatttgattttttatattcatatttgttactcattttcctattatttgatttttttatatttatatttgggttttcagaactctctcaaatcaaggcaaatgtaaactgactttaaaggctccaaactgagctgtcttcccttttaagacaaacatcttgactgattacatagcagggcctcaaaagggacttaagcaaatagagaattgtgggttaattttattactgagaagtttagttggtcaatatcaaaactgtttcttctcgatttttaatacattcattttgagaaggttaatataggttttttcaattaatagttaagaaaaatagatgaataagatctaaaggtccagtaagtgtaaactgcctcatgtaagactttaaaattttactttttgcctatgataaagttgattgatttccaatcaacaggaaattgtaacatttcctatctacctcagactgactaaggggaacacagagcagcttgttagcagttaacatgtatttatttcctgattttcaaacgcaatttagcaattaataaaactgtatagcttttaaagggatatattctttcattgcatctgatggcagtcttcacactgagggaaagtctgggaagctaatttgcaatgtcttccatgtggattatctaactaatcctctgggtaagcaaaacaccactcacaggaaaagtctatttgcagcactgtgtggtgtgttatatcaccaacagtattgtcctcttacaaaactgagctattcccaaactgtaagcaaaatttaatgaataaatatataccttttgacctcattatggcataatttttttttgaattacaaacaggtgatgtgaaaaaaacaaaaacaaccattgatttatttgtcactatctaatcttgttcattttccccaattgtcctctaatcatctataatattcaaaggtggcaaaaaggctagagttatatacaaactgagatttctttcccccttgaataagtcacagctgatcatggtagattttgctttttttacagaataaaagaactgacagcatcatagaaaactagaactagaattaagtcagattgttactcttttatgaaatctataaacaccaccaaatctagtaactgccaaatattggaaatattttcaaagatgcagtataaaaggacatagtatttttctcttggtttacttttactatctggtttactatagataatttaatactcatttacattcgataactcaaaaagataaacttagaggttttattatagtgttcttgacacttctgatctaaattatgatttgattgtccttgttctctgaaaaagaaatttccatgtgtaattatatgtatttcatctggctaaactagttaatccatgcttaacaatggtttttttctatattttcagatacaagtgattttctttgacatttgtacattgcataaagaaaatttttcttatctttcaaagtgatgttccaaatcatactaaatgttttaatattcccacaagaaaaataaaatgagaggaagaaaactaaaaagatataaaattagtaatattcctttaaatttttctttccaaaggtgatcctttggaaattaactaagcatgttttattttatgtttggccaggtgtgtagtaggtttactaccctaaccctattagtgaaaactttggaactctaaatgtaatgacaaaggcacaactttaagaatcattaaaatgagtcaagaaaagggttgatatataactaattgcctgttacataatgactcatctttcatattataataatttattgtctgtttatttaccaaacagtacttatctgaggattagttacccactagattttgaaaaaaaatatctgctagggagtggaatgctctgtgctcttgaagatgtcaaattcaatgggataaatgaatctaaaataaatacttatataaaaattgttataacatagatatgaaaattatgaaaatatgatatgaatctttagtggagggtgcaatttaagtcccagaacagagtccctgagagacagggagaatttttttaaggtaaaagataataataaattcataaaaacaaggactaggagattagaagctttgcttaagttcatgtggtggggataattttaacccagatttatttttaactgcatgtaactttaaaaataatttaaatgaatatataacaaagacacacttttaagcatgtccaaaataactaaatattcagaaatagttcttgttaagcacataccgaagctaacataaattctttacattacatgtgagtgcatgtgaatatattggaaacacatgtgactgaatatcaaaatagaaccatctccatataaaaacttctgtaggtgctattcctattatgactacactacccaaaaatatctcattggtctttatttgcattctgccatctctttcatcaataaattaaaagttttctgactattccagtgcggagtttgatgctttccattgacaccatgctcctaagatgcaaaggaaaagactagtgttttgaaataaactgctaagaatgtggtaccatatttgatcctttggggaccattataaaaacccaaaaacaagtcttgaagagtttgttcgtgtgtgtgtgcctgtgtttgtagatgtccatcaaatttgtattgtcatgatcaaaataaatgatacacctgagattttagacaatccagatattctgcagaatatgatgaagtcagaactttattctgattttagttttccagaaatttgtttaataaggaaaccaatttattctacagtggggttctttcaaaacaaatatgtgtgtatgtatgtgcacatgtgtgtttggggatgccaaaatgtccagaggatgtttttaaatttaaacttacttttgtttcaccactacattctttgtttcctatgctagaattttgaatctttatatccaacggacttctaggaactatgtttatttctaaaggaaatactacattagagttattctgtaggccagttttcttcttgtattctattttcccagccaacagtcaaactctggctgaacagatagcctgtgctatctggatgtcgatattctacattttatgataatatgattttttaaataccaagatagactgattttatggggtgaaggcaaaatgcatatgctgtagtttaaactgctatttcccttaatgactatttgtatttcataattgagtaatatgttttcatttttcactttttaatctttcaaaaaggtctctctgaattggatgtaaacaatcattctattacttctggaacactttaaaaagcaaaactgtgaaaaataaaatgctgtttacataataatgtcctggttttagaaacttacattttgggagacacattttactcgtctgaatgattcataatatcagttaacaatggagagaaacaaagagctgttatttaagtcaggctgttagtgcactaaaaattcactggcagtagagcatcacaactcatttatgtgaaaggattattttgttataagaacacatttttctactgatatcttgatacctgtttgttccataatagttttgatatcagtatgacctttatatttctctgattaaaagagaaagaaagaaaattttaacacttgataaacagcataggattgacatttactaaagtaagtttctagcagaattttgttctatgttatttcctgaatcactctagttataaaaacacagactcatcttattgtgagactctgttttgattccaaggagttccccctactgttggcaaagattgagatgagacagctaattgcaatttcttctataagatctttatagaaataaatccaaaattattgcccaggagaaaaagctaatgagaaagaataagttaagtgcagaaatcttcttatatcacataaataggctgttaaaataccacctgaccaaaggtttttcatagcaatgtttaacatggcagcatttaaaaaattactacatcagcctggcacggtggctcacacctgtaatcccagcactttgggaggccgaggccggcggttcacgaggtcaggagatcaagaccatcctgactaacgcggtgaaaccccgtctctacacaaaaacaaaattagccaggcgtggtggcaggtgcctctagtcccagctactcgggaggctgaggcaggagaatggcgtgaacctgttaggcggagctggcagtgggaggagatcgtgccactgcactccagcctgggcgacagagcgagactccgtctcaaaaaaataaataaataaataaataaaataaattattacatcataattttagctgttcatttgataaaaattgtataaattaacatttctgtgatataaaatgctgctaaatttaacacagtttacaggaacttttatctgcacacaattgacacataatagttgacttcgtttatagtacaacatttttataatttttatctgtgaaataaaatactaattaaagctattaaagtattttggctgggcacggtggctcacgcctgtaatctcagcactttgggaggccaaggcgtgcggatcatgaggtcaagagatcgagacaatcctggccaacatagtgaaaccccgtctctactaaaagtacaaaaattagctgggtgtggtggcacacgcctgtagtcccagttactcaggaggccgaggcaggagaattgcttgaatccaggaggcagaggttgcagtgagccaagtttgtgccactgcactccagcctggcgacacagggagaccccgtctcaaaaaaaaaaaaaaaattatgcttgggtagaaagaaaataaatacaaacaggaagtccacaggaacaattaaattaagaatatacaagcatggtagataaaagttatgttgcaatatataagtacatcaaaaatctatcttctctaaacttctcaatatcataccctgctgcttacagtaaaacagaaaagctgagctttgctgaattcctatcagaaaatataggtcgatttcttaattctgtattatgtttgaccggagaactacacagagaatgataacactgagtacaaagtttatttctttctgtatcattttcttcaatttgtgacatttaaatatacttagaagcagattgaagagctctgtgtagtcctgtaacctagagcaaagttattctgcttattataacagaaagtggtgaaaatcataaagataagtatttgtgaaatgaggctgggacaattacagtgatggtgtgcatagaaagaaactgtcattactctttagtgaaaacaagatgtaatcaaaggatgggcttatttttgttgtagtggttttatagttatttgtacttggctataaaagtcccttataactgaaggttttactagagaacatgtgcattattatatgagtttgaaattctttagccattaaagcctactgttaaccttgaaatgattgtttaataattatttataactcagtttcataaaatgcaactatagccttaccacaaagcctatgggtgtattattaggtaattggaaagatctgcttcagtaaaaaactgtggcatttaattttaaaaaccttttagaactctctgcatgtttgtggcacttaaaaatctttcaaggtgtgaatattagtttcactctcagtctttctaagtggacaagtagccactatgaatcagaatttagaaatgtcctttaaaaatctttatgtgttaataattctctaaaaatcaaaactccagaaacttgtacatttttaatccgccctcactaactgggaacatttgtttcaagcccttcttttagtaactgagaatttgaaataaaaagtcttagtttgttccttttactaagaagaaaagactatgtaaattatttgaataggcaattatttgtgacactaccaatactaatgagcaattttactaggagtggacttttgattgagtctctccattgtgacagaggataggaaaggaagagagaggatgactctgggaatcttaatcccacaatccaaaagagggggaaacataacagtagaaatcagtggcagaaatgacatctaggtttcctcctttccataagtacttattaccaatttgagccaatttgctctatactttcctcctttttttgtttgtttgctttgttttgtttgtttttgagatagtttcgctctgtttcccaggctgcattgcggtggcgcaatctcggctcactgcaacctgcgcctccgggttgaagcgattctcctgcctcagcctcccaagtagctgggattacaggtgtgtgctgccatgccagctaatttttgtatttttagtagagatgagttttcgccatgttggccaggctggtcttgaactcctgacctctggtgatccacttgccttggcctcccaaagtgctgggattacaggcatgagccaccgcgcccgccactatactttgtttttactcctttactccattctacaccttcttatttacgtcagaaaccaccattccttctttccagatcttagtaacttagtgcccatctgaaagtcaaatcaacagtccaagtaaggattgccttccccttcttatgaatataagccccttctagtcatacatctctatttaaaagcaattagaggcagtaaaacatgtgaaagaaaaacctagaaccatatccatctatacttaagatggtgttttccaaattcatttttgcccagaaaaactccagttatttatttaccaacttaaatagaatcatgacatttaaaaacatttccaatttaaatcactttcattaaaaaagtttatatattccacatagttttttgaatataaaatattctaaaattaacaaaataatgtgttttctgttacacaccaaaaatatttggcaatcacatcattagaatatgaaatctgggaaggggtaacttacagctttgataaataactggcatgagacagccattaaagaatgaagtcatgcatatgttcctatctagccttaagaaagttttctttttgtcagattttatcattgcgaactcgtattgtccagcaattgaaataaactatccaactactagtgcaattaaaattcagtccacagtagtatatttgtatgtcacaactcattagcctatcctgtctgtcctagagtttgaaaggaaatgatcaggtctagatatgtttagagaggggacagcattatagtaaccaaagttcttgcctgtatcagtgtgagatttaagatatgtattgcaatgttacattgagtcaatgtatgcagagaaatcgctcacagatttactttgaaattccattcattgtcttttcttacctcaattatgctgtatactcaaacagttctacaatggatcacaggagatttgaggtttgtatcctgggagtcccaattaagtaacaattcactttaaagtatttagaattcttagacggtgttatttttatttgggtacaaacaaaaggcactttataaatccaaagtatgtgcttttaaagtgtgttttgaagttaactattctactctactagatcatgtatttaggtcatgtaattgaattataaatacaatttagaagccacaatggaactgttgttaaataatattaatgtattaaatttacgagaaggaagtctgtacagcatgttataaactcatggtggatttaaagatatttatggtatttgaacattacagcaacattgcaagatactcagggtagatataattgatagacaatagaatcagtcagaagtaatgctgctaattgtgtttttctcatttatgctgaatagagtgcactaaaaatttaatttctgagtaaatgcaataaatttaattaatcttctacacttactttaattgactgtatggtctaacctattttggtttatttgttctcctttgagtagaaaccaaatgctgatgtgattagtccagttcttttccattgttcttattatcagaagaaacgtaaggatatggtagttcattagttgacaacctacattccaataagtaatttactaaatggagtctatgtaataaccatatcttcttcttctcactctggttactaatactgagattaaactagtgattgatcttaacatgtggagtaacatataattatcatttagtaatgtgcaattactacctgaacacaatgatacattaagccatttaaacccctaaggacattgcaaatataatctaataatttatgtatactggcaagctgatttctactatgcaaatcccatataaagctcagagaaattaaatgattggtatcacacaactaacaactgaactaggtatatcttttatcagaataaatgttagtaatatcctttaatttaaaggtgaggaagtattttcatattttcaaaaattttctaacagttatctgaaatataatctataacattgattaattggttgagggtatttaattatttttcagagataattgcaatataattaagcatactgttaatttccaaactgatatcctgggaaataattcaattatggaaattatactatgtaatccatgcagcggctatctatcttctgttttaatttaaatacaattacttctaattaggattaatttattgggaaaaaattctttaatcattaaggaattataatataaaaggtaaagtttatgtttgtctttcactagcaaaacgtaaagaatctaactttgagaattgtatttcttttaaattgtagtgatcaagagccttacttttacccatttaatttatttatcaactaaccagataatcaaaattttagtactgcttgaaaatttagaaacctaatgtctatcaaatatgtaatttatttttcttaacattttataagattaatatttccttcacaaaaaaatagttgagatgattttttaaagtctatcaaatacacaatttatttttcttaacatttaaaagattaatgtttgctttgcaaaaaaaaatacttgagatgacttttaaaaggatggtgcttttcatgtatcaggaaacactttataaacaacatgagaacatgttgtgcggtgtatgtatttacattatgttttggtttgtgtatatatgtaacccctgaaaatgattcccttctattgtatttattgattttcatggtctggttcatgttaataatgcatgcttagtttatgtaaccttccttcacatcctccattagtcaatcatgggattgttttctaatttaggagaaagatgaggtaaaaccatagtttccattatttaataggtcagatagacaattaaagtgaaccttttgttattgattgtatttgaaatgctgttgtatattttattttctaacctattacaaatgaatattcagtatggaaaataaacagtgttccatcttcttttaataatatattaaaaatgcaaccatatgcatgctatattttactttttgtatacaaatatcgattaaaagtcattagaactagcacaaagttctgagtaaaaccactaaagcctttgagtaaaaataattactttaaataagtaaagctttacacaggtgttattataaaacatagttttactttgatttctcctcaaattggtagttaagctttttgtgtgttacatataagtaaataatgaatacatttttaaaaaatacacattgcagaataatatgttgagtattagccagggatgatatgaaggtgtcatattagatataaataaacagataaattgactcattctgtcaacatatttaagaaatgaattaattgtggaatcatatgtaaatttatcaaatttaatatttttgaagttattttgatatgctagcattaatgttgttttctattatgcatttttattgtttcctctttaaacccataattattatgccagaaattgccagtatattgaacattaacctatccttgtaaacaaatgcaaacagtttaaaaggacacagaaacttttgatctcttaactttccctgtgtattttttgtaatttccttctttttatcctaattatagacttataatgagaaggaagagttatgttttttgagcaacatcaacaacagacaatgtgaactcaacagaagcaaatagaaataattcactgttattaactgtgtttgtgtattatgttttattttagtcaatctactggattcaaaaacaattcaaggggagctgggctggatctcttatccatcacatggggtgagttcaataaactatcacaaggaaacattttctctattacctgtcttagggagcagatgaatttattgtattctctaaagagaactcttgtacttctggtgacaaattatacttataggagtattcaatatatggagtaccacagcttgacatttgtgtccaatggagctagtgagaattttgaagattttttttctccttaatttatcaattgcttgaatggactgattaaatagtttaattattattggcatcatgtcaatgatctaagagtgactttttttgatgtgatcagaataagtgaattaattagactgtctaaatttcaggtaatgtagaaagtgtgtatttggagacggtaatctccaaagtcatagccttaaaatcaacctcagtaactgctcttccaagtagttagaatttattggtcaacagtataaacctatgttgtcttaatttacttgtttcaaatgtctacagtttgcctagatcagctcaaaaatgggaatattacttagaaaaaatctgctgctgcctttaagttttaaactttttacatagctttggtattttatcaatccagatacaaattacagagtgtgtagcatattggtgttctgaatgactataatgaggcttttatgggagaacatttttcttttattttttctgaaaaatgaggggagtgttatttacatttctcaaactcttttccctacacaattgtgtaataaattcctgagcatacctttttgtttctaagtatagtttgtgaaatatgtgaagtactattttgaaatatttgtcataggaacaaatttatgtattcctgtccttctatgatagtcgtcttttcaagagattgtaattacttccacttcgtgttggcgttcagtctttagatttttgtgcctaaatatacacaattttttgatagcaccagcttcttcaccagcggatgttttccatcagagatacttcatctatctgtcatctttgtatctgcttctcttcctgacacaccttgactttgacaatatgccaaaacctaaaatcaagccttcattagttactttagaggagagagtatgaagtaagccaggatttggttttcccagaggtgtaaaaggaatcaaatgattaagataaaagcacagcctaggttgtcataaagagtgaattgaaactcaagtttgagctggaaaactcatttgaaactaatcatctaaaagtcaaacctcaccttaatttgattttagaaatttaaatttttcatgactccttcagataatataccagagaatctgctgcttcaggatataagaaaagcaaaagctatggtaacatttagtaactatatattagtatatggtatactgtataccatatatagacatactatatactatatatactatatactcaataatatagtatatatattactatattagtatctataactaatagatatgtatatgtttctttttaaaacaagaaatcatcttatatttcacagcaacagtctggcttatgttttcctttaaagaaggtataatggtaacacattttttatattgggaattgggggaaatgaattcccccattgttattctcatagataatgtgatgggatagagttggcacatctacttccagagctatgttggaggtagacagtggggtattcttagcaccttgctgggtaaagtgtggcacagggacaaaccagcaacatcaacatgtgggagattgttagaaatgcagactaccagaccctgctccagacattgtgaatcagaatgtgtatctcaataggtgactctttagcacattgaatttgagaaacactcctctgcataaattacctcttcacatttcccatctctggcccaatttactgtctctttgttccccagaaatctcttataacttccacagtcaaaagttttcagtttcttctttggtttactgttgcctcagagatccccacttggacccattagctcctcttcattgctgtcctctgttgatcttgcaactgtgattttcctatttctgatgcataaaatagcctaaaacagttggtcattctcttcaagcttatcattattatttgcagggagaaaagagacactccccaatagttcatgaaacttacaatacctgagaactccgaagctaaaaaaaagaataaaatcaaatgatgtgaattattgttctgtggtgatatatagtgtatatttcctttaaatttcccacatataaagttaaccataatatatataaggaaatatatagtgcagatttagaaaacattagattgttttttttttttttttgagaaactgaccaaattactgggtgaaaataatgtatggtaagtttaggttttggatttaatagcctggcatatacaaatatttgtgcctctagattcaattaattattgttattgctctcatttttaatatgacaaggatagattagttttgtggttgtattgtttttaaaggaaatagatacttataacaattgtgatatccttgctgaaacgtttttcataaaaaaaagacaagtaatagctggaaataactttgagtttgttatttttcaaattaattaactctaataactggcagtacatctgactggaggataactaaaatatgactgtaaacttaagaggaaaaaatcataataacaatattataccatattaaatcactgcaaattctcactcttgatttagggtagtggttcttaacaggttgagcgagtaagggaagagggaatttttattttgcctcggtgggatatttggcaatgtttgaagacttttgtaacaactggagaaagcaggcacttttacatttagtaggggagacaagaggtactgctaaatatcttccaatgaacatggcagcccctaaaaagaagaatgacctggtctaaaatgacagtggctaaattgagaaactcttacttaggggattaataatagcattccatcaggaaatgtccataactaaggagatttgggagactgccagctccctctctaacttccaatcatattctcatcagaagctctaaattccaaatctgttgaaatataaattttaaaaaataaataagtgattcatttcaaacttgaatctttcatggaatgcttgtatcatctgagctataaaaaattaacatatttggagaaaaatggtgaagagtagttcattcctacatataatttcttttctatttctattcttccttttcctccaaagacgtattcatacatgaaactttacaattcacctaggtaattttcttgggagtagtatttctatctcctttttttttttttttttctttttttgaaatggagtctcgctctgtcacccaggctggagcgctgtggcgcgatctcggctcactgcaagctccgcctcccgggttcacgcaattctcctgcctcagcctcccgagtagttgggactacaggcgcccgccaccacgctcagctaatttttttgtgttttttagtagagacggggtttcaccgtgtaagccaagatggactcgatctcctgacctcgtgatccgcccgccttggcctcccaaaatgttgggattacaggcgtgagacaccgcgcccggtccctatctccatttttaaatggtgcttcatatcttagagaaaaccttgtagggagatatgatactacatatattattaggccttggactaattctccaaataaatatctgggagtaaatttaatgaaactttaattttctctaaatgaaggtcatgaaaataatactcaaatttgtaaactgaaattatttgtggaggtcgtgaatagcaattcatttttcaatgaaagagttttatttgacactcatataatctggcattatatttggtgactttagcaaagcagactgaagcagttaccttctctggccctataaactatgaatgatatgatatttcaatccagggcttaattttattcagaaatttgggtaaataattcaatcgttctaatattaatatttgatttggagaacaatcaacacatatcaaagcctctatatattgttaggttattgtttttttctaaaaacagccttttgcttacacatgacttaaattgattgtacttaaattgattgattgattgactgattgatagtgtctatctaccacgtaaactttcttagactacatatcactacataaatgcattggaggagagatccaaggaaggttgagctacacagttttcacttagtatagtattgatattgtgattaactagtacaaagaaatcatgagctatgactcacttaattaaagaaactccaataagaagagagtgaggactggcagggttcagggagtgtagaaaaagcactgtctgaaatgagtaatatatgtttgtggaaaacagaaagaggtatccgaattagtaattgtggaattaaagtttctttagatatttattgatgtcttagcggtgaacatgcacttaaaggaaaacactcttttggcaaatagggagcttgttgattgcccacccaatatctgttcgctggattctccttgctgatgaaagaaacatcgatattgttcaagttttcaccctcccaggtgttcctggaaaatggcccctctgcgactccatgggttgaatgctgattcatcttggaactaatcatgaccatgatagttattgttgcagggattggttgaagcaagtgtaagtaaagccaatgagactggtgcagaattccagtgatttctaggaaaggttttcctcctgatggagagatagggagagacccatcatttcctccgtttgggcttgttctgtaaaggctctgggtctgcagcagctgcatttctctcgggactagaaaggcagagcccagtgagcataagagaagccagcatggaaccttgatatcactgaaccactgaattacgtgaaagaatgcctcttctttgttatttaagccactcttagtgtttttcatgctttcaaataaaaggcatccttacaggatagaatgttttatctttgctcaaatattctaatttctaaatggaggctatggctatggcataattgtatattatagtgttatttatattttccagattgtcttttttggtactttagtatgatgtcaaaaataatagagtagtaaaacaggttaagaacattggttagaattgaggcatctgcatttccattctatctctaccacttattatataatcagatgtaagccaattaatcaaaaactgaccaggtggctcatacctgtaatcccagcgctttgagagaccaaggcaggagaatcacttgaggccagggcttcaggatcagcctgggaaaacacagtgataacaccccatctccaatcaatcaatcaatcaatcgatcaatagaaattagcctggagtggtggccttcacctgtagttctagctactcagggggctgaggtgggaagattgcttgagcccaagagttccaggctgcagtggggtacgactgagccgctgcactctagcctgaatgacggagccagactctgtctctcaaaaagaatttttttaaatcttgaaaaacatttgtcttcacctctaaaaaaaggaattagagtaattcctatgtcatatcactttagagcaaatgagatttgagcaactgaaatatttctatgcatctaagaatacaaatacatataatacatgtgaaagagctatataaatatcatttcttattctaagacaagctttgaggttctcccattttaattcaaactcttgctaaattcatttacatgtctccttaaatctcagtctacacttgaggtcttgaatttgtatttaggagaaggaaagttgacagtgttgtgtgaagtctcagcaggcacctcttctaaattcagagcccaatacattgcctctgatgtcacttcatttttatttcatataatctgcacagacaaaagttcgcatacaatcttgctgcaaaaggaattgcggttttggaccacgaattttaaatcattattactaggctcaaacacatctttattagtcaaagtaggaaccattacaatcatcacatttttgtcaacgagaaataagtttgtttattcctgtagaataaaaatctgtgcttcgggattcgacgaactcttggaaagcattttctgcatcctgctagttgtggaagcgatttccctgcaaaaggttctggagatgcttgaagaagtggtagtcggttggcgagaggtcaggtgaatatggcagatgaggcaaaactatgtagcccaatttgttcaacttttgaagcattgtttgtgcaacgtgtcattgggcattgtcgtggacaagaattggaccctttctgttgaccaatgccggctgcaggaattgcagttttcgatgcctctcatcaatttgctgagcataatctttgaagtaatggcttcaccgggcttcagaaaactgcagtggatcagaccagcagcagaccaccaaacagtgaccacggcttttttaatgcaagtttggctttgggaagtgctttggagcttcttcttggtcgagccactgagatgcttgtcaccagttgtataaaatccacttttcgtcgcacgttacaatctgatcgagaaatggttcactgttgtgtagaatcagaaaatgacacttcaaaacaacatttttttttttttttactttcgctcagctcatgaggcacccacttatcaagttttttcacctttccaatttgcttcaaatgccgaacaaccgcagaatggtcaactttgagttcttcggcaacctcttgtgcagttgtaagagaatcagcttctatgatcactctcagctggtccttgtcaactttctttttttttttttaaaaaaattatactttaagttctagggtacatgagcacaacgtgcaggtttgttacacatgtatacacgtgccatgttggtgtgctgcacccattaactcgtcatttacattaggtatatctcctaatgctatccctccccactccccgcatcccacaacaggccctggtgtgtgatgtcccccttcctgtgtccaagtgttctcattgttcagttcccacctatgagtgagaacgtgcgatgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttcgacatttgggttggttccaagtctttgctattgtgaatagtgccgcagctttcaatggccggtcactatgctcctcatcttcaaggcccttgtctcctgtgcaaaatttcttgaaccaccactgcactggaccttcattagcagttcctgagccaaatgggttgttggtgttgtgagttgtctccactgctttacaatccattttcaacatcagtaagaaaattgctccaatttgctttttgtctaacatcatttccatcgtctgaaatacatataaaacaaacagcaaataataagtcattaccaaaaacaaaacgagaaatgcacattaaaatgatgtataacatatttcacacttaattcagaatgtattccaatatcaaatggcaaatttcaacaatgcaaacactgcaattacttttgcaccaacttaataattgaggcagtttaaacatagtaatttggtatgcagtttatttataatttttagtgatgagaatgttctcaaatattgatatttcagatttcaggtcaaatgttactttttcatggagacctcctgacttttcacaagccaccctcctgccccaccacctcctaaatgactgtcacccctattcctagcatacaacacctgataagttcctctacctccttatgcatgttctttgttgtatatccacagcttacaattatacattaatgcaatcatttgattgatctttatttcagccaggaaactgcaagctgtgtgaggccaatccccatttcatgaaattctcccttaactctcagcatttacagttcctgtattaattgcccattaattaaaattatctaaaaaatgaataataagagctttcccaaataagagagctaacaacgatttttgttttgttttgttttttgaaaataatttgatgatttacactatattacttgaaataatgtcttttagggatttcattgtctcttttaatggcataaaattaagtacaattcttatatataaacgcatatatcttgaataatctataatatatctatattaaatatattacattgtcttttttactagcagacatatttagttaaatgtagctagaaaatacaactggcttgtgaactgaagtttaactgaaaaaaaaaactatgtaaagatagcttcatattgaaaattatattgattgttatcaaggggaaaaaagtgagaatcctgtaaataaatccagttgagcaaatcatagaactgtttaaaatgaataaatcatagacaggaatgaaaataataaaaatactttctaaaataagtaattacttttctactttacagtatgatgttatttgcctgtagtattagaattattgctatttgggaagtttgggttctaaaaatcttaccaactggatttctagctttcgctttgtgaatggggttttatatgcagaaataatattttgacaactgtgtgtcagcaataatcacctgggattctgcctttatgaatcacagtccaaattctacttcataggctgaatagtcaatccaggaacatcaaatttttgacatatgtgatatgtgattcttggtcacttgaaatttttctgactaaactctattttaagtatgtcactttcacctattatgctgacctttcaaggaaggatgtctgattaaattagaaaaacatggcaaaatcttacaggcttttttttttttttttttttttttgaccctttccttgaaacaaaatgcactctgaaaaaaaaaagggaaaacgtggacaggtgctagaaatcagataagatagaatttattctagcgacttttaatttataaaaagtaaaatgttttcttggtgctttaaaaaaatagaagtgatttttctgttgctaacactatgtctctttatgaattgtgttctcttcatcaaaacagtgtttatgttttaggagattggattagaattttaaaaatatggcatgtactatatttcatttcttttactttgatgtaagcttagtgggatttaaaataaaggagacttgaaacataagtgcatgggttttatttcctccagctttactcatgaattcatttgtgctttataatccttacctaacatatattaactataaagttaaataaaaagctaagatgtagtcaaataattttcatttctattttgacagtttaaatatttcatatatttgctataatcattctttatttttttaaagtagatttaaaaatttcaaatagaagacaaaattctgcttctgctagtttctcatattgataacattttttctctaaaacaaataactttggcactaagctctgttttgttgtgcaacttcaaattagcatattttctggtcaaaaatgcacagttattaaaataaaagtgaccaaaaatatacatattataattttaaaagaatggctttcatattcaattcattatacattaaatgtgttgaaacatgcaaaatagtgtatggcagactgaataggtttgtgcattattaagaaatggcctattcctttaatattttataaagagtatattcagactaaacattatgttttcaagcttccaaatgttcttttgtatgaaggatataagaacaagatacataccctgatggaaaggagtttcaactgtttcattccattacgtgtaaaacaagaatttataaaaataattcacacaaaagctttgcttatttaaaatattgcctcctttatgaaaatttttaattatttggacccttaggcttattacactctggtgcttagtttcttttgaaagattaaaaaaagaaattaaatttagtctataaaaactatggtatagtatactttttacgtaagtcccatgtcccaaatgatagtcattgaacctaagaatgcttaatggctatgatgtatacaacataaaccaccttaagtatttctgcaaccttaatagctgtagattaccattactttttttcctacatatgatgctcactttattgagaaataattatgtgaataaaaatattaccaaagtaatgtatgagattccttgggagttgctaaaatcattcatctccattgcatgtgacataagaagaaaaatgtcaaaggggctgatacacttggatttttctgatatacttaaaatcatattattacacattatttttattaattttgttaataaggcagtttgatatacataaactaacagatcaaaattgttacctttaaacttgtatacagtagttgttagaaatgcaaaattctgggccccaatcatgacctgttgcattagaaaccctgaggatggggcccagcaataggatttttaataggctgtccatgggattctgatgctactcaagtttggggattgctgtgttagaagatcgttatctgatgtaatgaggcacacagtacttactaagatattcagctgctgcttgattcagggctgtagttcatctcaacctctaaatacagcactgtgtataattcatgattaatataactgttgatatttttaaaatattggattttacaataaacacacaggaagagaaaagacgcgtttccctggcaacttgggaaatctattcctggaaatttgtcataggaatttatttccaagtcatcaaatttatctcatgtattcttggaatttagtttgaaccacatgtagtatcttcaatatttacaaatacttgtacagtatttatatatctggaatccattgctcatgataaaagagatgatactaaaacccaaaaactaaataaacaatgaattaagtgataggaaaatgggaatacagaattggaaagtccctgtcatgcagttactagaatataaggttgtctgggaaatgactattaactgttcctagagtgttactaggatcagactgtgatgaattttgtgtgccaccctaaaatgctcacatcaatcaaagacaacattttaagcaggtgatcagggaggatagtgtaattgaagaacaaataggaatcagaaagggcactgtaaaagttcccattataggttaatgggacctagaatgagccttttattctttggttatatatcttgaggatttagcatcaagtagaacttttattattttgttaagactccaggaagggctattcttaaaaatcaaatcttcattattttcttttcttttatgttaatcagattatagtatttattataaaggcacaaaacaaagagaagtcatatgtggaaaactgagtaacttgtaggacctatagaggactcagtgaacatgaaaattatctagtaaactaaggaaagcaaaagaaacaaacaaaagagtgtgtgttgggggacagaaaagtactctcgcagtagaagttattatatttcccttctgtataacagtcaatattcttttgggcctaaggttaagaataagctaattttttaaaaaatgtaaatggctacctcccttctcaatgtaaagtgacaagaccaagaatccagcaatcggggagacagcctagcctattcaagaaaggagagatgcaatgcaatgttttaaaagaattttaaccattttggatggtctatacttggatactattccatgccatggaatcccaggaaaactgatagccgcacacttcataggtttactcaaaagtcttcaataggatttaaatcttgtgggtgatatgagtcaatttggtaaactgtgtttgtccagaaattccctgaataaatatgtaatctgtatccgtattgttggatggatgtactaggtagccatttcttaagttgaattagtaacacaattttgatggaaatttgcctatcctgagtgctgaaaaggcagcaaataagccataaaaatattatatgtagaatcttgtgaaaacgtttattgatagagctgcttccattttccattaaaggcagcaaaattttactttatttagagcagtaaaatatatttgaatgagtaatcaaattttagaggtggcagaagcggcagcgactatagaaatcatctagtgcaatactctaattagatagacaagcaattgaggctcaagtaggcttagtgacttgatgaaggtcacgtcattaccttctgggtctgggttcggtgctcttttcattcctcctctctgtggaggagtactggtctgtgcacagtgacaaagaaggatttaagattgtgtagtttaatattatcagattatactttatagaatttcaagactacttcaaccgagtgtcatgcattgcagcagcacccaagataatatccaaatctggagacacagcagacaaaatagagctacttttctcagcaggtgaaaaatgctgatctttcataagcccaagagaaaaatcaggttgtataggattattattagctttccattctcgtgaatgtgtatcccttcatcacaacttgatttatgatccagagactgagctgtcacttgacgactaaagattcttaactcattttctgacaagtagaaattgattttagcttgaattcaaagattaatctaaatctgcttgcattgaaagagtattttcaaatgttgctatgtaactaaaataaatatcacatagtttcaatttctgtataagccaattaatttttgaagatcttttaaaaattagtatatcattttcctacaactagtcttaaaacagaaggattggatatgttatcttctagccagtaaattctcaagatttaaaatatctctaaattgttggctttattttgtgctttctgaactgctaaaataatcactaaatacatgttgttcatatgtagctttcaaaataattggataatataaattagagtaacaagttagtccttcaacaatttttggagactaaaatataaaacagaacaaatgagctttataactcccaaaaaacctttgtggtgaaatttgctttagtgattatctcttggaaaataaacacttttattttctgaaataagtgattctgattcaaagaaaagtttaggagaggaaaacatttaggggaaggttaagtgtaatagcattatttcagaagtgaaaatatatgaggtaatattcgtttctagaacctatcaaattcttaatagtttatgtagcatacaaggggcttgtagaatctttagtacactgaaatttgttcactctgttatccaacaactgctttagctcctgctgtgtactaggtactattgttggcagtagagatgcaaacaatacaatagctaatatttctctaaagggctatatactattcctagtgctttcgatatatcatttcatttaattctcaccacaatcccatgaagttttacaagagagaacagtaaggcccaaagaatttaaataaatcgaacaaattcacaaatctagtaagtaaaaacatcaggaatggaaatcagacaatctgattcccataaaatgcacgtcaccactactttatactacatatggtaagagaagtaagctatttccaaggaaatcttaaagtttagtggaaaagaccaatacagagcctcatacattatgccaagggtttggcttccatcttaatgcaaaattgttatgaagtctgggaattaggatgtttactccatggacttagactagaggtgcagagatcagacggtctaccaaagtcatcagagaaagaggtctaacaagatatggaaaggaggtaatagatgccaggtgatttatgctatctgttctataagaaagggtgtcaactaggcagaaagggggtagagaaatcaaggataatttccatgatattgtgattgatgataactgatgcatgtcttggtttctcctagatcaatgtttcccaaactttagagtacatcagaaccatctgaaggataccacccttatagttatggattgccttgctaatggtgcttgtccaaagatcacactttaagaaccaatgtcctacattaatactaaggctttcgcctgcaaataaatttaaatggcttggtattatgaaagtttaaaggacagaacttcaatgaaactttaaaaagagatgtgatctgttatatatatatatatacacacatacgtctaggtgtgaatatatctatgtatacatctacacatatatctgcatctataacacatatcctaacatacccagtggtatcccatgtgctatttcaatatatgaaattgtttcatggcccctatattataaataatttctaaattgctggaaatttagaagataggaaatttttacacagattcctccaggcagttgaagaaatttatataatgtacttctagagttttagcagagtcaattatgggtattttggaggtagagtatatatagaagctaaaaataaaacttttttctaaatattaattttatattgtatgctatttgctatctaaaactgatagtttctaaaaataattataaaatatactcatgacatttggttgacaaaagggaggtaatcatgaaactttaaatagaattttaaacaataatagccttaggaaatgtctaccatatcactttttcccccaacgttcaatttccctttgaaaagcactgaaatgatagatacaacatttgtagaaattatgattcttaatagaaactttggtctatatttaccgcaatgtttaaatgggagaggagttattgtttaatctgttactagatcaggggctgttccataggaagtggctgtaaataaacagagcatgaaacctctcaaggcacttataagtaaatgagctaacttttgtggccataggcctgctttaaacataccaaaaaaaatctcatgagtattaacattgatttcatcccaaaatgtttacagcaaagtaaaaggatgttttaattgtttaattattggtctttattcaaaattgacataaactgttacttatattaacgtgcttttagagtacttcctcaggaaatagacacttttgaattgtcatcttagaagaataggatatctctcatcaaatactgtggccaaagtgcaccaaaaaaagaagatttttaaaatgtaaaagccatttatttaaattgtacatactttatttttattgttataatcattaggaatttcatggattgatttagaccagtgagccatcaaatctttcaatagcctcacgcagtagagatcccctttatgccttttcaaaaaagagcatggatccggcacaatgctaaatgaagattatgttcaaaaaattgaaatgactgaacagttaactagctgtaacatgtttaacaatagaatggggaaatcctcttttaaccttttagctaattattaaatatcttaatatgaaagaatctaaatattatttatagaatattctataaaatataactaatgaaaaaatgaaaaggttacctgtacaaaaggaactataacattatatttataaaatctttaagtccggaattctgcacgatacctacagagtttgggaaaaaaaattaaattgtttttaatgagactagatttctctttacttttctagtaatacttttgtgtttcttttggaatatacaatgtagctggtctataagcaataattcaaattaaatagaaagctgtcatgttaattaatataacccaatctgtactactaagtggcgttgaaagatcttgctttcacttgattctaggtgattaagaatcagtcattagtaatgtataagcactttttccctagatatttcagagtcaaaagaaagctagaaacaagtcttacccacaaggaccaagtatactagtgtgttttgtcttgttcttgcactagagctatcaaagtcaagaaagaatatggtctatagtggttggaaatttcattctagctgtcaattatttcatgtataatgcgggttttaaaaaaattctttttaaaataattttagatatacggaaaagttgcaaagatagtacagagttgccattctctccacctactttctcataatgttaaatcttacataactgtggtacactatcaaagctaagaatttatgtaggtacattactataagctacagactttattcagatttcactatattttccagttacttcctttttctgttccaggatccaatccagggtatcacattgcatttagtaggaaggaatttttttcttttctatttatagtcaataatatattttaccacatatcattttgtcatcagtttaactttttaaaattaataggtttatttttagagcagttttaagtttacagaatgattgaacagaaagtacagagagttcacatatattccccatttacccccacagtttcctccataattaacatcttgcattgctggggtatgttttttgaaaattgatgaaccaatattgatacattattttaacttaagtacgtagtctgcattagagttcactctgtgtattctacagttctgttggttttgccaaatgcataatacatattttcaccatttcaatatcatacagaatggtttaattgccctaaatatcccttatgctccacctactcattcctttcctcctcccactcatccatggcaaccacagatctttttgctgactgtcgttttccctgtcagaatgtcacttagtgatatgcatgtaagattcctgcacatcttttcacatatgatgctgttttgtgtttgctttgaccatctatgtatccttccagttctacacatgccattttgaattctgagtttacaaaagaagcctctgtccttgtgtgccttccattttgtacttattgaggtgtgcttctttttgaacttagttttcttttggaattattaatggtaacattacaacaaacctttcagtgcagtttactattagaaaatatctgcacatatgaacactttcatttcttttcatattatcacttgtaagatgacagtgtgcatttcttttacatttcttgttatttttacaataccatactattatttatttttgcttaaatggagtgctgaatactaggcttgctcctcgtttccaaacactctgtggttgtgttttgttttggtttgattctttttacagtaataacatatggcaattgtttatattttcaatgcccaaagctgattattaaactttgggtgtttaataagagttgaggaaaaaagtccagaataggcataatttaccaattgaaatataccagtttattgacctactttagttgaactgtttgaaataaattaagaaataacaatcatatcgttcttatagtatcaatagtaagcattgaataaaaccactggatttgatcgatgatttaacagggtaaaaataaaattgaatttaccctcataaaataagacaagttctttttcctttccaggaagaaaagaattcatcctctaaacaaaattttgttttcttgatagaggaggggagacagggacagggattaaaaagttgatattcttttgcctacctgagtcattgttctcaaaactttgctgctaatgaattactttattttctataattcaaacaagttagaaacattctattttagttgtgtgtattacatatattcacaaacagacacacacacacacacataatagtgtatttacctttatatagagattcttcaaggaaatatacaaaaatatttaaaataatatccatcatatcaacttcttaataaaactactgtgtgaacatactcaatttccagatatgtatatacacatatattatttgagctaaatcaattcttagcacagttatttaaagcaatatagaatgatcttcataatatagctctttgaaagatcttatcttgcaatcttttctttataaatttgtctgaatttataacattcaatagcttatatccttccattcttttcactaagttgatttaaatgagtcaaattttttaaaatctgctttttctatattgtctatttcaaataatgtattaaatatccacttagtcacctaatgtagagacctttgagtcaattcttatttgttgttttatttttattcatattcagtatttatcgtttcctgaggaatttttttttctcaagtgtgtctagaatcgatttctcactctccatttcactgttgctttatttccttcagtcaaacaatatcatcaaagaagacaccactgtgtaataatatctttggctttaaaataagttgcataatttagttaaaaaagaaaaattaacatcaaaataataaaaaaatgagatgtagtgttaaaaatgaatagatgctaattttggaaaggaaatccttacagtagttctcacttacatgtgattttgatttctgtgctttcagttaccagaagtcaacagaggtctgaaaacattacatggaaaattctagaaatagttcataagttttgaattgcccactgctctgagtagtatgatgaaatctctctctgtcctgctccatcccactcagggcatgaatcatccctttctccagggtatcctccatgtatacacaggaccagcccattagtcacttagtagctgtcccagctatcagactaactgctgcagtttcacatggcttgtgttcaaataaaccttatttaacttaataatcccccaaagtgcatgagtaatgatgctgccaattcagataggccaaaaaaaagtcataaagtatttctctaatgacaactgatgatgagcttttattcatatatttgttggctgcataaagtcttcttttgagaagtgtctgttcatatcctttgccaacttttttgatgggtggtttgtatttttcttgtaaatttgtttaacttccttgtagattctggatattagacctttgtcagataggtagattgcaaaaattttctcccattctgtaggttgcctgttcactctgatgatagtttcttttgctgtacagaagctctttagttcaattagatcccatttttcaattttggcttttgttgcaattgcttttggtgttttagtcatgaagtctttgcccatgcctatgtcctgaatggtattgcctaggttttcttctagggtttttatagttttaggttttacatttaagtctttagttcatcttgagttaatttttgtacaaggtataaggaaggggcctagtttctgttttatgcatatggctagccagttttcccaacaacacacatatgtttattgcagcactatttacaatagaaaaacttggaaccaacccaaatgtccatcaatgatagactggataaggaaaatgtggtatatatacacaatggaataccatgcagccatagaaaaaatgagtccatgtcctttgcagggacacagataaagctggaaacgatcatcctcagcaaactaacacaggaacaaaaaaccaaacaccacatgttatcattcataagtgggagctgaataatgagaacacatgaacacaggaaggggaacatcacataccagggcctgtcgggggtgggggtaagggaaggcagagcattaggatgaatacctaatgcatgcggggcttaaaacctagatgatgggttgataggtacatcaaactgccatggcacatatatacctatgtaacaaacctgcacgttctgcacatgtatcccagaacgtaaaggaaaaaaaagccacagagtgcttttctaaatgtaaggtttctaagaaaagaaaaaatcttacaataaagttgctaagatgtatggtaagaataaatcttctatccatataattgtgaagaagaaaaaggaaatttgtgctaattttgctttggcacctcacactgcaaaagttacagccacagtgtgtgataagtgctcagttaagatgaaaacaacattaaatttgcagacacgaacagaatcgtgtttcaattgaccgcaatcagttcaatactgtctaggatttcaggcatccactgggggttttgtaatgtaccccctagaaaaagggcagaatactgtatttacatttaacctgacctcaggaataattcctcacccctgaggaattttggtctagaagtataatatagggcatcaaaagatgctagtatgaaggtggaaataatgactactaacaattgagaaaacaaaatgactcatatattagtgcaaaataaattcagtaaaaatcagtcagttctttgacagtagcatggagtagctggtcaaaaaggaggaaaaccagaatggaaaagtctgtatgttttgcctatggaatattaaggaaaaataatggatcgtgcattaggctaggagagtaaaacaccatgagaaagaaaaaggcatttgggtgtaatgatgttatattctagaagtatacaatgtctagaatgtacaaagatttttagggaaaaaatgcatgaacttgtgtgttgattaaatgcaaatatcagtcagtaacacacacatgtgctctctgtgtgtgggcatttgtgcatgtgtgtctgtgtttttaaaatgtattattggaaaactaaaatatttattaaaatgaaaacactaacatataaggcacttaataccagggtcattattactgagaataagagtctattcaagtacctgtttttaaagtatctaaaagataatggagagtagagtttatgaatttactgttttactggaaagagtctcttcttgggtttaaaaattttaccaattaagcagagaagacaagaagcattaagcaaatttatttaaaagcaaacaaaaggaatttatgaataaattaagattttatgacaatatcaaaagttatacaaaatgtttgtgtctttcatgaaacagacatccaaactgaaattaaatttagttttctctaggttttttcttcttaaagattgaaaagttatcagggaaaattgtgcttttaaactttgtgatgacatatgcttttaaggagcctgtataactttcagaataataaaacaaaaatggctattttagaatattccttgatgatgaattaatcttacattgttttccagcatacccatcttaggaaagttctgtttatcatgtcacttatagaaacaactggtgaatgcatctgaattattttcaattcctgtcacttgcatgtcaacttgcaccatcttccgccattcctaagttaggtatttgcaaatagaaaatagacattattgtttatttggagtcataattataaacatataacatattattatttcattggagtcatatatataataaactaattgtgaaaaatagacatcaggaacctgagaataccgagtcagagaaagctagaatgccataatgcaaattttgaagccagcgcataccaatcagagattatagttcttcaaaagagacagaaaaatgggagcatggtttttccattgaaacagaagatactattgcctaaacaatcataaaatattatatggttcaaaggattttatagagtgctggtttctacctgaaaccagatatgtctgacatggttgtatgcacgtctgctttgaaaaatattttcttagtctataaatatttaccaaaagcaatctatttactgaagcggtaccagacattttggaaagtattactttgaggatggaacaaccactattttataatctcagtcatcttttgggtttccttttctgaaatagaaaaccattgaaataagacacataggagtggtatgtcatccatcagacactagtatgtgttcttcccttcaagtgcttggtgtatattaaaaactgcccacattaaatgcatagaataatctttttttattattattatactttaagttttagggtacatgtgcacaacatgcaggtttgttacatatgtatacatgtgccatgttgtgtgctgcacccattaactcatcatttaacattaggtatatttcctaatgctatccctccccctcccccctccccacaacaggccccagtgtgtgatgttccccttcctgtgtccatgtgttctcattgttcaattcggcattacaaaattcctgtggaaaatatgagttgtgggtatttatctttataatatttaaaaagttataagaaactaaaattaagattctttaaaagcaaaaagaattcactggtgtgtgactatgtgataaacaatggaggggtgattgatattaattaataagaaagtttaggtcaaatattctgctctcatctcagctgttataataaacaaattaaatatttagtgagagtttgcaagtaaaagcaccgaaatatatttctgtgtacaagtaccagcttgttctcaggtaccactaaaatctacccttaagcagtagttgtttcaaaggtcctgtggttgtacatccatttccttgtatctctggctctctttttagtgacaatttggatgggaaagtatatgattcttaacggatattgatttcatgctaatgacttcatgattaattatttaagcatctaataagtcaaattatgttaaatcacaccacagacattgcagatatgaaagtctaagtggtagccaacaatttcagattttcatggggtatattttgtcagatgaacaaataattcaaattttaagctagaagtaaagtcaacatggtctttaggaaattcagacaataaaatttgatacatattcccaagatatatgtaacttttatttatatgttttttgtatagttggataataatgtgcattcgttattggaaaaaaagataaatttaaaaggctaaaacagatatcaatagagggtacccatgcacctcatttgggagaccttctagagtaggtaatagctaatatccttcattttatgaccaatagtgatttctagaatttaaaaattcatataacttccccagatgcacatatacatattattgagaaaactccaaaatgttgaaaatggatccatattctatgttactgaaatgtttaccagatatcaatttgaatcttatgtgtattcagtttttccatagcattaattccttacgtcatatatcaccaaaatgacggactgtttcaagtagaccagaatatcatttgtacctttagaacacttgtaatttgacatttttagtatagaatttactgcttagaaattacagcctggtatggtgactcatgcctgtattcctagctactcaggaggctgatgcaggaggatcacttgaccccaggagttagaggctgcagtgagctatggatcatgccactgcactccagcctgggtgacagagtgagaacctgtctataaaaaagaagacaatacagacaagttctaacaccttttcttatttacgcttaacagtagaccctgtagaagaagtctgatcttttaagtctgataataagagatatattatgaaaaagataaaaattatacaggaaaaggaacaactgatgatgcataaaagcagcagaggtatatctaattatcatacctaaaatatgtgccgtcgaaagccatgtgtgtctaatagtctactctcaaatccattatctttactagaagaaacccgatttttattcagacattcagagaatgtttcatatatttacttcactggacttctaagataccattatactggcattctactcagctaaaggagtacatttcccagcttctatcaaattgaagtgtgtctgcatgaaagagttttaactgaagggacataagtaggggtgtgggacttctacaaagatgctgtacaggaaatctggcatttgggtagtgactggcactacagaagccagtcacttggggacattagaatgagagctatgacttagggtcagcatagtgaggagcaggaagaggcagctcactggtgctttgcgggagatgccacagcacgtgccagctgcctatttcagtactgtttatacaagaaaattagacttgtgtatgactgaagattttctaggttcaatcattggagcataattccaaactaatatacaaacaatatattattttaggaaaaattaacataaatcaaacatggatatgtgtataaacgcacaaattctccattctctacatgagcataatagaaataatagaaataaaataaaagcatagaatttaaatattaatatcaaaacatccaaatccattttgtggtctggcatgacctgaagctcaagtaagaaaacttttctccaaattctgtttgcaatgatccacttacctttactcttagaaatagtgagaggcctttacagaaggctgcagaatagctttttgttttttaaattacagattttccacatttaaattttaatattgtttggtagaaatgtttgttttaatgaagacttctgccttaccttgagattattcagtgcatatgtttatgttatctcaaatatttggacgcatattttaattcatttttctgtggatcacgaaggtactcatcaacattatggtgtccttattaatttatatccatgtgttctcttctttacctgattaaaattccaaattctatctctaactcaacaaatgatcagagggaatacaacatacataagtcacctatacattagaattaacataatactctcagttgtgttctggtaaacctaaaacgacctcctcatgctgttccttattatgattaaacactctcagaaactgcacaggccttctctttccacccacaacctcctttcacatatggaagttttaacttagggtcaagaccattcaagatgtctaggtgattttactcatctgttgttatgagtaattctcaggacctaaaacgttcatactgttaaactttttagggaggactaatggaatacatactattatatattttttaaaatgctggaattcacatcattattctttcacttatagtttcaacctccagaaacttaattatactttttaaaaagaacgtgcttacattttccatccagtcaatgttttttacagagtcaaaatatactagggtaaaaagtaaaaaccatctttgaggttataggaatatatttaacaaaaatgactgtgaaaaatcacaaaggaattgttaatatgtttctaaatgaacgaagaaatgtaggcattatatgtggtgaggaaagtttgaaaagattcattacaaactagcaactaaattccagaattttgataattagtttggtaaatttagaaaaatcacccaaggctcagtttgtagtatttatctgtaaaactgtctaattattttttgtctactatttcataaatatcatgtgtgtatttataagctattataggttgatggatataaaacctaaacatagattgctacaataaagcatatttaaataagcaccactgtaataagcactatgctataagttaattactaaatgggctatgtatgcaataaaagccacagatgtttggaaaatgaagagttccattgtgaattgacatgggtaaaggaaaaggcacttaaatctagaatttcagcttcatcttgaagcaggtaaatgagtcagagagaagatgagaatgtttcatatatttacttcacttaagatactatgctctcctgctttaattttttcacacttgcgggtccttcttcattgactttgctgttgcctctttattttcagccttctgcaaaatgtagattcatatatccaacttccttattaatatctccatttctgagatattaaaaggaaaaaagttgttttcctctttttctttgagcccacccccaaaacatatttctcctgcagtcttcctcatccatggccacttcttccttccaggtatcaggccaaaatctctggagtccactttgattattttccttctctcacatttcacttgcagtggtggcaattcttgttgactttactttcaaaacatatcagaaatataaccatttcttacccaccagcaatgctacctttctgaccaagccaccaccatcttttacctattttttgttaaatccaggctccctgcccctgcatgtgtcctattatagttacactctgtgttcatcatagaatgatcctgaatctacttatctcactcctttgctgatgatcctctaaggttttcccatcacattcagaataaaagccaaagtcctcagaatgacctgcaaggctcatcatgatttgtcccccagtgacatctgtgacctgctcctctctccttccttacactgttccatccttgctagtgtccacggtgtctatgaacaagtcaggtctgcttttatctctgagcttcagcacttattcttcccacttcctgcaaatggttcccctttgtcctgaagccatgaggccccccgacatttatttctgttctcttcaaatattgacctctcgttgtggcttgccttgatcactctattttaaattgcatttactgtttttattttctccataacaattatcatcttctaatattctccttagtgcatttacttgttactgttattatttatatcccctttccttttgagcaggagaacaggaaagttttgggcttccttgttttttgggtttttgtttgtttttttttttttttatttttatttctcattctttggacgcataaaaaggtgagcactcaatagatatctgttaaatgcatgaataagttaatgaattaataaatgtaggaaagtgtcatttctccatgattttttttcagaaaaagttatgagtatcaatggactgtgtggtgcttatatactgctaattatgtataaatgaagtgcagcaaaacatagtctcataataatttcaaaaatactgattttggacctagcttttaagatttatttatttaatgaacagctatactgaacaatattttaaattgtttgattgaactaggattaattatataaatcatgtgaaaaatttcaatcatttggcagccattttgtaaacaactcactctatcattttgtaattggtagattgctcaaatgttggaacagtgtaacacaaagttttcagattcaaatagatcatgattttaaaaggttggaactttaaaaaaaacaggattttatttgagacattaggcaattatccatatatttcatctaaagacaaatgtaacacacagccaacttcctttaagccacattaaagcatctaagaacatatatatataaaatatatattatataattataattatataatatttataattatcattgctccactattataaccattagaaacataattctgtttaaaagtttcaaactttttaaaattttttcaaagaataagtgtagttaaattttcttgaagtttattcaaactgacagctattaagcacttactgtgtatatgtctgatagtgctgtacattaaatatagaaagatgaatatatgtcataatccccaggatgaaggcattatggagttaatagactcagaagtgtatgtaaaatcaatacataatgagaactattctaaaatatgaataatgatcttgtacattttttatctgtaatagcttaggtactatttctttatttgttaactatggttccagcctatctgcgtcatttaaaacaaacttctcaaacttcaagaaacatataaaataccctttttctagttatattaataagactatcaagtagcatttagtgggtgtataccttgtgccaagcactagtgacaatatgtactgtttcatttaatcttcccaaaagtccattgacatttcaagcatagtattaaccagacaatgctcatatagataaaagagtaaacaaagtttgtaagaaagatttcagattagattaccttacaattgcaatccattttgattttcatggtggctttttgattgttcatggaatttctgaataagaaaatacattttcacaatgccaggctttacaaatatcatttataaaagctaaaaagtaaagcaaaataactactgttttacaattacgttttaataatgttaacttaaaacttaaaaataaaaccacttctcatataccagtttgtggaggattgagttcccttgagagagtgaaaatatggtcttagtgatttcttttatgagattaccctttctcatctttgaaaacattgaacagattcatgctttatacagtatgtagttgaacgttgggaaccaagtcgtactgcagtggtaggagtaattacagctgtcagttctttcaacatgagaaaacaaccttgtttcaactttacaagaaacagattgtaagtatccaaaggaaaagaaataacagtctttatgtgatgaacagtgtggtgattgttaaactagtaaactcggccatttggagcgatgtatttactggaggccgttgggaagaagatactgtttacgtgcaagtttgagagtgttttatgaatgaacaaacaaaaacatgagcactaagtatctcatcaggaagattataatgactggtggacttttcagagtagagacattgtgtctaaagaaacttgtcttaactgctttcatgtgagttttgtttttgtgtgaaagcacttcctttgtatctgggtgttcctcacatctggtttatttggatgttagaaatccaggacttccttatactaaacaagaagagagcagatttaaaattggaaaaacttgaaaacacattataaaatgaggagcaagtgctcttatttttaactgctctgcaataaattgtttattttttaagctatttgtttaacatgtgcttcttctcttaatctgtgtggagggggttatttggtgtgcttttggcaaaattcagtctaagtgccaaaatcagatgacagggaaactgacagaaaagcaaatccattgtttttattccactgttaggtaaaacttaaggtcctggtttcaagcgtttgccattttttttctttactttgtgaaaatgtttacttcttaggtaaaaagaagaatgatattagttagcaaattaaccaaaaaagttagtgtgcaaaagctaaaagatgtttttaatgctaaacagagcaggaacattttatttaaaaaaacgagaccatgaaagtgctaaatatataagaatataagattctgatgacttttggtggcatcactttcctttatctttacatattcactcatgtccactacacattttattttttttttggaaaaaaaaatgtaactaagggcagccagatggcctaggacagaaaacaggacacctctccttgcctggacagatttcaagattgacactgcatcagtgcacaaatgaatccggataatgtggcagaaacaaggtgtctgcctcttaatatgtagcatgcaaaagctgaaggaataaaataaactttcactgacagttctggtttgcagatatataagaatgaaattgtgatgaagtgaaggtttgtactgggaaagaagccaggatgctatggtagtgcgatccagtgttccactcttggccaaccaaattctgctcttttatgatcgaaccacttattctcaagttctgctttagaaaaagcaagattaatgtggaagtcttcattaaaattcaattgccagatattccttaatgcaactttaatataattttctaggatcgccaaatttaaacaaattctatttgacctttattaacaggcaccccttctcatacttcagctgttatccataacacctgtagcaaattcctatggtgttctttcacaaaaccagatctcttgcaaagttgatgaaaaacgaagaggaacaaggagcatagaatatcatatttcttttaggtgtttctcctgatttcctttgggtcctggaacatgtgcttaagtttacagttatctaaataaccctgctgctccaagcagatgactgttgtaaaggggtaaccttgcggggataaaaccagggcaggggaacccagaagcagagatgaaactctctgcgggctgatgatgtatgtatattgatttcacaattgtcctacaggtactaattccaggaagttgcttctacatgtctctggggatgcagcagtaagtaaaagagaacaaatcatccttggcagtagggtagatagaaaataaccaacactaatatatacagtgtaggtagtaacactcgctatgaagaaaaagaaaaaaaaaaagggaaagaagtcaggggaaagagagagttaatgggcagggctgaaattttaaatagaatcaacagagaaaaccctgagaaagtgagataaatgcctaaagtttgtgaggtcttttctgtccacctcagttgaaagagcctaccattgcttgtttgtgtttttaacagatacttcagtagttctatgtataccattgcttcacaaatattaattcatttgaatctacaagataacacaatgggacacattctattataattttgtagatgaaaacaaaactacaatgaaaataagtaaattatccaaggttgcacaaccagttaatgttgaagataagatttaaacctaaacagcttgactccagaatgttctaaaccatttttagatgcgtctttaaaagtagatttatttctgtggattctaccacttcattgaggattgcctttaatgttcatggtagacagtatgtggtttttcattaggtgacattgtctcttacttctcaattaaggtatacttataaattcttggggctttcttttacactgtctattaaaaggaatgaaagaatatgcaaagtattggttggctatttagtctggtcaagaattcctaaatttgtttatcagaaaacaatgtattattacaaaaaatgttaaagatgttaagcaagataaaataaatgtacaggatgctccttattatgtctgcttttcccagattcataataaatgaacacattaatattttatagatttgagaagtcctctttcaaagagacaagatttgcttttgtatatcccgttgcttctcaaacatattttacagtgggcctcttcttctcagcaacaactgcaacattcaaaggaccccaatgtgctaaggagcattcttaataaacagtgccaaaagagtactggatcaagctgtcttccaaatttggaattagttctatttgaaaggagtggaaacttggtaggcaaatacatatgaaaaaatacatatatttgcccttaattttgttaaagaaaaaattcctatgcatgtatttggggaagaagaaaagaaataactacttttttttgttatagtcctaaataatacatcactgtagggcaagggcaatatattataaatagcctcacccacatttccttaagcatatgtgcattatttacctaattcattaatatattagttcattttgtactaatatgtctggcatattttcaaatgtttctaatgtgattttactgattcattaagtcaatatttatcaaatatctactaggcattttgataatcaaagattttatttttagcatcatttctatagccctgattattttacacaaaactgaagttccttttaccaaaatcagatgcatgttttatgaatcagagctcttagttgtaagcattggaaacctgctgaagctgatttagtcagaaaataaatttactgaaaagagtattactaacccagctcagaaagtggctagatacaagttagggagggtacagtaaggaccacagcaagcaccaccaaaatccactagtgaagtccctgtaattaccaccaccgttagtccctggctatggtctcattgacaccacgacaaggctgtcaattgaagtcagatggcattgccaaagctgctgccaaaataataaattctccactgcctctcactcccattacagagttctgggcaggaatagtcaatgaaaccaattggaactacagaaaataagtgaggtgtatttgatgattgtgtatctaaatataggaaagtggctcattttcttggaatccaaagcggataaatatcttcatgacccccaacattaattactattagtgctataattttcatcatttttattattacattgtagtatatagaagtactcactgtaatgaaacatcttagcttcacacggtgatttatgagattgtgttgaggtataaaggagattaattaagaaaactctaaacaccaactaggctttatatgggctatgagttccttccttctttgcttccttccttccttcctcccttccttccttcttttccttcttcctatttttgtattttttaactttttcttcaaaaataaaagaaaaattatactagatttggaaatatgactaaatactacaataacccgacactctaagaccgttatcctaaagcagtataccaaagagtttgaataagaaatgatggtaatcaatttccttacattccgttaggagaaggaagtttgcaaatgctgtaaatgaacataatatataatatattagaaatcaataatgtttggaacaatcagaatggatctcacatttcttctgggggtaacagacaacaaacatataataaatacataaactgtatgctatgttaaagtttgaaaagggatatgaaaagatagaaaaagcagtgtagcatatcttgttagtgtctgtttcttacagaaaatgatggtaatatttagattgttttccttaggttgtttggagaataaaatgagacttcatgtgaaggccctctgaaaagttgttatgattacaaaattgtcaatattcttaagtaaataattataaataactgttcataagtaaataaagctttatattccacaagtcagagaaaagtaatattagattttgtgtgtgtgtgtgtgtgtgtgtgtgtgtgtgtgtgtgtgtgcgcgcattctttttctgtgtgtatttctttcaccaaagtttggatcatgttgtacagcaaacttgtatctttttaattgtcagccctaaagattcaaccctaaagctttcttcaatattgtcacaaacttggtatatctctttggcaactgctttccagacttttaataggaaatccatcagcaaaattttcactttttatagtctcctcagcttacaaagttgctactgtctcaaacctcaaatatttctacattaaaaacattttttaactacctatttcagagtggttctccaattttttggtctcaggattgtactctaagaaattattgaggttttgcttatgttggttatgtgtgtaaatatttaccctaatggaaattaaactgggaaatttaacgaaattattaatgcatttaaaaattagcagtaagtccactagaaggatgttaccatctgagtgatgatctcatctcacatcacgcagcttctaaaaatctccaccaaactctggtaagacaattagagtgaaaaagacaaacattactgtactgttactatgaaaatcattttgatttccctggatcacactttaaggaccatgccatattagaaactagaataaaaaaggaaaatgtttgaatgggtaacacattcacatggttacaatttcaaaaattatagaagaaatatagtgaagtctctctccacctctgccagtaagtcattgtttctcctctctcaaagccattaatagtattagttatgtggttatatgtatacaaaaattgtgtaatgtttacatagtataaatataacacctgcttttatacaaattgaatctttcaattatgtcttatagcttactttttttgaaatctaacaatgtatcttggagatctttcatataaagagcttccttgttctttatttttatgtttgcatagtattacagagtatggatataccatgatttatttaattagtttttttactgacgggcagtcattcattttatatatacatataaaacaaaaacagtggctgtaatgagtaaccttgtgtgaatatcctataatttttattattttaaatctgactttgtctaggcacagtgatttatgcctgtaatcccagtatttcaggaggccaaggtggatgagttgtttatcccaggagttcaataccagcctgggcagcatggtgaaaccctgtctctatgaaaagatataaaacattagctggatatggtagcatgcctgtagtctcagctacctgagaggctgaggtgggaggatcacctgaacctgggaggtagaggctgcagtgagccatgattgcaccactgcactccagcctgggtgatgggagtgagactctgtctcaaaataataataataataatagtaataataataaataataataaataataaacctctcttgcttagtgagccttcttatccaagtgaggtaattcacttaaaacacaagtaagagatttacacaggaactgggaattagatgaacacataattatcctcagagcaggaatgcttgaggctgaaaaggggtattacttaaaattaaaattggggataacatgtagaaagtaagacaatcctggacatattaggtaatttggtgtcctggaaatcatgcattttagaaatgaggaaagcaggagtaaatacaggaacatgccatactccaaataaattagatcagaagaaataaagtaccttattaattaataatgtccaaataatctatttcagccattgtgaatgatgatgttagttttatgcaaaagcaaatgcaatgacctagcagaatttgttctttgaggatctgatttctgctcattttctaaaatgttccttcactcagtattgttctcttccttcctctcttgcccagaaatcacttgtccaacctctctccttctcctcaattgtagtttgggttcccctgaaatcagactgtaggaaggcattttgtatgctgaatgtttagaaaggagtgcctttgggattcaaacctgtggaaaggaaagaaaggaagcaggaatggacagaaggtgaagtgaagctgtgatctagacctaccaagggttttagcccaaccctgcatgctggaactgagaggggcttttagaaagatcttgaattgggctgagattgcaaggcctttttattcctgcaaaatcactggatgtgccacccttgggaaggacctgaactctaggacggccactccatgcagcaaagacaatatctgaaagggttgaaagctgcagggtgtctgctgacagcatcccagcagccggggctgcagtccttcaatgaagaggtattcaggtggcaaattgcagtgtcagcctcttgtatcaacatagtcgcacaacaaacatgattcatactaagatataaatgattaaagtttatatttaccaggatatttcattttagcatgagcaaaataaatgagccaaattacaggagtgattatagctttaggatcattcacacctaaacttgaaccctgccattgcctcttattcactgtaagcttcagtttcttcttctataatatagggatgatgatacctattttggaggatagtgtacagattagaggttatattttaagtaaaggacttaagcgcctagtacatagtgagcatttagcaatgatgacttatttttaatgagtaatcataaaattgatattaacttgattaacttttagtttgatactaaatactttgctatgattttgaggggtcgggggagaagggaacaataaggaaataagaaagctttcccagaacatctcatttatgttgctgctgatgctttatactaacctttttatcatattttttaatattattgattttattacattataatagcaatacctcatattcatatgatataaaaataatgtgtagatgttttgtgagttcccttaatatccaatgtatacttctattgaaatgtgggaatgaaactttgtaaataaactaaatgaatactagttgtgagtatcttaactacacacctgggaaatcgaggactcttgtccgatttcccaatcagacaagattgtgagctgtgggtctctgctgtagctgggtggcaggtataaatggaacactcctgaacaaatcagaattaattgccaagagaacctacagtgttactttcaaaggatgatggtatggggaaggaagagacacaaaaacccattctaaagtgactgttttctctttgaggtcaataaaactggtctggtggtttatccaggtgaataagaggctgattaaggaatgagatctttaaatctgattgtgcctagtttttttgtatagagaagtcaatagttaggagcaacaaaccagagtaccaaataatattaccatattattttcaagggaatagaaacatctcaaattaatccagtgatgattttgaattcttcagacagaggtagcgtttcagacataaaggagtagagaagactaattgatttagcagcgcatggatctaccaggtagcctagacaaggaatgtccaatcttttgtctcccctgggtcaaattagaagaagaataattgtctttgcgccacatataaaatacactgacactaacaatagctaatgagcttaaaaaataatcaccaaaaaacttataatgttttaagaaaatgtacggatttgtgttgagccacattcaaagccatcctgggccgcatgcggcccactggctgtgggttgaacaagcttggcctagacacgcccccctaaaaaatccaacaaacctttgcagagtgtatgctattgctgggattaactggaaatctttcttggaagacatttttcagacctgtgtcacacctgacatctgaattttcccattcacagcttctcttgccctttggatctgcttccacccagacttgctgtagggtaaatcccactagtttttctgtcttcctctgaacttactagaaatcttccagcacaaaattctagatgccttcatgatccttttcttttatggagaaaaaagattaagtaggccaaggaaaggatctccagattattcaatgaaagtatatgcttttctgcccatttactctctagagagcatacaattagtgttaatagaatgtgtgctggtaggataatgccccagaacaccctgcagaatagtcacagtatatctcagggactagaagagagtgtttaataaatgaaattatctgataatactacatttaaaatggaggtgtatttacacaactacacagagacaacttgtagtactactcaaacaaacaaacaaaaatctttcaatgcagcattgctgagtcagggttttcatatccttatacttcagaaactgtttcttatttggcttttaaagattgcaggtccttcttagagtctttctgtcacctctgattttaatcagtgagggattaggaacataaaacagattaatacaggagacattttgtaagtgattctaatgcaacaacattctagacaatcccactgggatccatgggaaaattcaacctcatttcttttgtagctacaattgaaactctgggaaagctgaatgagaacacaaagaactttcacttaaaataagacaaattgccaatgcttaactaatcctcaaaagcagatcttcctaagaattaaaacgaaatgtcatagtatgtaatccacccaacatatattatctgtatataaaacattcttgaaagaaattatacttttcgtaataattatttttaataaatgcaatgcaatgcaaatatatttcaaattggttcaatcattccatccccaatgctatcaccatagaacagaccatctcttaactgttctaatgcatggattaaaaacttctgtgctcttctgtgcctttcctctttccatctccatattgtagtcaaaatgatccattcaaaaatgcaagtcttatgttaattctctgcttaatttttaatgttattaccttcaaaaaaatgtgttacttttgtattctccttttgaatccttgatccaaatatcttgcatctttacatactcatcttctgaaataaaagaagacatcagcttttgtgcaacaaaatcctgactcctttccaaggctgttcaggccttgaatgataaaggcccctgccgttctggaacttggtcatgctgtggctacactggccaacaatcagctcctcagaaacaccaaatacccattcagggcttttgttcctgtgttttcattttcccagaacacttttccctggctcttcaagcgccgttcaccctatggtttgttttagatgctatcatcatctttgttttacagatgatgaaactaaagccagagaggttaagtaatttgctcaaatgctcattaatagcaaatgagtggcaggattaaaaccccggtgatctaactccagattcccggctcttcactgcatgagatctctgtcttagcacccttcaggtctggttctcagcctaaacgtccgggtagttttccctgttccaccgtctaaagtaggtttaagaaccaccttcatcttctcattcttcgtttatcttcttcttcatataatttatcaaaatttgtaattatttattatggtagttgttcagctttttaaattgtacactaaattatgaggtttctgtgggcaagaccaaaatatgcccagcacatatactatcttttgaacagaagcactcactctacacatttttgcttgaaataactaaaacacatggagaggaagggtagttattggatgcctgtaacttttgaaaatgatataaagtctttaaattataataattgtttttttctgattttttactctgataaccatgttacaagattctatttcattcaaacgtataaaaacaacaccaaccataaaaacagttctttgaaacaatgaagacaaatcaattatcttctatccttagcatttctccctttctctcccaaattcacctgcttcctctgatttgctctccttttttcttttgcttcttggaattatttgcatataattagtttccaacacagtgacatatcagaaatgtcgtactctcagaatattttagaatgaggtctagggagaacctaaacaaaatgcacccttttattaaattgacctgacaatattaagggggtgcttttgaatggataattctttgaaagcatcagttaacaaacagcacaaaaacacaagcacagcaacccagcaagtatgatgtattatttaagaaggggttgagtggggtctttatctgacaagtcacaggcagaaaacacattcctgcaaattgccccatttctcctcaaaatgtgtctgaggtgaaatggagcatcctttgtttcgtacaaagaaaataactcaggaaaatgacagtttagtgatacatatcctcatggtctaaaagtcaatgacctggaaaaaaaatgatgaaaactaatttgttttaatggacagatagtattgtatatttttatcatgtacaacataatgttttgaagcatatatacattgtgaaacagttaactagctaatagatgcattacatcacagagtttttattttgtgataaaagtacataacattcactctgtttacattttttcaaatataaaatacatatacttggaaattcaaaggacatataatttaaaatatcacatttatattctctttaatattttctattctttcaataagaagataaagcataactacaagatttagcatgggtaggggtagggggagaaatgagaaaatgaagtagggagaaaagctatttctctcccctatgtggggagaaataacattacaaaaaagaaatagaagctaaaatgcatcatcttcaattgtgtgttatactaactccatagtttgaagtttgtgcttattagaaatcctgacatctgtgaatttaaggtagttgtctctgtttttgtcttaaatgaaagtcaaagttgaatacactgaactttctgaggagcagcagaatttcaagggttccttcctttagaaattatagggagtatctgaggactaacttgatactggagaaatatttgcacattgctaaaacctgttattctcttttcaactggagcaagatagaattcccacagctaggtcattactatactttgactcctaaactctcatgtttatactgtgtctacatatttgagaattgcaaaaggtgggaacaacactttcttcactgatttctattatttattatatacacatatatacacacacacaaatatacatacatatatgtacatatatttttaaacaaaattatgattagcattttatttgaagagtgcaaagtacctaaaagtcactaagacaaaggtttgaagttgacactggataaaaagacaaccttgaaataattttaaagtttgcaattaacacagatcacagtgtggcaagtaaaagttttaatagcagactggcccaggccttgaggtaaattatgcataattattcataactgctatttttggcttgcctgatttgtcctagacctctggctgaggaaacaatttgaaataattagtgtactagtgcattgacaatgatgaatgaattgaatacttcttgtgccaaacatagatcttgataggaagcagataactttgacaactgtggtattttgttattagatctctgaaagtggaaagtttatgttattttttgtgattttttatagggtgtttcataagtcattctctaatgtcctcaatcattaatgaggctgtgattaaaaacaaaccaaaaaaaatttaaaaacagcattgatgtttatttataccaaatttttacatgtttaatgttaagagtttaaactatgatattctaaaaataacttcatggtaattaagagacttcctttcaattttaatttcatgactaaattagagtttagtatattatatcaaaactatatttaagaaaaataatacagataattaaacacaatgcttcttgaaatagagaagctttaaatttttcatatgataattagtaattttttctaaatattacaaaatgcatatttgcctacctgttgagttcctattgctaggaaacaaaaccttccctttacatatgttagtatagaaaataattttcaatgattaaaatatgcaaatgtattgaaatttaaaaatttagaaattctggtacaccatcaaaaaataaaactagcagaaaattatagaaaagtctcagagagatgtttttccaattcattgtacataaattatataaagctcctcttttaattaagcaaatactcagaacacaatatattcgcatttttcagtagaataaacactaacaattgtctgtctggagacaactgttccttggctggaggtttggacagacaggcaatctttgttttggtataaaagcatcagcccatttaggtcacctgagtgaaaagaattagacttattttttctgaaaccataaaataatttaaaagtataaaaagatgaattcacagacaacctttggcatctataataattttatcactgctaattatacatgtttttttttctaattttaaaaggttagttagggcatccacatttgcagtaaaatttttttatagatattgtacatatttttcagaccgaaattataaacatttatattacacaggcacatagtagttgggtcttagctgtgcttctgaaatacagcatctaatcaatgttctcattctctgttacttataaccatgacaaaattatttaaatgattcttgcttttcatgtatagaataaactgcaatcttaaataaactgctaataaaatatatcaacttgtttgataactgttatatataaactattattttatgtaactcttacccataatgaagagataaaaaatcacacaggtgaccatacagtgtttttgtgtatattttcagatatcatatatttcaaaattgtgcctatgaccttgaaaaagctgtttttttgtgggatcatatggctacataaagagacacttctcttaagttctcttgcatttattaggtttaaagttcaaatatatcatttcttcagttttactgggatgtatgtaaattctacttcataaccttaattttgtttttttgttcatattttctgatagtagaaattgcagcattcaatctactttacctgaagcctttgttaattagatacagttactggttttgacagagccagatgaacggctctgaaagtcaacaaactctaatattgagattatagcctcggcggggcgcggtgactcacgcctgtaatcccagcactttgggaggccgaggcgggtagatcacgaggtcaggggatcgagaccatcctggctaacacgttgaaatcccgtctctactaaaactataaaaaaaaattagccgggcgtggtggtgggcgcctgtggtcccagctgctctgctcgggaggctgaggcaggagaatggcgagagcccgggaggtgcagtttacagtgagcagagatcgcgccactgcacttcagcctgggcgacagagagagactccgtatcagaaaaaaaaaaaaaagagattatagcctcagaaaataatgatttaatcacagaactagaattacttaagtttaaacctaaggatacttggcttaatctgtgagatagcttttattttattttcctcataaggactttgtcatattggattactttggacccaaaccttcaaggacacttagcctggctctctgtcctgatggaaatggaatagcggtggtctgggagtgaagatttccactggtctatggaatgcacacaacttggctataaagtgtagccaaggagttgatgacatacgaactagttcttctacacttttcttctgagacaggtgctgttgcgactactcttgctattgaagtgaagatagagcaaaagtgtagacagtgggatcccaagctcaaatataaatatttaaccctaagtatcagttataaaaatgatacgtttctatatgtcattgcagaagagaaacacttggggattttgagacccttgagtgaagaaaaagaaaaaacaagaatttatttgagagcaatttgagagcaatttttgtgaatgctcattttggttatttttgttaatattacctagaattaagttcagtagttttctggtctagtggatcgttaaatagaagatgtttacagcatgaagagcatatgctaactctttaaaaccattttttttttttttaagaattgaatctgatacttttgcttagctggataagggaggcaaaatttttaacagattgaacactttaaaaaggcttctgtttagtatcacattatgggcatgcattttcagattggtacaaattagccttgatattacatgaagatttttatgtctcaaatttatcaacgttgtttcaaaaactatatgaagaaagaagcgttttacccactaaaataaaatgaactgttatatagcaggcttaactacctctgtggtaagttctctgtgagagaatataaaataagcatattttatttttcaaatgcctcttgtcatttgaagccaagcagattcaactttgtggcaatggctacatactgaactctatgagaacaataatgtctcaaattgattgaatatcactaatcggttctaaagaaggtgatactgtctttaagttggaagcaattaattttggtgtacaatgaagcaagcaatggatataataggtgtttttcttatgacacaaattgataacttgattttgaggcttatattgagtgaatgtcgtgggaagtaattttacaaactcttctcacatttgtttcattctaagaaaatggtgaatgataaaataatgggaaagaaaacagcatctataacttattcaggattgcacactcttttcttaattgctttagggtacaacttcagagcttattgctaaaaggttatatgttttccttgtgatgtgattttctaatcacggggaaaaaaaatatgatatcatcccaaaggaggcagttgaacaaaagacaacacataaccagaaaagcaaaggttcatggcctgacttaaaactcctttgaatcaggaaccaccttatgatcacaactgccatgtttaaatgcatgactcagagatgtgcctatcgttgataacattagcgggtcattgtgtaagcctgaccataatctttctatagacagaagccctctgtttgggtggaaggcttaaaaagtagtgttctgtgagatagattgcaatttcttccattcgcttttgtttcttccttcttcgtaaccaaccgccccttcttctctactcccccaccaccccctttacgtctgaagccatcaattcatgtatttaaatgtccttggaaactgaaagtaatctagaaggttattagcatattgttataaatgttaatggcctgacagcaaggatgggctttttcttttatgcgtgttgttgtgaacattgtgagtttaaatggggtaaatcttccccattcagagtgttgccctggcccttcattcacatgtcaggagctcattgtgtgcccaaaccttgtcagaggcttctagatgtttagtggcagcagcttgccattgagagctgggaagagggctgtttgggatgggggaaagaccagcctaggcagccaggtggtggccaactggccagtaactgacagacaatttaacctaaccaggctgtacagtcaggcctgcgttacaaaagacccacatgtgtccttagcaagcttcattaactcttttggctagggctgtactcctctgacatattaattagttgcaatgctttctcctactccaacttaacctttccattggtcactcgattcaagtggatccattggaagctattagaataatatgcaaaataactggaaaaatagctgtaggaggaacaagattccctatcacttcactgattttgtaagaaacaacaatgttgaaaagaaaatgtgtgatcattaatacttcactcagaaaggtgatctattccatattgttaataataacaggacatcaattacagtgtaattatgtgcatgtcataggtatagaattgtcatgatttattctgtctctgtaataaaaataaaggaaaatactataaaacaacattttgatgtattttaggttatcttaatgaccagagtgacttgatgtggggattataaattggttcagctttttgagtaattttcacaagttaaagtcttaatgaagaagaaattgcaatattcaaaaaagttaatatttttaatattataacaagtacagtattcagaatctgtaaatatgtttcatatgtacataggtagagatagatatacatataaatgtatccaccaaaaaagatgagttttttgtgtactccttgatattttacatttcataatcaagtgctgtatcatgtaactctaagtagagatgcatcaagtattgaatttaatgactattgaatctaatttgtatcctttgtttgttttgcttatagaatgttttttgtcagaggtattctatacgcataaattaaatgtccaaatttaatttggaattcctaaaatccaaggccaaaaatgcattttatatatcaacccttacataggcagtaaatcttcagtggtatagtacttttaacttctcacagcagataagtcacctctcaaatccattgggtgagtaaactcagtttcattttatcgttttagatactgttatttttccaacttaaggaaagtttcatattacttagttcaatatcctaaagaaaaaaatagaaacaagtacaatgtgtatacttattattaaatgtttttattagctatgtaaaatcaataattctaaaagtagattttgctttaaactgtattaccagaaagagagaagctgtattcaaaacctgatgatgagcattgtctgcttactttttggtcagcttcactgtatttttcctcacaataattggttaatatgagtcaggctgactctaaaataagcatatctgaggcaattcttgagaactaaaacaatgtgtttagttttaagttacatataaaaataacatactgtcacatttcaagaaaaaagaaaaaaatgatcccttcaacattggctattgtctctaaaacatgttctataaaaaataaagtaaattaaaaaaacatagtgaacaaccacagtctggtagcaaacatgcattttattcccaaatcacacgtgtgtcttttgggacatatattttgggaaaatagttgatattggtggtagaagcaaggaaaaattactcggcttttacagagaagaaactcaagaaaaatgctatgtaagaaaaatgactcatggagataagttataatagttttaatttcaattgattttaatttaattgtgaatcttagggactcagaaatgatctgttttctgttggtgaaagctgcacattaaatatcaagaggtcttaggtttccgtgatactaggtgttctcatacttagatagtctcatgtatttgcatagtaataagattataatatctgtctctaggagtgcttaagtcttctttatcatccacgagtaatctgaatatacctgatcaaggcaaaaatgtaagtgtggtcattatgagtatttcattattgtttttatcagggaaatgagattatctgcagctacatacaatgagcttattatctgttagtagattgggtctcttttttaatccatttctaagcagcatgtgcatttacataatgtacatatcacttcaggaagtaaaattacaaaaagattgattgcagagagtatatttaccctatattctagcaagttcatcatttttttaagaatccctgtcttgaatgtaaatcagaattattatatccttaataatatagttataaatcagagccaacagtcttagaaccacacatcttaatgaagttactttttaaaattaaccaccaagttaaattatgaaatatatattagagtatgatatttgccaggtgataatactttaaaaaagatggagctttggaaagaatttatactaatcaatttaataggatataaataattataagatgttttgaccctacatttttaaaaatcaaatcaaatttggtaaatctgataagaatagcatgtgcagaggaaaaaaaaagcatgaaacattgtgtgaactaatttggttgtctccatttaattggaagcatgtattaacattctgtggttctgcataatactttttctgttaaactaagcttcaaaaatctggtaacaataggtttggtaaagaaaaaaagtgatagcattttttttttttttttgtaatctggccttgaaactttcacctgaggaaataagcatgtgttggttgtatttggcagtagaatgttacctttgaaaataggccctttttatttgatgtgatccaaaataaagctgaaacaaattgggtcacaggtgccaacacttgataatttacagtgtggtaaaaccgagtggtgtttgtaagtataatttgctccgggaaaatttgaaaccactttaagttggaaaagtgtcaatattttataacatattttataccaaccatacccagattgcaagatcctttctaactacaagctgtagttaactttcaactattcatttaaatttgtggcttacaagtgtagtgtaaagtcactggtcatttattaaagcacattctttaaatattaagacacaggaattgataaacatatatattttagtatgtggaagtttattttgaaccttgttgagttattaacttcaaaaaaattttgaccaaattagtaaaattatgtttcagccttattggctttatgacatttaaaagattataggcgttgaagttcaaaaactaatattattaaatattagtaactaacattattccactttaaattttgatttatacaagttaattaaaatacttcctaaaaggacgggttgtcatctaaaattttccttttggtttctgaaccatgcctgcgattctattctggttctcttatattctggtacccttagcattgaaaaaggaaggaggaagaggagagagaagggcaaaaacatcctattctccaggactgaattcctccttctgattagagttattctgttgttattgttgtttttttacagttgttttcgttttggccaccactgacccccaagtgatgctatcttgtgcaactttgcttttattttttgtttaagtttcagatatttttgtgagatattttgtaatactttaatatagaatctgaagtttcttttagcattttcccatttcatttctcattttgtgatacacatctcaatatattccaatttggagatattagtatatgccactgtagaaagattataggtgttgaagttcaaaaacttgacttagaaatatctttttgtggctggacatggtggctcacaactgtaatcacagcacttcaggaggcggaggcaggaggatcacctgcggtcaggagatcgagaccagcctggccaacatatagtgaaaccccgtctttactaaaacgtgcaaaaattagctgggtgcggtggtgcatgcctgtagccccagctacttgggaagctgaggcaggagaataggagaatctcttgaacccacccaggaggcagaggttgcggtgagccaaggttgcgccactctactccaccctgggtgacagagcaagattccatctctaaaaaaaaaaaaaaaaaaaaaaaatatatgttttttcacctactgtttattcttacaccagttacttaacctttctaattctcaggaatttctcttgcagaatgagagtaataatacatgtctcacagagttgctgtgtgcaaccatattttgtaaagcatcttacacatattaacagtcttaaatcttatttagaatcatagtgttacaaatgtatttaactataagtttattaatacatacatcataaaatccttgtctctgttggcatttgttgtgcaaaccacttggaatttatctgtaatataccataggaaaatgaattgaagaaaataaaattttcaaaatggctttcaaatattttattttaattttatatggagattaaaataaatacatgcagatatttttcttaatatttcagattctcttgtaacaacaaataccaaatacaaaaacacagccacatacaggacacatatctcacacacacacacacacggttttcttagacattgactaatttgcaaaaccaaacgcttacttatatgtagcatagcataaagggttcactctgcgtgtgtgtgtgtgtgtgcacgtgtgtatgtgtgtgtgagttttatcacttctcataatcatctgaaatttcctaaatattataagagtagtttttcttcttatatctgattccacatcttaacaaaaacttttacctctaagcatggacagaatgctggttagctacctgccagcaattctttacatctgatctgcaaaaggacacttgtctgggtgttgtgcatgccttggtgtgcactgacaactgagtgttaaaatctctgggggacatccagagcgaccacaagtctgaggccttggattacctgtccacatttgggactgtaactgtgaaaaaagatttctctctcatacatctgccttctctcttctgatttgatgttccctctcccattggtaagatttcagtaaacaacttcaaagactgacataggctgacagcacacggcagatgtgaagggttacttcctttctcttttaggtttcattttttaaaaatttttgaaattatcaattagccttaaggtttagtttgttagaaagggttttgaaaagccactcaaattgccagaaaatgtgaaggatagcaaatcttcaaggtgttagttcaaattagtggttgctaattaaatgcactgttttatcaaatcactctgtacatctcctgtgggtaatttcaactgtagtcctgacaacatttgatgtgttttatatttgcattcactgtttttgatgcttgctttatttcctcttcttctacctctctttccctcactcgttttattctctcctatttaaatactgtgctgttcaattaaatattgattgattgatttactacactcagaattttccaaagaagactgagtcacaaagcaaaaatataatgtctaatgataatgaacataatatcctccaaaggaaccaaagtattagaggaaaatcccaaggggtgaactaaattcatatctatttgtacatttacatttttattttgggttctaccactgaaatttttatcttctttgtggatagtcttaaagtgttgattacaattattctactgaactttttcaaggtgcagttcccctggcatgatgattctaaaacaaatatttactaggaataaatgacattttaagggcttataatcaagagacatatgtagccaatagatagatagatagtaaataatttcaagtcatttttatgttattacatcttctaaatataattttgatttccatgttgatattcctttattccatttgtgcaaagatggaactaaggtataaagaaatgctgttagcatacgtataattacacatacattattgttgaggaaggaattagaaataggagtctggctgtggagttatatgtcatagcaaagatgtaccaactgttttgaaagaaattcttgttctgaatttttagtccttggggaataatagctcctgtgaatccattatttattactgtagatagtacactatctatgaagtttgtggattggagcagatattgtttagatgttttagatgcactgaaaattatattataaaaccttttctgttttattattaattctgaataatataatgtattaactaaaataataatattttcaatactgttatatagaatcctctatttttaaagcattttgagtccataacttctatttgttgagccacagaagaaatttatattttatttttatgggtaaaagaaaagtgttttatatcagttactgcttataactagcatctgaatcttgagaataaccttttctatgtgtttaaagtcataattttattgcttttatccattgtgtattaaatcataataaggtagtcaaagtcaataaatgtttgtggtataaaaactagatgtatattatattattaatgtgggatgtttttctaaaagcaaaatggtacaaactatatcgcttatattttataaaaattttcatttttctttttttacttgaataaaataatttctttatacctaatgaaccatttgagtagtgttatttgtgtttcttgcaatgttgaattgtttcatgtgcatttttatgtttgccaatgattcaagtattgtgaaattatatttgagatggaatttatttggaagactaattaatatgtctttttctaatgtttttcctactgttatactgatctctgatatctcttattcctccctcaaaaatcacatgggaatggagtatagatagttatcagagaaggggttttaaaccagtctaatttctttaaaaaggaggggaacttttataattagttaccaccatttgcctttatttttcatataataggatacttactccatcatctaataagaaataaatcatgattcatagtgagtctctttatgatctttggtccagaccagtccaaggggaatacaagcataaagtctgaatcttctctcatctttttcgcttagattgaggtcactgttggggcagagcagggaactgtgtggttaactgtagtgaagacagcctttgagcccaatgctaagtgttatgttcaaatgttgccaatatttttaaagtctgtaaaaaaaaaaaaaaagatcttcaaaaaatgtggacaatgaaatccttgtctagctcctttttcgctttttcctattaacacataaagtcacaaatgcatgttaccaagtcaaacatactcacacttgtagatacatgttcccagcagggtttcatttgtgcttagtgctgcggtttggtgaaaaaccctctcatgtgtatagttgttttcatttttgagcttgtcacagcatgaaatcagtgtctcactgagagcagggtttttttttttcaataccctgagacttagaggctaagtaatttaaatgtttaaatatgcagaaatacaactcaagtgcagttcgtatattcatatcaatttctgttataaaaggttaaaacaaaatgctgtaatctgtagttgagggtgtttagaaaacctgttctatttgtttccgtgtttttctacaacagcataaatttcttccctaaaaatctacaaatgcatagtgtgccaattaaatgatgtcaaaacagctcaacattaatttttttttcatgaaagctttcttacctgctatacatctaagatatcttaaatagaccaggcttgaatgtggaaatatttaggcattgtcctttatgcaattccaaatctgattttttttttaaagtaagttacccactataccataaacagagtcagaagttagtttctcttgattttcaagtctgtgtgtattcagttccctaaaaagaaagatgaaaccattctcttaaatttatggtgtgtatatttactgactggcatgtgacaggaacactggttagaaagccacagcattatgatgcattgggtcaaatattgttttgacattgtgcttactttacagtaatcaacatattaaactgaggagcatttccttatatatgcaaaatgcaaagtataagggcagcagtttagtagcgttataaggccatagaaggttaaggtttgcttgccttgtggtgcagctgataaaacaattggactgtttccaaaattccttgactccagctttgtcatttatttttctctgtcgttattttttaaggaaaaaaatagacttgtttccatgaaactctgaggtggcaaacctgtacttcacataaaataaaaactttttttgtaagtgaagtgcatatgggactactctggcaagtttagtttgtgtaatttgctaagacttgcttgtataggaggagctaaaataatttccagagagttggaaaaaaagagattttgtcacagccttttggacaagatgttgataaaccaagtgactgataaacccctttaaatgggatattttccatactccaacacatagtatgaaaatttattttcatagttttgaaaatgtttctttttatgtaaacaaaaacactcatattgtaattatgtaatttgagtttgacagacttaagtaatctcctagttttatttaaatgacttttgtattctacctgtttcttttatattgaagtttactttttgagcatttcagtgaatttattggtgttcattggttttctgccttgttttcaaaattgtaataggcatgttgaagaccacagaagaatttctgagttaatttccagttgagcaaatatgacagatatattaaataaatgaatactaccatagagtttaattcttctaacttctactgattttttttcttacagcaaaatatatcagttatatattttgtcacatagctcagttttgtacactgattaaaatatttgagaagccaggcagacattcaaatggacctgtttaataggtagtcaatgacaacctcagaaggtgatgcagccaaataaacagaaaaataaataaaagacaatgtaatggagatggtagtggagagagatatacttaatactgcggtgttttaaatttgagcttttggattattagtgccatatgcaatcagtaagtatgtcataaatcttgtccttcagaattatgagatatcaagaccagctccataatctgggggtatagggtatttttgaaataccttgttcaaaaactaacaactttaagattgtggcagcagatcgttaaatctaagcagagagccctaggagacgatacagattgcatgctcagaaagctggcctgtcaggcatgctaattgagtgaaagtcttcaaagtaagaaatggttttcaattatttgaatcattattccttggcaaaatgctagtaccttttttaagggtcgctgggaaggttgatgaaatatttcatgtaaacgtcttaggcaacagtgagcactttagatagcatttgaccagtgataatcattttcatccttacttatctgttagctttttttttttactatggttttcctcttatttgatgaccatactatcataaattttcctttatttttcccctttatccttctcttctcttctttatgactttaattggttttttctcctttcattgaaaaataaatactggttttataccactctttatttcctataacaaggacagctgtacccagtggtgccactttatagccccaaccatgcctccatgctgagtgtgtcctttcatcagatttccttgacatctgtaaaagatcagtccgggaatgtataattgctaatggtatagtctgtacagtacagaaaatatggctattcattgtggagagtagcctagtcactgaagtttaaatacatcagagtgtcctttaaaaataagaggtaggaatgcattgatagcttggtgtaggaaattttatagtctgaatagattctcaattgattttccgtatagtacacatagatttctattcactttagtggagaatttacaaaaggtatgccttacattatgtcatgaaaaggaaaatattgaaaaaaaggtcaatccatacataaattttgagcagagaaagtatagcttaaatgaaataggtttttctaattattggtaatttgtgtggtgcgtgcataggcatgtgtgtacttcttttgctttacctggaaatagtctatgtatgtaaaagttgaggtataatcaacaaaaacttagcatatctttctacatctgtaccaatgtcagggaactatgatgtctctcacactcctttgaaagagaacattaaaaaaaatcaaaactccctctaagtaatataaaaatctattcattactggttttcagaatcacatggtatatattacattgttactaaaatattttgaatgaaaattatctacaataaatagcttattatttccactgaattacacaaagcagacattgaaacttgtcagaatgtcagacattttttaagatgaaaggaaaactgattacaaatgtgattttaatttgaggactcggagaggtaatccttgaagtcagagttccagtataatttaaaaacatccaaaacttttgatgatgtactctgatagttaaaataattattgagttcctactacatgtatattcatagatagctacagatttagttattaaatttctacatgtacctttctatatattgtacacacaattgaaattaaatatgaattttaaaatggactgcacaaggatggatgacttcctaatctcttcccactgtctcacatgcttcattgagctcctaagaggtttattctattatgcatagtcctggatggtgctttgggtgagatctgtaagatttggtcttttctcatggctgcaattagatcttctcttgctacatcatcctaccaaatacccaaagatatgtcaatattatcctgattagaaggtatggtaacccacaggacctttataaatcaccttttgcctcaccttcctctctatcacttagggtcttaataattattgcctaaagttctgaagtactccctacacacacacacatggcctccaactttatattaaggtgatttaataaagaaactattttttaatgaaaacagatgcattctaagccttttctattaacatgatgattttttaaagactttatgttccttttgctttatgagcagaaatctagaattttataactcttatactttgtttaatggctcaagaagtagctgtcactttttgggaactgggaattagctacagattatatactgctgtcttatctgaaattcatttgcaaaactctagggttgaaactacttgtaattgtaaaagtctgtgagatttgctggttacatagagacattgaaatgattatgtaaatgatcatttaaatcatattactatatcctattctatgactataaaaatttttaagatataatttttatgaacagtattttgtgttttttttaaggtttgaccttttcctttaaatatattcacatgattcggagcagtgtttggaattttcaagatgttggtattcttcaaatgtttcagggaccaaatagttatagagatcactggaaaatgatggtgattttcctcctcaacttattcttagatagaaattgaaagaaaccagttcccctaagggaaaatattttcccttggcttcatgaagaaaacacaaggatatgtgtgtagaagtagttgaatggctggttgacttgagtggcttcatcaaaatggaggcccctgtagagtaatggtatccttagtaggttccaagttacagggatttcttggcatgaaaaccattgtgctctatttgtgtttgaaaggcctccattcattgggctggttgtttacattggcattaatctaattacattccggttgttttgaatttagtttagatatgccataagtgattctactttctataatcatatgcagaaattacaaagtagcagtcaacgaattacttttaaaataagcaaacactggaacaaccaaactcttatgtttttcaggagcaaaatccaaaatgtaaacacacactgaaaagctctttaaaaatcaatgaaagatactgtgcttttccaagccagaattcttggtttcccttgtgattgttaaaacaaaaggaagcaaaactcttgaaatggattcgtttcagcattttcttccccacatctaataagagggaatgttttccagcaagataatgatggggagtcaggcggaaagataggggacttaggaaaagggatagcagcagtgatattagaatgtgaagctggaaactactgctcccaggactaaatagtctaagtgctcccaaatcttgtgtccattaccaacagggagattggcatgtctggtttggaaagcatgtttttaatttgcatttgtctaaaattaaaaagccaacttcttattgggtgcttttctccccctgctgtctctggattatttttctgctgtgagctcgtgctttatctgcatgtgtgggctgtgaaggtagtatatgactgggcacctgtaatcaaagtatggtaaagaacctaaacctagaaacattatgttgtttcctgtataattcaaagtcaaagcagcatcagtaatataattgtaacaacgtccagcaaagttctagcttttctccttgtcaaacatttatttattttcttttaaaatatcaaacaccgttttagattttagaaattagaaaaaaaaagtttggtgactttgctgtcccctacatacatgttgaactctctggtgggtactccagcacctgttggggctgaattaagcattttattggctacttatgtagaaaggaaattatatttgatatattaatatatttagtagttgagagaatagatctcaggaaagctaagtaatttaacagatatcaacagatattgtgaaaacaagaattaaaatccaattttcttacttgttcaattccctggtcctcctctacgtttttcactgctggctagaggactgtcttttgtatcttctctagggcttaaacttggcaaaaatgtgaagtaggtgggattggaggaatgtgttttgttccttcagttctaccctctcacttttcatttcacttgcatcctcacaatttccacacagctctccctttctactttgtctactctcagagccttcttggttcacatattcgcatttacacaaatgatgatttaggtttaacattctattatacccaggggtgtggtcatttttagggacaagcaacaggatttagagggataaatggttcagtagtggaatgttgtcttttgaaaagtgatattttgagaggaatagcccctcattgtctattactcaaatttaatgcatattacaaataatgcttattttgtttgcaagaaggttcattttttttctttcttccttctttttactttctcttttttctttctctctctctcctctccttctttctctttttttcttctttctctgtctctcctattcattctttctttcatcaagtggtacatgtctactgtttgtttctagagatgaaacctaaattatagtcttacattcataattggcagttagtgagtccaccttatttttcatatagacttcttttggtaaaatttcactgcattatcatgatatattaatccatcttgatactatattgtaacttcctctacacctaacaccctttaccttgtctttgaggtccagggacctgtttaaatacctctgttcatttttataatgatacaatctgtaactatcaatacatgtccttggtttaaaaaaaatataaataagatagtaagtttacaactcacctatagctttgttaacctttttttctttaattcttaaaaattatttcaaagtcaaaacggcttcaatttactttccactgtcacgaatttcactctgtgaaatgagaacaactcaaacttcacattgagaagtattttctgatgtttattagttgtgcttgtatagtactgccaattacatttattagccctaaatattaaacagctggcagaattccattgtatataaataagacatttgagacctggacaagtgccatgttgaatacagccagctggtgctttttacagtttttttcgggctactagtactgatgccacagtacattcagtgtttaggtaaatgacaatagaaaaacatgttgtgaattgggaattctataggaaattccattatgtagaaatatagcatttcaaagacttttaaaccaaggaaatgatacgttatgcacctgttgattgaatttgttgaattttgtgttgcctggaatatgtttttaatctttaatttactgtgtgcccattttatattgctgagttatgccatgcaaaatgatgactgcttttatgtttcgtcttctaataaaataaatttttatttcagatttattttaattataaaagtgtattgaacttaatagtagtatacagtttagattctcactttatatgtagaatttactctttcagagtactacagactttaatttttatcctcacgaatatttttatgttcatatcctacctttgttgaattactgtataaaagccctttcttattacatcaaatttgtgtttttgaaaagcaaacatatttataatatgcttaatgtatattaataagtaattaatatttatttatgaatgtatttaatatatgagtctatacattaccgatttattagtattcattaataaattaataaatattaataaataatatacattataaataaatgtatatatctatgcatttaatacatatttatttatatattattcataagtgtataaagctatacatgtattatgtaattaatttatcttatttaatgtgtattaataaataattgacatatatttacaatatacttattgaataagacaaatgctagtaaagtgacttgcactgttgcaaatataaaaaatatgttaatttaaattaaaaaatgaatttgagctgatgaatatcagtgtgattctaaaaatgtccctctgttttaaaagactatatgttcttaaatttaactggtaaatactgtagaaaatatttgttgatttacatgatgtgcgagagtgtgtgtatgtatacaagcatgtgtatgaaaagtttaaattaaacagtagccttgtcaccataaacacttatctgagataattggccatgacatagctttgtaggaacacttcagaggctgcgctgggcttgagaaatgtaatataacaactctcttgacttcagtgaaataaatgtatattatatattaattaacactaaaaatctcttagcaccacaaacctgctttctttgacaattctacatatattttaaagtgtataactggtatctcctaaacagaaacaagtaatctgaaaaaaattcaggattttaatgggcaatatataacaagttactttattccaataatataaaagaaaactagtaggcagaattttgtttttatttattttgtgatttaatgattttcatgatgacaataaatggatacattcttgtttgtaattccccctttaatacccacacataatacttcctcaataaaatgttattgaagaaacaaatagatgaaacacatccagataaaaataagccagctacgatctcgttctatcataggcacgtgaatgacacccatgttgccaaacgctgtggctcagtcgtcaaccgtcaccttgctcatcttgcagaagtatttgggagtgcttactgacttttcttcttttcatcatcgacttttattcagaaacttcttcatttggtgtcagcatactattttcatagttctcttgctttactgggcactttttcttaagctctttcctagattctcccaaaaattcttgatttctaataaatgaaaaattctagaactcattcttcaaactccttctattctctgtacaatcttttcctagccaatatcaccatctacatattgaccgtccttatattatatccttgacttcatcatgctcctaaattccagactcataacaggtgctattacaaacttcacttctaactaatatatccaagatacttctatattctttcaccaaacctgctccttcttcagttaatctttcccatcttaataaatgattttcttcttcacatcattcacacctcttcccatgacaatttatcagagctgtgatccttgaccactgtgtccctctaccctccttcattcttcactatctgttctctttttcctccttaaaagtaggttccatgaaacttgagactgctatttgtttatctaacagcctctatccccagttttgaaaagtgtatggttcatactaggccctcaagaaatacttttgagtgagttaaatataagactatagtaagtgcttctctcatgtgctatctagactagatgcctgtgcctggagtgtaatacctggagttaaatggattccagtttatgtagaaagtttagaaaacatttctgaaaggaataaattttagtctttctcaggagtatgaagaggactaaatgggaaggattgtccttaccttatgaaatgagatgtataccttaaactataattgacattaagtgggattctagtattaaagtccaaaccttcatttcattagtattaatgtccaattcttcaatcctaatataatgttgaaaactatactaagagactgggcacggtggctcacgtctgtaatcccagcactttgggaggccaaggcagggggatcacgaggtcaagagattgagaccatcctggacaatagggtgaaaccccatctctactaaaaatacaaaaattagctgggcacggtggcgcgcacctgtcatcccatctacttgggaggctgaggcaggagaattgcttgaacccaggaggcggaggttgcagtgagcccagattgcgccactgtactgcagcctggtgacagagcaagacttcgtctcaaaacaaaaaacaagaaaactacactaagagacctagctctagtctaagccacttttctcttcttgagaattcctcgtttcctgaacgttactttgagttctgtattgctcccctgacaaattctttttattccaaaacagaacccttgctttcatttgcaatattttttcacattatctattttttaaaactaaattactgtaagtactctattttaaacaactggttactaaggaggcattaattgtgtccattatgatctgcaatttattattagtacgtcttcctttgttcagtagccctgccattttgcattgagatttaatactggaaaacaaattttaaacccagttcagctcatttggaagtataatttcaacatgagatctgagctgaaaacaggtacctcgttcagaaatttaaacctaagacacttcctgtgcaacagtattaaacatcctctatctgtagcagctcaaggttttactatttaaccattttatgactactttacctaaaagctgcacctgcttctttgatttatattatatatcttattgaaatcaggccacactttcctttacttatttttttaacacttactaagagaagctgataaagaaaaatattaacatttctggaccggtctgatgatagtactttaaattatttttcctaactctcttcaaacaaactaactctcttatttttcctaactctcttcaaactcgttgtttgccaggtgagtctatgaaaacaaatgaatcagtcatttcagagaacaatatatctaccaattaactgggtaaccaattaaccaattacctataaacataggctttattttaatattaaacatttaaattttgtataaatattgttacaagatatattctttgttacatatactgtgactaaagaccacagactgggtggtttaaacaaaagaagtatttttctcacaggctggaagtgtgaaatcaacatgttgacacgattgcttcctctgataaccttgaaatacaggtgtaattgcataaagttgtagtttttataaatataacatttgaaaccccaaaataatatattctgtgaatatcttctctttatgtaggccatttacaaaatatggaaacctttgagataccacagttgagaagtatctgtttcaagcctctctttctggcttataaatggctgtcttctcgtgtctcttcacattgtcttccctcaatatatgtctgtgtccaaatttcctcttcttataaggcctccgtagtatcgaattagagctcacaataataacttcattttcatttaattacctctttacagatcttctctccaaatatactcccatcctgagatcctgagggttagaacttcaaagtatgaattttgggggtatatgattcagcccataatatatgtttaaacgtttacccatttcattttattctttttattggaaatattaaaatacaatattcctctttcattggtgtagtaaacattgactgggtgacgcctgccagatattatgctagcttagaagacaaaaatggatgaatacatttgagccacagtgcttattaaaaattaaagtggagtttcttctgacctttaatgcactctccagcttaccagagttcccatgattcctaattgtacccaactagtattatatttttatttttatttttttaattttttttatttttttattttttttgagacggagtctctctgcgtcgcccaggctggagtgctgtggcacgatctcggctcactgcaagctccgcttcctgggttcacaccattctcctgcctcagcctcccgagtagctgggactacaggcgcccgccaccacgcccggctaattttttgtatttttagtagagacggggtttcactgtgttatccaggatggtatacagcctgtgagaaaaatacttcttttgtttaaaccacccagtctgtggtctttagtcacagtatatgtaacaaagaatatatcttgtaacaatatttatacaaaatttaaatgtttaatattaaaataaagcttatgtttataggtaattggttaattggttacccagttaattggtagatatattgttctctgaaatgactgattcatttgttttcatagactcacctggcaaacaacgagtcttgaagagagttaggaaaaataatttaaagtactatcatcagaccggtccagaaatgttaacatttttctttatcagcttctcttagtaaatgttaaaaagataagtaaaggaaagtgtggcctgatttcaataagatatataatataaatcaaagaagcaggtgcagcttttaggtaaagtagtcataaaatggttaaatagtaaaaccttgtctcctttgtctcgccctagtgtgtgacttcgggaccttccttaatcttttggcagctccctgtcttcatcttttgaaaggagatattatttatttttaacttgtaggttggttatgaggactatattaggtttataaatatcaataacttagaaaagtgtctggcccatgaaaaacatgtagtgcgtgattaaggatttggcaaacccagtgaaagaacgtccagatccaagaggagaatcctaggtataatattttgttctagaaaccacactacattatggagtgttcattaacttacattcaacacctacaatactgtgagtgactgctgatattgaaaatgatgtactctgagccttcgtagatccagagttataggagtaaaagtttaattttcttcaaaatagtaaggctaagatttgaagcaggaaactataataataaatataaataaaaggtaaaatatactatatatactacatacactaagaaatattttatgtaccaaaatatattcatatatgtatacacatcaagtagaaataaataaaatgactgtaggatttaggaattagttctccaataaccagaatacacaattgaccaaaatatttgccttctggtatacttataaaaatctctaaaatatagagttaatttggttttcttcaatgtaatcctacttaatttcatggtattgacttggatttcatattttgaatagaggatcctaatacagagaaaactggtatatgttaccattttaggtgtcataaagctctagaagctgaagaattctctggagacatgtaatattaggcaaataaaataaggagccatcctgctcctaattcagagtaagtaactgctttaaaatatactggatttatttagcctcatcagattaggatatagccaaaatcaataaataatcacttgtaaaatttgaggtagaatttagagaaatattttcaaataaatatatttttacacacctattattaatacataaactttgaatgagtttgtaaataatctctgaaatcttttgtacaaagttggaacaaaaatttatctggatagtaaatagaggtataattgcataacgttgtagtttacataaatataatatttgaaaccacaaaatatctgaatatcttctctttatgtaggccatttgcaaaatatgaaatcatttgagatgccacccaaaaaaatggttaatctgtgaataaagacaacaagatctttgtagcttaagtagctggccattgtttttgggtttaaaaatttcttttaagttcaaaatattgctctgataagctacaagtttgtagctgctccccaccaaatgatagcggccttggcattaccatgggaacaattgttacaatttgataatcctatttttcacaattcaatttgtgattagaaagattttcttcatccttgatcattttgatgtagaaaggatttgttaaaagacacaaaattacagttagagaggaggagtaagtgctagtgttttatactgcaggatagctaccgttaacaataaaatattatatagtttcaaataactagaaggaggatattgaacatttccaacagaaagaaatgataaatgtatgaaatcatagatatactcattaccctgatctgttcactgtacattatatattccaaaatgtgactatgtgccctatgaatatatacaattattgtcaattaaaataatattttaaatgatattgaataaactacttttttagaaaaatttaattacacaaaatgatatgagtacacactatttagctttttaagtgtttcccaatatgtttacctgctatgaacatgttatatgaatagtattgaaccatttttctgagctcaaaatttataaatgttccttcatctctaaaatttcatgtccaagtggctatttatggttctaatgtatttcattatttttgcttgtacacacattcacattaggctatgaaacggaatgcactatatattatagaacatttgtaaacatatgataattttcaaagtagaatatttatcacttatgatttatttataatcatttttaggtcaggattaaaatgagatttagtccattcccaaatattcttccagaaatgtaacttttctttaaaaatactaatatttcagaacttgttaaaacatactctttatagtacatggattgatgtgctaacaaaacgatattttaataagataactaggttcatctaaaattatagtaatactatatttctgtatttgtttcaaagttattaatatttgcctgtaactggcaaatctcgtattaagtattagtagagcagagttttatccagactgactttacaattagtcccttctgccttgcagaaacaatgtggtttattggcacttgaacaggtctaagagtaagaagatctggtctaggttggacttttattagctttgacattggatgtgtttctgtctctctctgtagatatcgattaagaaacctgtaaagaaagttctccaatctcctatagaatctattgaatatttttctattcaataataaaattgttaggacaaaatctctgtatctgctttgacttcttctctgctatgctttatgaagtaaatgacgttttgtgaaaacctctgctaacaaaaatacatgtattttttatagtcaatatctgtcttcttgtcagttcactctcctcagaccatactttgctctaaagcatcctctataatacctatacagttattgaaattctcttctctccagcaactctgacattgtttttcccttgttctattctcacctctgcaaatgctccttttccagcagtatataccatgccgaacttgaaaaactttttgatgtgggaacatttcaatatggatgttggaaagagcaatttcgataatacagtatttccacttctctcatcagctcatagttctcttcctaccctgtacacacaagcatttcataatacagtttccgacatttcatttttcttgtatttttttcttttttaaacataagatttctaaaactttaattatatgactccaaaatctgaatttatatgcatgtaatttttttttctgaattctggatatccatttcaacttttgaaaacattctttttctgtgtttcatgttgacattattagattctacccatattaaacttttgctcctcttctttgcataagttctcacacctgttttgctgctctttctgctcataacgttatctccaagtcaccaagacaggttcataaaaaacaggaaagctgtgcaactgaagagttctgggtttgaatctaggctccaccattaacagctaacagatttaggggaagttattgaaccccctcctaagcttcattttgtctcatctatagaattagtagatgatggcacctgcagcacagggttttcaaggataaaatgatgcaatgccagaaaggcccattaccttgaacataaaatggtcaatatgattatccaatgttagcttaaaacctcagagtcattttcaggtttttagttttctcaaaacaaatatcaatcgtttgtcaagtccttgtcctactcctaaaatatttctctcattcaaaaattagttcatttatttgcttattcaatgagtggattatgtggaactgtcctgggtgttgggtatcagtaatgagcaaaatgaacaagtcctcattacctgtcccttagataaccacagtaactctcagatccatctgcctccattcctcatctagcccatcctaaacactcttgccaaagcaatgtacttaaatctaattgttgcttaaatctcacgagtgatgagaaaaacttccattatattccaaaccatctacatggtcattccccactgttctaattttctactattgtctttatagcacccagagtgattctaggaaaaagtaaaacttgtcagtcttctgctcagatcccaggattgggctaaactcttcaacccttccccttcctccttctcccagtcattctctttacctctctcctctgaggacatacaagatactgtctaccttgggattctttactgctgtttcctttgccttgaatgatgtttcctgatgtatccatattcttttattcaaatagttcaccatgaagtcttcctctgacttgtctcatcctttgaggttttatttaagtatcacattttcagtgaagacttcccaggccattcattttgaaatcttcccctcctctcaacatacacaactgtgtcctctctctggcttccgtcattgcttctcctgaaaacataacactatgtaagaaaacacattttaacacttaattttgttttgttgtatatctctcccactggtatggaagctccctgaggagagatttcaagtcatagatttcaagtcatcattttcactgctgtaatagcaccttatagagtcactagtgcataacaggtgtttgataaatatgtgttgagttagtcaatgaaagatcaacttcatctctcactgcagctgcccagtgatgtccaaactcagttggaattttgggggttttatgcctttttccatatcatttcacctgctcggaatgtgctcatcctccttcttcctcctcatctattttcactagtcatagtagtcaaaattatacattttgacatagtagtcaaaattctacttatgtttaaatttcttccctaaatgccacctcctgactgctaattttttcctctggtttttgtactgggagtggcaactttcaatagcataaatcacattcaacacttttctctcatgtcccacatcaaatctataaaatcccgtggctctaccacccaaatggttttggaatctgttattttcttcctatttccaccaatgctatcctatccagactccatcctatgtcacaaaagtattacaataacctcccatcccacttcttagaccgtcactccttgctgtttctcttcagcacagcagcctgtgacctttttatgacatgattcagatcatgtcactcctctattcaaaccctttactaaatttccatttatctaaggataaaatccaaagtctctcttatgacctaaaaggacctaaatgaccttctactcaactacttctctgatgtaatgtttcatgacatcttgatcataatggtagtgccaagaaatggttttgtagaatgtaagggcttcataaacatttgttttatttagcaggtaacaactgtgtaagcacttactatcgatattatctattaagccactaagcaatcctgttagaaaggtgctattattatctccattttaaacatgatatacctgaggcttaacatactgcctggtatgaaataaaaacataaaaaaaaacataaaaacataaaaaaaaaataaaaacataaaaaaacttatttttattaaaatatagaatatatctcttgacgtgttatgcagatagatggcagatatattttacttttaaaaaagataatagtgaaaagaagtgaagtcaagtgtctaataaaattacagaaatatagaacatggtaaagtgtggaatactattggcaaagattttattccagtttagaagggcaaatttatcttagaaaaaagatagcagactcatttctcataaaattgtggctgggcacagtggctcacacctatattcccagcactttgggatgccaagacaggtggatttcttgaggtcaggaattcgagactagcctggccaacatggtgaaaccctctttctaccaaaaattacaaagattagcctggtgtggtggtgtgtgccttagtcccagctactggggaggctgaggggggagaatcgcttgaacctgggagacagaggttgcagtgagccaagatcatgccactgtactccagcctgggtgacagagcaagaccctgtctcaaaaaaataaaaataaaaaaataaatatgcaaagcagccaaatattcagttaccttttgtcaattatatttagtgaatttcaaaagagtaaaacagacttacactggtcataattgttatagcctcaaattagaagaaacagaaactccagcaagtgaaaaggaataataaatagacaaactttgaatttaaaatacatttatattattttataaggaaaacaaactagtatattccggtgacatttttggttaactcagctttgtcagcataataataatgaatgtttatttgctgcttcccaagtggcaaacacagttacaaccattttaaatggacaatctaattttgttcacaatatctctagaaaatgttattattatttttcccattttacagatgtgtaaattaaatcatactctattgaatctcttagttattaagtagtagagctaggtttcaaacacagggtcttttatctctacaggttagacccttaaatctaggctcctcaggatactcaacggataaaagattaaacatgtttctatgaagtattgttgctacccttgtgaagagaacagtagaaggggtctctgtagctttaaaattggtgctataaaacagcttacatttcagagaagtgctctcaaaaattacacttattttgttaaaaagtaaatttagctatctgaagatctgtaaaacttagcatatgttccatagtgacaccagttaatttcatttccgtcaccgggagtgctccgcaggtatattgtaaattgctatgaattactgtggctgtgacccattatcatagcaggaaattgcatgaatctcacaactgatatgaaatatactgctgtcactgttatgcattaatttctaagtagttggtcatttgtaataattctgtaaatgtccatcttagcacagttttcagtctagacaagttaagccaatgtgcatggaattttcctcattatcttcaagcagttatactgaattctaaaattacttttttattggacaatttcaccttgaatatctttccaagaattggaaacatgctagtctcattgtcctactctctaatacttaagggaaatttactctataaaaagtaaagccatttggctatatatgattagaaagacagagtgagaaaatctctgatgaatgtcaacagtgtatttttttctttctaacttgtattgaatatattaatgatttattagattattcttaaatcgtattgactcccactttactgaggtaattttcagataatggtatacttcatcacgatagttttaaaaagaacatttttgcaataagtgtcctttacattataagtaaacatatttcaccatttaaaaaccaaacctttacaatgcaaattatacttttcttctcttttctttgatattgacattattctcctcacaagaaagaaaattcaaatagcacacttcattgaaacttcttgacaatggtgaattatatgttgtctccctatgttatactttatattttagcataacatatatctgtttcgagtcaatgcttctggctagaaattctcttctttggtaaatctttgaatacttttaataatttttgaatttttttatttccaccccaccatatctcaggttttcagatgctttttcctttatcttccaaaactattttcaccctctatttcaaaaatctgaattataaatttactgacacatagtttctagaaatgtataccttcttcttttttcctgtaagtctgtcattggtcttatagttactcagttaaggatactctgacagataactgtctacattactgattttctaaatccaatgcctcatgtagccaaaagcacacttctgtctgtactttgtataattttgacatttggcacattgcatgccatttaattttagtaaattaaaatagggcgcttacttggttttaggcacagggctagatgcttgggaggggaagatgaacaaaaccagagaccatggagggcagcaagactaatgaatagagaaatgagtgagtgtgttttatataaaataacagtagatataactggtagatattatgttctataagaacagctatcctgtctatctgtgttataactgcattatcaatatagagcctgatacacaatattcaataaacaaaaatttgaatgttcttgaaaggagaaatggagtctacattggacattatttcacagagaaaaattaaagatatcaatttatttatatacacgtaccttgtctctttttgttgatgctgcatctttcagcagaaagaagaatcattctgaaatatgttttggtatatccaaaattctaagataagctgagttactatcttcacatgtagatattcactgtgtgcattcataagaaaaaagagcatctctttataatctttttgggaaatgttcagtatataattgttcaacagaagtcatcttaagaagtcttgcctgggtctttgccatggtcttgctaaagctcttctcttttttattctttattgtaccaactcccagtccagagctaaccatgcacctctcttcagtagtttctcactgtagcaaatgaggcagagacacattgcactgcccaaattgttcctggccttacatttctaagtatgccagggccttgaataaggtagttttgtccaatatctttcattgtaacactgatgagaaataaatgtaattcacagccagggacactgtctggagtgttcacatcgtccccatggctgcatgagttttccctgggtactctgtttttctcccatatcccaaagatgtgcccgttaggtgaactggcatgtctaagtgttcccagtctgagtgagtatggtctgtgtgagcgtgcccttcaataccatagcttcctgtccagggctggctcctgccttgtgccctgagctgctgggataggttccagccaccccagccctgaactggaataagcaggtgtattagtctgttttcacgttgctataaaaacactacctaagactgggtgatttaaaaagaaaagaagtttaattggctcatagttctgcaagctgtacaggaagcatggctgaggaggcctcaggaaacttacaatcatggcagaaggcaaaagggaagccagcatatcctacatggctggagcaggaggaagaaagagcaaagagggaaggtttgcacactttcaaacaagcagatctcatgagaactccctcaatatcatgaaaacagaaggggaaaatccacccccatggtccaatcacctcccaccaggtccctcccccaacattggggattaccattcaccgtgagagttaggtggggacacagagccaacggttagaaaaagaatgaatgaatgaatgaataaatgaatacaaattattttaaaataaaaatctgtcatgtgtacaataatcatacaaatacatggcattaaatgaggcagtactaaggcactccacaagccaccatatttgccatggtttttgaactacacagtgggaggaggtgctccttaaagtgtttactttgcaaatgttcattcctagatgtaacccactacccattctgaccactgtctcgcagctattcaccaaaaattgggttaataatcatcttgttttcatgaatttttcttaaatgaatctgtatcttacatttatttccatgtttaatattagaagtgcttcgagtgtttatttagaaatttggtgatgttttcataaccagaaatatgccatgggaagttaactcttgtttatatcaattagcccagggtaaaattggttttgttatacattgtttaaagtcacagtttccaagaatctatcgaggatgttaagtgtgaacttcaagtacttgtccacatatccacagcccgctgccctatattccaatcgtactggaacccagttacttaaacaggttttgtcctcacatttgctaagcctgctgacactttttctccctctctgtgtcctccttaattttcacttacagaagttccaataatctcatattttcatttccgtatccttttccaggaccttccttcacatgataatctttcctttctcaataactccttgcagtacctcaaatacagaacatattgtcatctactgtatgtgttatgcctcctccaccagcatcaatttctgataagaaaaatcacattttgtggccaagcgtggtgtctcacgcttgtaatctcagcactttgggaggccgaggcaggcggatcacttgacgccaggggttagagaccagcctggccaacatggcaaaacaccgtctctactgaaaataaaaaataaataaataaataaataaaaagtagctgggcatggcggtgcatgcctgtaatcccagctactccggtgactgaggcaggagaatcacttgaacccaggacgtggaggttgcagagaaccgagatcaccctgctgcactccaacctggatgactgagcgagactctgtctcaaaaaaaaaaaaaaaaaaaatatatatatatatatatatatatatgaaaaattacattttacttatctttttactatacacaatttctaatttaagctttgcacatataaatatttaatatgtccatgtaaaattgaataaaactgcaattataagggcgttttcaaaaatcacaaatcaccacagaaaatcacagtagaatgctatcaaactacagcaaactataaaaatagtagcatgtctaaaatcaattgtcttcttcataccagtataaatatgtgattgaaagttatttccccacacactgtttgcatgtttttgtaatacacctacctgttttgtcaggtgttctaccaccagatgtgaaatagaacactgtgaggatttacttggtttgttataatatcttatcattccttgtaggaggtagaagatgaggttattcaggtgagcttctgtgtaaggcatgcctaggccctggcaaatctggagtgaaaaaccagatgggataagggctgaacatgagaccatgctacagagacaggggaaggacgacattttagacgcagtttctaaggagactcagaattcacggaagctgatattggagcatcctatcagttcaggtagagtgcagacgttaaaagtccagttggccaagggatatatagcattagttctcagtgttgggggttagaatgttagaatcacctaggtttttttggttttgtttttgttgttgttgttttttttttatctgggaagcagtattttaaaaaagcttcctggttccctgcttagccggaattaaaaaaaaaacaaaacaaaacaaaacaaaaaaaaaattacataaaggaattaaacagacttaaaggtatgagacatttgtccaaaggtgcggtatcattgcaacagacctgagatctcagtacagtaaccctgaatcccagctgggagaaaaataacttaaagctccggctgggcgcggtggctcaagcctgtaaacctagcactttgggaggccgaggcgggcagatcacgcggtcaggagatcgagaccatcctggctagcacggtgaaaccccgtctctactaaaaaaaaatacaaaaaatcagccgggcgcagtggcgggcgcctgcagtcccagctactcgggaggctgaggcaggagaatggcgtgaacctgggaggcgcagcttgcagtgagccgagatcgcgccactgcactccagcctgggcaacagagcgagactctgtctcaaaaaaataaataaataaaataaaataaaaatattaagaaaaaaaccttaaagctcctagaagagtggagctgaggctacttcaggtcttctctcagtctaggggtattaaggaactagaagacagagaagaaaaacacagacatctatgagcccagctgcgaggttgctgggtaaagcggagacagaagggacaacatactcaaactttctggagacattgtgcctttaatagcctgtatcttgttaaaaccacagaaagtactgaggtatgcccaatattggtgagaattctaagcagggatcttacatgattctgttcctagctcttctcactctctaaaatactttgttggctttcctcataataattctgattcttttacatttgtctttgtttcccagatcttttcagtatactgtgccaaactgtggatattggcttttctatattccataaggcaattctaataccattaccaaatttctgctgaaaacttaggggctaaaggtggttgggtatgaatagtagccattataattaagataactgtccacatcttcccacatatgcccttttcggtcatatttgtcttcggatcctgtcccacatcttgttaatcatagggattttccaacatcaaatctccatcttctgtcttcctgactcctcggccacaaatgtaattctctgatttgacacaccacacacacacacacacacacacacaccccaaacaaaaaaacaattctattcctcatttgtctcaactatttgacattactctgatctttttataatatacctttagaaatatatatctgtgtgtaaatgtgtgtgtgtgtgtgtgtgtgtgtgtgtacttttgagaccagaatgggctaaggaaaactacttatgaataaatagaaatataatgatttttgtagatatatttgtgcgtgacacttgacagtgacagccttgctgtaagagattctgcatgcatgcttaaaatgctgctgcctggtaaatgcccaaatacttccaggacgaagactggattttgaaatggctatgagtgtacaaggggaaataaacataagaataaaaaacgtgagtggagaaaggaataacatgaaccgacttaatatcacttaaaattactgggtgcaagattaatcatcatcagcattttgtaaagcgcagaaattggtgtttcttataaaccattgaaatgcaaaaataatgtaaatgtaacaatattgctgatgcatttcccttatattgtcatccacaaatttcttagaaactggttttaagtcttaaaaggtaaatcatgactatcttgcaatcttaatattttccaaattatattagcttgtgcactaaatttattgcagcttctgtttctcttaaaggaagtgtaaacttcctcctcaccttactaccccttgttagcaaataaataaaaatgttttctatgaaagtaattaatatcaacaataaatataaattcttaattaccataatgatgatatactagcataatagttattaggtaaatgccagttaattattaaaatatatgtttccctcaaaaatatatgtttgattcagtgacaaggaactgtgctatctagaaaatataaactaagagcctccttagtatcttatactacctttgatgatggagaggtttggtgtggttattttcagaatggactgtccagtgggagaaagtttggatgcataggtttcttatacttgaaatgatccagagaaagatgaaaatacaaggaaccctatgtggtctaataattaaagcttaaagtcaaaatctggaagctaggctaaatatcagaattgtttattttaatgagttagaggttgaaaaagtattttgagctcctcttttgtttgtatccccttctgctgaagctgttactggtggataccaatcacagagatttcttgaaagcattaagaaaatgaagagaaagatgcttttcaccaccaaattctatgttaccattgctatgtctcccttttttttttcatctctgccttgagacaatttctttagcaggatagaatctctgataaaatataatgataatatataatgaatattatacattagttcttacagtagaaaaatgaatgaaacatgggcattctttacatttacaaagcatgagcattataacagcagctttaattaatgattttttcttgttgctgctgctatgagaaaatattcatttaagaattttatttctactgtctttagtcctcagcaaatgctagagttagagacttgttgttttcgcaagtggtctgagatggcacatcaccatcccttacaagcaatttggccttcattacaaattaatgaagtgataattgctccttgcaaccttttatgtgcaaagaatgctggttctgtttgcattatcttcttgcaatgtacacctctgttttcaaggacttgtggtatcttgccaaatgttaaactacactgagatctccataattaaaatcatattttacatcaagttatgaaaacctctacacaatatgttctgtttgatgtccagtaaaatgctgttcattgcagaataaatttgcaaatgattcatcaaagtaacaatctcatttattactaaaaggaaatcttgacttaagaaatttaaagtcaattggtttacattcaaataatattgtcatgatcgaactttctataagatggttatggaaagcatttgttctctagagtttttgctacatctgtactttaaaatgccattgtagaaccaaggtaatgttactagagaagactctataaaacactaacttttaacaccagagatttttggagcaccaagtctgttgactgtttttttatattcaacatatacattcattttgctttgaatgtgactgtattattataggcacctcaatgtaaaaccctaagaactgagacgctcagttgctcttatcttcttaaaaactcagtatattacatacatatagagtggatgcatgaaaattgtatattggcaattattacaaatataatgtgaatattttctttccttaaactgaggttagaatgtatcttgtatattacttctgagatcttctaaaatagtctcaacttgtttcgttgttgaatctcggatgtgacaatgaagctaggtcaattttgcctccagaaaatgagtgcctatcttgtattttagatcctgaacgatcaaggtttttaaaataaatagtgctgttaacttgttttgtttgtaagttaataggtgagctatgaagaactagaagtttttaaactgtgattgtcacaacagtaaagttcacaaattgttttttataatttaagaatttagtataaaaaaatttcccctaatgaggcttaaaggccaaataaatgtcatgttcctttgtttgtaattaccgacaatttaataaattaatattttattttattttgtgattagaaggtgtgaattaaaatttctgtgtctttaaagatggcaacaataaaaactagggactgctgaaggagaaaaggagggaggcaacaagaattgaaaaactaactgttgtgtactatgctcacaacctgggtgagaggatcaatcatactcaaaacttgacctcatgcgatggaccaatgtagcaaacctgtacatggcccaaactgggaaaatattcgtacagatgaattttaggcagtagtattttttattctttttttaaacaaacaaacaaagcaaaaaacacacaagaaaatcataacatagtgtcaatagaaatagaaaaaactgttaatgcattttatatgctgttgatttagttaaaagtgtttaatgtctattgttcttgatgaaaattattaatgctttattggagaaaaatgtaggaacacatttataatgggcttcacaagggttttattcataaatttaactacaatatttaaatatatttaaatattttctctaagaaaaacgttttgttgtattcccatgaataactcttacttataagaaaaataatatttgtgcatatgccaaaaggtgaagttttgtgctccatactacagtgaatatgaagagacctgcctaaaatttagcaaatgcctatgaaacaaaattaaactaactttagcatgtatcatgaattaaatttacaaatgaataggggattcaataagggttctataatacagaaattttcttaagattgtcagggttatggaaggcataaggcagaagaatgcacagtcccatggggttataccgtaagaaaggcatattccagatgggcacagtggctcatgcctataatcccagcactttgggaggccagggcaggtggatcacgaggccaggagttcaagatcactggccaacatggagaaaccccatctctactaaaaatatcaaaattagccagttgtggtgttgggggcctataatcccagctattcaggaggctgaggcaggagaattgctttaacccaggaggtgaagattgcagtgagctgagatcgtgccattgcactctagcctgggcgacaggagcaagactctgtgaaaaaaaaaaaaaaagaaaagaaagaaagaaaaggaaggaaggaaggaaggaaggaagaaagaaagaaagaaagaaagaaagaaagaaagaaagaaagaaagaaagaaagaaagagaaaaagaaaggagggagggagggaagaaaggaaggaagggaaagaaagaaagaaaaaaagaaagagaaagaaagaaagataaaaagaaagagaaagaaagaaagaaagggaaggaaggaaggaaagaaggaaggaaggaagggaagattccacaagttccacaagaaaagaataaaggacagaatatccaccacatctttcgtaaacaataaaagagtttacattgacaataatataatatgtggaaatattacttatctcgattcaaacacttagaaaaattaacatgtggtttaggaccagttttaagaggaacacaaatgtgaaattcaagagttagaaagtttttgcgtaagtaacagagatccctagaaaactttacattcaagaatggcatgacaaaagatgtagtttcctgcaagaagtaagcaaaatggggcataagaggaaagtatggacacagagataacagaaacaactggtctaatagttttaggatcataagtaacacacacttacgatgctaagttaaaagcttctcaaaatttgtcctaaggatcacagaaaatagtgcttcactgttctcaaaagtctgaatgcttttaaaggtttttacagtgataaaagttgttctaagataaccttaactgctataacaacaaaaccccaaatatctatctatttcttgactaagaaaagatccaatgtgggtgcaaaaggctttaagaatcgaatgtttgccatgtcttctgtttttcacacataacttggttttatatttggcgggaagctgtggggtgaggaacatttctatttttacttcaaatttttttttcatagttctgcaacacatgtccattgaaatgacagtacattaaaaaatgtcatgcatgatgatacatagtaaaaatatcatttatattcactttattttaccttatatcaattttaccaaaaacctggcacaaattgggaaaagattaataagcatgaattttaggcagtattattaattttttcttttttaaactgagaaaaacacccaaaaacatatgagaaaataatattatagtgtcattggagacaactgatttgaggttttgatcctggaatgtttgattaggctctattaactgctaagtgtctttttcctgaatattcaacaaactgtaacgcaattgaaatgtgttcatcaaaattataaattactttatgtccattaactcagagaaccttgcaaataaaaactacaaacaagaatgtttttaatgagtaaatgatgatttattatatagagatggctctgacacccttatgttgtattcgttattatcattaattctgcctcactctctgtttctctttgattcttcagtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaaggtaagagccttctctatttttctttgagcaatatttctcacctatgagtttatcatagtgtcattaaatgaaatgcactcagtctcaactcacttggcaggaaaacatgcctcaaactgaccatagtctatttatggactaaaattaattccatttgatgtggtaattcatgctttgctgtagaaatattaatgtatttgattatacagtgctggcctgcaccctgtaataggtgttatacatgctatatttaagtttttctgctgtttaataactaaggtaatctaattctagaccacctggaagaaaaacattctatctcttttatgtagaaagttgagaaatctttagcactcagctaacctaattctaacagaattagatactgtggtggttatttatgctggtgctcatctatctcatagcaatatttacttcattgctataaagtacagtcttttcttcactgacatctgggtatcaaatacatgtttacttacaagagattagtgcttttagaagattatttgatttaaaaatccagagctgatgcttcagtgtttaatgtatacaggcatgatttttaagtgtcttttgcaccatgatttggctcgttttagtgctcaaaaattatttgtatcatccgttaggcttgaatgcatatttgatattaatataatatcacagaactagaactctttaatcaaattaatatttattaaaatcgctttatattttaagtggaatcaattaaaatatcattttatataaaattatgtatatcagctgtgctatatcatatcataatttcacttaatcccaaaatttacttagcattaggcaaggttttatgcttaagaacacactaaaattgttactcaaattttaaataaataaatatataggagaagttaagtatattgtccttgaaattttgtccattttaatgcccttgcttgctgttacactctgtcaagtctggtgttctactcctgatcgcataatcagtcacttttctcaaatgcaagtggaataaatgagactactttgcatataaattgtcctctttaaatctggacagaacataatattttgcttttgactgtagacatggttcacagaataaattcctcttcctcttcctcttcctcctcctcctcctctctctcctccccctccccctcttcctcttcctcttcttctttttcttcttcttcttctccttcttcttcttcttcttcttcttcttcttcttcttcttcttcttcttcttcttcttcttcttcttcttcttcttctccttctcctcctcctcctctttcttttggctaggtaggataggaaaaaagaaagctaagaatagtaaatggtaaatttttctctttcaatgactgtttagagagagaaaataaaggagggtagaaagaaatattggcgactaaagaacgatttaagaatcgcatgccaaacaaactccaagaagcaccaggaaggtaaagagtacttattacaataaatttggtgaaatagaaatgcatataaaaataactatgcaagcttaaactgataaggagtggtataaaaattagtaaggaaggtaagaaaatatgtgtcataccgtttactaggaatttatctaatatattttaaaatatgacttttatttaaatacattatctctcatatttgatgaaagagaaggatactgtaatatattttctttaatttaccatgtatataacttaaaatttatttggaccatgtttctgggatctgggcagacttgctggattttgacagcatggtcaaatggcaggtggggttgtttttttggggaggatgttcataaacctccttttaaaagggtaacactgaaaaattaaaattataaagtgacatactaaaactgagtcatctggcattcactttcaagcattgacaatattttacttgattttttcatttggatatttcatattttttagatcccagcataactcttcttactggttttctctttttaagattggaagtgtgggaaaattttgtattaataccaaggaaacatcatgattttttttttttgttctttttaatccagcctaatgaattatgttatctgttttggtttagtttggaggggagagatgaggacgctaatggctttttatatagtcagttaattacatttgagccagatagcagaaggttactataaatattccttctcatataaactttgtttagacttagtgtaccaaataccttattaatgtcactgaagaatttgttgctctgtgctttatctctgcacattcattgtggaatgctaactttattccttcttcttttacattagcagctaaatagaaaagtgtgtttgatgtgatgtatgaagacacctagactttttgatgactatccaaaattatatttgttttacttctgacttaggataccagttcttactctccactcatttctctgttaattcagaaactcttaaaacagctgccaaagtttcaataacaggataattttaagactctgcttgctctgacagaggcgctagagaaaattgaaaaccttagtatattcttcacacctactaagtctgtgtgcacaatcagaaggcaccctctggaactgcaaggtgctcatgagtgtgaatgaactcagaagcattcctttctagttgttttttgcctggaagttccttaaggggagacaccagaaatgtcttttcttagaaacatcttgcttagaacatagcagaatctaattgagtaggttctcaagtagatacctataggatgtgtaattactgtgagatttctatatttctataccaactatccattcttagaatagaggtcctgaagagaatagactttacattatttatctttgattccactacgcctttcagaatgcattgcaaataaagatgttaattttatctaatttgaaataaacatatttgattattaggtcacatacagttgcagccaggcaataatagattcatctgacttctcgttagaataacgaatagatgatgaagtaaaggaataacaaatatttttacggtaccaaagatcatacttttttcttttatgaatttatgatgcatattatctttctgctttaaaataatcaattgtttctagattaatacctgtaataaagcaaccgtctaaacaatttttgtagatgctgaaataaatgtggcatttttgtcccttaaatttactgatctagtgcttaaagcattggctcacctcgtaaagactaccctataattatcgagattcttaccttcggttatgaaaaatttcctttctctgaggttaaaatgacagctgtctatttcctctttgcctttagcagttatacatccattgtttttccaaccaatgaatttatttaaataaaaagtatggcactgataagtaataagataaataactttaatataacaaattaaacagatacattatagctttataatagctatcaagcctctgatttatacaagattctatgtcttctcatcaatttatgtacatgagcctaatgccaaaaaaatttctgcacttgtcttcaaattacagtttgcatttaattgttctatttagccaaaagctcttgtcactaacaagtgtttgagggcttgggcttaggagtcctaggaatgcagcttattaattttgtggctaaacattttgagccttagtttcttcatccacaaaagggatgggcttcaaaatggccagtggatgtattgcttagtccactgcacaatatacagcactagacacaaggtatttgaacgtcattattttcagtcatcagaatccctgaaatgtgttaccttccttgttttcttgtttcaatacattttagaacatttagatatgatgaaatcacccattcaacagcttaccttagaccttagacatattttaagagataaaacatgtatttaatgaatgtatatatttgtgtattcattatttattcattgattgcccaccttcttccaaacaaggatccaaaaggattgtgcttttctaaagagacattttttttgttcaattaaacctctagtctattaaaccatgggtgatatttcctccattatcttattgttaagtgttatttttcttccaaacagcagtcacgcttgatttttcccatctggtattggactcagtctcttttttttcatagtatgaatcttcccactgatttttccaaagtgccttgagtttataaatgcacatttttatattgtatattcagaaagacttttaggttttaactggtttgatttaagaaagcatgatttaggaaataagcaaacaactgcaatgcaaaaataaaattaaaatgctacatctcaaaaatgttaagcctaggttttgttcatattgtgtttgtgtcctaacattccttctataaaagacgagtttagttagttggaaaggatataccaataaataatgcccttgccttgaaagaatcatgtgaatcaaaaataagtaagcaactaagaaaaagaaaaatatatctgttgaaacatttcacctgactctggatagagctaacttatctatttactttgctttaggtagttattatgtatacttaagaatggcccaaatactataaaggcagtggagaagcagtataagttgtttgaagtatatgtcaaatgtgcttacacgaattattattatgtgatattactggaaatctgtgatcaaattatgtgagtgcactatctaaaaagtagttaaagtaaaaacttattttttaatatgaaaagtgagagaaagcaagggaatatatttggtttgtgacttcttaaatattgtagctcatttttgagtctctataaaaacaatataaatttaaaccatggatttgcaagtttaggaaaatagaaatgtgaattctttgttctgtatatactgcaaatcagattattttgaacactcagacacaatgtaattgcaaacatgtttaggagaaatatgtctgtggttaaatttagggagtagagcaaattcatatctaagcatttgaatacctcgtaatgaataagttaaatgatcagcaatgaaccactataacaggccttaaaaatcacaagaagttccataaatgttagtaacattcttacgcaggattacaattaaataagacttacagtgttttagtaaaatatgaactgttttaccttatgtgggttaactttagtaatataatctcaccaattctgttcagagggaaaaaatcttaaaacacattttctctttaaataggcatttcactctacttaatcccaacctaaaagatgattttataggtcattattaaagtatacttctaaagctctaatttaactcacaggcattccttatcaaatggctgtggggtatctgctttatagtatcaagttcttttcattaaattattattcttacactaagttctttgggcttttagatgctttgactggtctagtgtttcaaatgtgcaaatagtaatttaggtaatatctatatgccaagtgtataatctttgggaaacataaataatgtgtccattaagcagtttatttgtttgagagactatggtaatgtatgggttaatcttcccaggacagtattcactatgagcatctgaggcatcagaaaataattttggttgcagaaaaaaagtagctctcattttacttgaaaggggttgtttccatcatttcattttcagttttctgtccaaaggaagatagaacattgctttgtagacaactcactaaatatctattaaatgtaaacttacctgtaaagtgattgaaattgtccaagaaaaagacatatctaaacttcttttttctgtgaagggtgggatattggttattgtgaatatgtaaaaattatagttctcctatcatcttaatgaatattatcttgtcagctagctcgtgaatctgccatcataatttactgtcaaggctggttggaccctaaagaaagtcttgaaattccttttctttaacttaaggtgttttatatggatgaccttccttagctctgatttgctgcgtgccactttgttaaacaacttctgttaaagcatacatgttatataatttatggcttttgtaaagaacattcatcttcacttcaaacttatcctttttactctaactattcagatactataaaagcttctgtgttttcaactttcaagatgcaatgtaaccatgtttttcagaatacatgtaatgattccagagaatgattattgatatttcattaacttttccagctaatgtttcattttctttagtcaacttcttccagcgtaaggagaataaaaccctatgcaaaataaactgagaactagatctttttttccctcctgatggacttagattctgtgaaatatactggtaatagtttcacaaagattgctttgtcaatgcagattcattgaacactttccacctttttttcctgtgatttctccacccctttcacttctgtctgtgtttagagttttgacaatcccttattagttccagagtagaacttatgagagctaataagggtttacattacagctctgacagctggcactaaagtttaatagagagcaattgtaaagaagtataagtgttgataatatttgatgaaagtgctcttaaagaaagagccttttggaaataatcacataactagaaaagctgcatatatgctctttttttgtagcttctcatcttccagtatgcggacaaaacatcctgttggcagatgactctgtaattgcttatggatgccttttctaggaacagaatccagggtcgttaaaaaaacaaaaacaaaaacaaaaaaaaactctaaactttggtcatattcttaccgctatttctataaatctctgaaattcatgttaactgtcctttagaaacacaatcataacgtggacatctaatcgcagattcattctgtgagaagagaccccagggattccaaaggcgagtcattgagatcatgaaacccataaaccccacataatccaccacagactttttgtattattaaaaataaacaaataaaaagcaagaatggcttcaaatatagaaagaccctgagtgtaaaatatttctgaattctctattcaatggtcagttgcaatgccacaaaaggttaaaagaaaatgctgcaattgaaaacagctgtggcttttttaacatgaagactaactttcaacaaagagaaagtatatgctatgagatgaaggaatacctgaatttattgtgcaccaggaacatgtaaagttttatgaaactgagaagtgaatctgaatatataaataattggtaaggaacatttttgcttctctgatagttactggagaggaaaatttgtatttcagagatttagattcatttactgtttatctcatacttctacattgaatataaaatatttcaatccatctatcatcatgcataaatgttttatggcatacagaattgattcatgtattgaattggggggaaggaggatatagttctggctgtaaagcatcttggattttattattattattattattattatgctttaagttttagggtacatgtgcacaacgtgcaggtttgttacatatgtacacatgtgccatgttggtgtgctgcacccattatctcctcatttggcattaggtatatctcctaatgctatccctcccccctccccccaccccacaacagtccctggtgtgtgatgttccccttcctgtgtccatgtgttctcgttgttcaattcccacctatgagtgagaacatgtttggttttcttgtccttgcgatagtttgctgagaatgatggtttccagcttcatccatgtccttacaaaggacctgaactcaccattttttatggctgcatagtattccatggtgtatatgtgccacattttcttaatccagtctatcattgttggacatttgggttggttccaagtctttgctattgtgaatagtgccacaataaacatacgtttgcatgtgtctttatagcagcatgatttataatcctttgggtatataaccagtaacgggattgctgggtcaaatggtatttctagttctagaagaagacatttatgcagccaaaaaaatatgaaaaaatgctcatcatcattggccatcagagaaatgcaaatcaaaactgcaatgagataccatctctcaccagttagaatagcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaagcatcttggattctaaaggagatatgaactgaatctatcttaaaaggaggcaagtatcctattcataaggaaaaacatggtctggtaagcatgaaagacaaatgttgtttagagactcataatctgcttctaaagtgtcatcaaagagttaaagagttaaggtttcaatctccatggagtttaatatttcatcatttacccattttttcacaacaacatttttttttttttcgagatggagttttgctcttgttgcccaggttaaagtgcagtggcaggatctcggctcaccgcaacctccacctcccaggttcaagtgattctcctgcctcagcctcctgagtagctgggattacaggcatgtgccaccctgctcagataattttgtgtttttagtagagatggggtttctccatgttggtcaggctggtctcaaactctccacctcaggtgatctgcctgccttggcctcccaaagtgctgggattacaggcatgagcctccgtgccctgccccccacaacaatttatgagtgtctgctataccaaatgtcaactggaaatgtggcactaaacaaaacagaaaaatgttcctgccctcaaggaacttagatttgagtggaaatattaagaaaccacatgttaatacagatcattccagggtattacctatagaattctggagtctacaccagtgttcctagcccaggtgatgttacctccaagaggcatttggcaatgttttttttttttttgttttttgttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgggcaatgtttaaaaatatttttggttctcacagctgaagaaaggggttgcttactggcacctcctgtttagatgccacacatgttgctaaatatcctacaatgcacagggcaatgtttatagcaaagagttatgcagaccaacatataaatatgtagtggaagggttgagaaactctggtctagtttaatcattgtcctttacagatatgtctattaaggctaaaggttcgaattatacattagcagagctcgaattggtacttgacatcttgtgattgtgcttcaggacacattcgttcaggaattttctttaaaattagtgaatttttgaaggcatataaagtcttactaactacttagattattggaaagtgacacctctgcaagaaaaacaaaactaagatggatttttttctgggagaaagaagaaagatttcaggaatagtgacatgaagatggatattttaaaactgaaaaacaaaaagttacctgcaaagagctggttaaggtgactgacgttcagcgggtagagtttcgtagtctaagaactcagaatgcgaatggagtaataaaagagatatcaaatataaagcatttggaggttgagggtgtttccgtatggaaacagttcagacagctgttacagagttagtttcctttgaggatattctgacgtgctgacatgaaatcaaatctaacatttgactcccttttttctgtaatgtgatactaatacaaaaaatgacaggtagatgtggttctattccaggacatattgtgttaatagtctttgtataaaaagtttctatgctttagttttagtactggtcctttgacaattagagtggctcttcgatatcagctgtttcttttaaaaatagccatttctttcctttagcatgtgactgagcttggcacttcatttaatcctctcaacaacatatgagcttggtggaatcatgtctccattttgcgtgatagaaaactggaggcttagaaaaatcaggcaattgtccaaggtcacaattagtaagtggttcaactggaatttgaatggtaaaactggaatttgaaagtggaacagatcgcttgtgtgggaccactgtttcctatgcttcctggcagagagaggctgaggtacctgaagctcatcagcctgctttaccagaaatagtccctgaagcgcagagtatgtttactgtaaggatgcttctcaggatgttattcaatacttttcattgtgtcctctctctgggaccaatcacggacatttacttctgactccaagggtgggagtgattgtgttccttaagctattcacttgtttttgctttttggatattgattcacgtaatggtcatcgtatcttgtttgcattccctatagaagagcagaaaattacgtgtcttcctgtatctgaaaaacatacatagatacgctctcttaacatgccttctaaatagtaaactcactgttttatttattctctttatgtaccctttttggtctactcttcaccttctaaaatgtattttattgtaatctattccatcttgaattgtgggaatgctttctcaaatacgaaaagccatacatacatttaaattactatttattgattgcctactatgtacccagtgaggaatataccatttgatcctcaccaaagccttacgaggtaaatcttattatcgttattttatcagaacaggtctaagaaaatttactaatttgaccagtgtcacaatgccagaatgtaaattcaggtctggctgactctgaaacctgatgcttttcataatataatatgtcaataattttcatctgaaatgcttctgcaagtcaccataatgagaaaatttgcaagttcctgctgccaaggggatggttggagaaattggttataagagttgagaaaaaaaagattggcaatggtggtataaaaaggcaaaaacctcatattaattagcataacatctctttctttaacataggattaggtaagcctctaacacgcaaatcttttcacagggcatctctggcctttattttctaggcatgtggaactgagccacacctctaattgcttctgcttctgtttccattgctcctgctgttgctgaggacatgattgataggagatgatggctagtggagaaccagggctcagaaagacacttgctatgtgcccaatgtgtatgcttgcacaatatgcttcattattagcttgacagatctccaagtggcagattgggaatgaattttggacctggctagcatttctgttacagacattgggtttttaaaaagctcataaatacatatacatatatatatatatatatatatatatatgtatatgtatatgtatatacctatgtatacacacacatatatacatatatgtacacacacatgcatgtaaatatatatagatgtacatgcatacttgtgtgtgtatatgtatatagacataaaatgcaaaataatatatgtattatataaatatatataaatatatgtatgtatagatgtatagatatgtgcatgtctatacatgtccatacacatatatgcacttagcactatatacttagtacatatacatttttagtaaatgtgtacttataagtgtactttaaattctttgtttctaaaaaattgagaagggtgaaggctgtaataaaatatcacatcaatttctggtggtattggactgctgcacacattcctacatttcttttactgcttttagaatgaggcagcacacaaaatacgttaataaatataatatgtataacttccaaaacttgaagtggtaacacatactgatgaagctttacacttcattaagtaaatgaatgtgacttaaagttgcagacttcttaagtatctgacctggttgttctatacaaggatcatgtgtggaactaattttctttgaaaatgttattggtgttatagattacaaacttttgtgttgctgttaaatatttcttagtcttttaacctttacaaaatctaaaagcttatttaaagcaaccctttcattaacataatacaactctttaaaaacactgatagtcaagaacagaagtaattaccaggggctttcattgtttatacttgttatactttcatgacaacatgtatgctgctttaaaatctattttttctcctttttaaaaaactcctcttacgatcattcccagtaaatcaaaatctctgcaagatgatgggtggcatcatggtgttctatgagtgcttcagtgcggaactattaggaaagggaggctgaaaggaaatgctgactccatccttcatacggttgatggttgctcttattagagatgaaaagaaaatgagaaaatgcattggcttgctttttattaagcacagtaggtaaaacagatgaatgcttgaaggctcattgagctgccataaagaaatttaaacattgttcatattggctagtcgccaggctcatgctgtaaactccagatgagggtcatgattgcagaggaatcgtcagctctattggtagacagtttctgtacgttcctagactagtaataaacctgagatttacccagcagggttggtgggattatgtttgttgtacatgacttggtatccatcttaattcctacaaaataattaagatttcttagcataaaatgatggcgtgacttgactttatacatttggattttgtttgtatcattgtattataataccttatatgtgtgaataaatttagcttcctcatatgtagatctagaataatatctaagagtaagagtggagagaaaatcgtataataaagtactaaaatatggttagtaaatatggttctaaaatatagtaacgaattttttaagttaaaaaataaagctttgttatcattataatttgtaatctttctaagattaacagtgtgctttccacttctttttaaattctttcaatgcctggttcaaaatctgaacacagcttttgtgtgaataatgatgattattttatcgatcaatatttttgcttctttattaataaatgtactataacaatatctaacaaaaaatgtgaagcaataagaaaaggtggataactttcttgaacataggcacacatgggagatgtaaacctggacatttgttacactctcatttgtagtttatttcagagatttatagcatctctcctatctacacaaataatttaccatgaaatttattcaaaattaagcttcataaaatagagacataatccaaatatttggctgagtgatcatgcggttgactaaatctttaaatattgaggttgccagggcaaatgagttgggatagttaatttacaataaaatgataaaagaaattctgctgtattaggtaacaccaaatttgccttgtatcagtttaccttttttcaccttcattttatttttagaaagttacaaaagaaagtaataagaaggtaactgtttttatttctgaagaaggaagatggttagaaacagccattaatttctattaaaggtagagatactcttataaagcatacactttttggtcagacacggtggctcatacctgtaatctcagcactttgggaggccaaggcaggcacatcacttgaggtcaggagttcgggactagcctggcaatcatggtgaaacactatctctactaaaaatacaaaaattagctgggagtggtgtcatgcatctgtaatcccagctactcgggaggctgaggcaggaaaattgcttgaatcctggaggcggaggttgcagtgagacaagatcatgtcgctgcactccagcctggtcaacagagcaagactctgtctcaaaataataataataataatgataataaataataataaaaaaataaaaagcatacactttctaaatactctttgatgctgaaaaatatagacgggaaaggttaaagagtggctgtgattagtgagattagctttccagtttaaataaaaatttagcaatcaaattcagttaaaaagaaatggattactttaaggatgtaaaaatgtgaaagttatttggaaattatcaagttatttacaagtgaaattatccatcttggaatagctatgttaagatctaaagacgtgaaggtagtaatttgtaatcacattttatttgctattatttattcactggtcagtcatggctatgattatgtgctactgcttcgatgcctgtaatgatcagaaaaaaaatgcctttataatccagtggattctatgactggaaaagtcagtgaaaatattctatgaatcctcggaaaatactctttacttactccaaaagattttggtgtgttcgaaacaattttctaaaattacactagatacgaaagtaaaccttgtggaacctttacattttcaaccaactgtaccatgttatacatctcagcctgttgcatattgctacatttctcttagcttaatagctattgtgttctctaagatggtgccagtttataaagtttggtcatagtagcctaatgtattttcaaagaaagttgcattttttccccaaataattttacagaaaacgtctttggtaaaattgctaagtgaggaacacaggcttacaaatacatcccctaggtatgccataagttcatagtgaagttctttacactttcaggaacactgaggctgcagtcagagcctaccctattttaggtacatagttttaatatgctgagtaatttggtttcaaagctcataggagatgaaaatctgaaagttgaaaggggtaaagaagtacatagaatgagtatagtaaacatcacaattggcagcctgagaataggaaaagaacccaaggggctatgataacatacacacgtgttcaagttacatttgcctggggccactgtgggaccacagtcttctatgcctcagtaaactctgagtgttcacaggactgcaaagtacataaagcaaataaaaatattcgtagttgtggccttgagacatcaataaatgtttaaattatattcactccactctggtaaagaatcaaattgttatataatatattttatatttcctccatggaaaacaaagattagaaacatcattgctttaatcagtataaatggtatataaatcagaggtcctcagggtttagcttggctctatcccttatttgctatgggactgtggacaaactatgtaaccattctgggtcccagtttcctcacatataaattggagctaacaagagataacaatagcatctccttagtagtgtcattgagaggataaagtgacatcatgtttttaaaatgttcaacacaggtcctggcacctaacaagtactttataagtgttaggtttatcataagagggataaatccttactatggggaaacgttagctatctagaaagtctttttcctaaacgttccaggaatccagacaactgaaggtttattatacatcaagtaaaataccaaaataaacaaaataaaatttcactaaacagtgtacaatttgtcataacatacagtatttctgcactctaatttaagagctcttcaatttttaattatatttagaacttcaactgatccatgattggataggttttcagaattaaataactttacttggttcagtaattggttctgatggtctgtctaacatggttcaggattgtttcttttaaaacaaggcatgtcataccattctgaattccttataaattctgaattaccttgctgtgacagtattttttttatcatgtagaaaaccagtccttattcagcaccagataattagctactttgcaaatgtcatgacgtttgaagcttaggcatgattactgagacttaatcacactaaaatccttcatatacattccattgcataagattgttgagtataaagtggaggtgcagggatatagatggtgatgtgtctatgaataggtaggaaatcagaagacattttgaggcagacagagagcacatacaccttacacaataaatttggttaaacatagtcaaaagagaaaaaccagtgaagacttgttactcaggtgtccatcaatattatatgcaaacgttcagtcaggtatataatcagtaactgtcctgaatggcatgtgtattcatatttttatatgttaaacatatcatttctacatttactttttattttttcctctttttctgcaaatagaccaaagttctcacattgggaaacatattatggctacaaaatgtttaatcatttttaagtgaattatttcaaaatttctttgagaaacaaataacagctactctcttggaggttctgaaaattgacttcagacgtgggatgtagtcctgtttagatattgaggatctaagcccaagggatcacttgcaggtctctaatccctcatggatgaatcatgcatttcctgtgtatttcttgagtaaatattaaatcgaagtaaagaacttgtacgttacgagagactgaatatttaagtcggtgtttaacacattatggaaaacatgtataagtcatggtataaatgtaaatcctggaatgtggggcaaaatttctcaattaccttgtacatatccaggaacaactagtgagtcttctatttgtgcatagttaggtactggagggtgattgattcatagcttcacctgtgatttcagaaggctgagtattattatttttattaatttaaatacttcaggtaaattcactataataattcagagtaaggatatcctagaacatgatggctgttattttgggcagtttatttgtaacgttccatgtccaagaatgactcactcttatattaggttgtttaaattggaaaggtcaaatgacttaagcttccaaaaattggtttggcaaatttcacacttactttcagcattgtagttcctttcaccaaggtacatgcatgttagggctctatgtacagagaatttacaaggttaattaaagtgtattgtgcataacacagtcgtttagttggtagttcaatattatgtttggcatgtgtgataacattgcagagtagatctgctgtaactttgactttggtatccttagttagaaacgactactctggtagacacatgctccccagataaaatgcctactcagattcactgttaaacaataagaaaaatagtttctgctgaaaactgtttcatccatgggttgatagtcacggacagagtgtgtataattggcaatgtgtatttaagtgttctacaaaagcagaaaagaaaactgaatattgaagatgatatagtgttcctttgaaaaaattggacaaaataacaatgagaaagcctgccagcacagttataaaggattaatttcctggtattcacatacagggctgataaatatagtctatctacaacttcattatgcatagtgctcttgtcattcaacgtgttagggaatgaatatggagaagcataatgacaatgtcatattgatttacataaaaattttgtgtgtagaataattatatacactatcatatggtataaatttggaaagataaatgctatatgcagtcacgattttaggaattattaattttatatatacatactgattaaccattaaggcattatacaaaatactgtgtaagatgtaacacctatgaaaaatgtgccgtgttctctagatatgttaaatctagtggatgagtaacccataaacataccagagaagtatgtaaggacgtatgaatggaaacatacacttgatattgataaccaggaacgtaaacatttttttaaaagttttctgaagcccagagagcagcagttttcaggctgaagtacatataaactaaagattcacagagacttcccaaggcagtacatgagcttttgtggtttaatggaaattaatgtttatatcctcaactttcatatgtagtgaagttaacatgtgtgagaatttgactatgtttaagccgaagctcttaagctagttctccttcctcacttcccttttcactatttctctttccctattttctacagaaaagcattcttctcatttttctgaaatcttgctaagatgctttgttcgtaggatgtaagtgctaaacaaaaggaaattttaaaatgtgttaagagtgtgaatgaatgtgaatcaaattacatttcaggtcaagtggtatcagttcttggctctgattcaaattgaagaaagacttactaaaattgtcagtgaataaagaagtaaaaatcactttagtgataaattactctgtaatttagcatataactcaagtttgaagaacttccactactatagaaaaactatttttattcctgcctaattatttatgtaaataagattttctggtgcttgcatttataacaatgaaaactagaaaatgaattgattttcagtgcataaaaataagttatatctatcttaaatgggaaaaaagcctagctcatctcagtatgacatcaatttctaataaaaattttattttaattaaaatagtttaaaaatatatatatttaattaggtttcatgagttatttactaaaaataattataataagaaaatttaggaagacaatttgcaggcttaaagcatcaaaatttaaataaataaactattaagttcaatttcaatatttgattactgcaatatatgatagattcatcaatatgagatgttcaaacataaaaaatataaatccttagcataatattttaaatggcgagttaattggaaatatgaacccaagggacagaaagcaaacaacataaaagttctgactattaaagaagaacttgatcgtttatttttacatggatgacattgagttacaaagccttggagtatttagattccattgggtgcatttaggaatagtgtaactgttttattttaaaatgtcaattttagaatatgttagaaatggcataattttcaattgtttacactcgaggaaacattttacataccaccttgaaatatataagtcagtatgtatgagctttaaaaattattttagagtgtatatgagtaataaaagttagaaatttacagatctaggctcatcactttatattaccagtgaagagaggaagacccagagcaattaagtaaactcaccaaggtcattccagctctttgtagcagatcccaactagaaggaagggactatggagaatagaaaggtttcaagaagtgggtaatacttaaggtaaaatttttctgggtgaaaatggcctctagataggaggagtttttgcctaggtgtatcatctccatcaccaccaaaccacagaaaatttcacgttgcctaaattatgaatttttgttggaatgtattggaatgcaagagtgcaaagttatgttggaagtacatggttcaggccaaagattttaaatgctcttcagacattgtatgtggagtgagctgtggaatgtttttaagtagagtgaaggagaaaagtagtatgaagctactataaaacttatggatgaacactatggtaacatggttttgatcatctatccaaattcttctttctatagtattatgattatactaaataaaaacaatatttttagatgttgttgtttagttgtttgtgtttcgggcagtatcagggaaagaattttgatcaaggtgctatttttataaaatcaatcagttattactttacttcgctttatcttccttcagattttatagtacatctagatccactggtatggttccacttcccaatatacatatttctctctctctctctctccctctctctctctctctctcacacacacacacacacacacacacacacacacctttgcttttatctgctccccagaagagctttatttcagactatgggctttgttttgatgtacaggcatggtcgtgcccatcattggctttctccatggctaagtatctatgaatctgtaatattttttaataatattatgtttattctgaataaaagcaatatattaatcacacacaaaactcatttgttgtacattacccatcaaattttaaaataattgaatttatgtaatgggggaatagacagtaattaattcttttaataatttgcaatgaaatgaataggataagtttattgacacaattaattttctgtcatttaattggagaaactatttacctgccatttctcttaatatatgacattagtaagttatttattatacaaaacattaatgaccctattagaccaaactcaattaatgatcacattttaggcatgttgttatattatctagtgctttctatattgtttgaatacacatctaaatatgtatgtatctaaatatgtatgtacctaaatgaaaacaacctagattttaggtaaaaccactattttctattaaatacctaatttagagagaaagcaatttgtttgctatttgcctttttccttcttgcttccttccctcatctagctcctaattgtgttgtcactgctcttgtgtgtgtatgtttgtttgcgttttggacaatatagaatagtgcttttcaaacatcatgcagatggataacctggtgatcccgttagaagtgcagtccttaggtttggggcagggcctgagattctgcctttctaacaagctctcaggtgatatgaactttagaagggaaaaaataatatcctttccccacccattataaagtttatggctgacatgctgtagcaaaaacagattaacaagaggaaataatacatctatttaaacaaagttttatgtgacatgggagtcttcagaaatgatgacccaaagatccagggaaaagtgtatatttgtatgcttcagtttgatgaagaatggacagtcatgtagaaatgggattagaaaggttatgatctaataataatggtttacttaacaaggctgttaatggacagttctttttcgtcttccttctttcctccaagtgcagggcaggacacctgtcacacgaagatctgaagggcagaagggaggagagattctttatgtaactcacaggagaaagacaggagaaggtcagaaggtgccctttctgcttgtgccaagatgttatattttggggtgtcgtgttctgagccccaatgggaccacagtttagtaaggcttgagagactaaaataacacatatttccatttgcttataaaaaattccttaaggaattttaattcacatgtatatatttaaagaatgaagagcaaaaaaattggtggttgggcaaggaagactcatttctggccaggctgatagattagaggaagctttattgctgggaggatctggaggccaggctggcggaggcgggagcagcaggtcttaaggtgtgtcttgtcaggtggaacaaactgggtgggaaaggacagactggtgaaaggccttgacaaaccaattatgttggaaacagaaaggtgtcagagtcttcaaataatttttaggagaatagcatgcttgctatacataggttccatgtaaaacaatataaccataccttcttttggagatatctttctattttaggttaatggggaaatttaaatactagtggggcaaggtgaagtttgtaacaattcaatttaggcaaaaatgccacttcttaattttatgccagattaaataatgaaaggcaattaattttacaatgtgttatacaaaatggcctctcaaacttggtaatattcaaatagccaagaagaaattgaagtgctctataattaatcctaaactttgtattcctatactctaagctagaagagacttagctatttgcctatcattcattgaggtcatttcttgtaccaaaattagaaagataacaggcaatgaactttcaattttattgaaccgtagctgttagctctcttttctccctgtacctgaattcatgaataagcagtttccttttcatggtgtcagaaaatgaactcctactttatatccaaaaatagtcaagttgaggctttactaaaatatggtaattttatttcagtatgcaagaccacagagatctcatgtctaaatacttacgttacaaggtacagagacatctcagataacaaaaaggttagaatttaggagaatagctttttgtccagagtatttgaaatatatatatatacacgcacatatatattttagcctatgtctgaagatgaattatttagaaaatcaaagaaatattaaaaagaaaaagtggaaagccttgttcatgggtaactattttttagtgtggaatagatgcaataataatgccatgaactgcaatgcttcccccaagacctacattgtccccccacttttctgcctttggcattgaactagtgtgcgtaaatgaggttgctctttttgtccagttgttaaggcatgagcagcggggcttgcctttggtactgaggctattcatcaaagcttttaaaaatgttttcattgttattgttgttgacatgactttttgcttctacctcccctgctgagccagaccctaagaactttgcaccggctgttgttttttctcatgtactgaattgctgttggtttgaagactgcaaggggagagtgaaaattatatcggttcctcaattggtgttggctataggtcttgcacaatttctaaccaaaggctggagtatagtactagccctctttaagggaaacggtggaaggcataactgagataaatggatgcattttggagtttgtcagctggagtgtatgttttacacatatattcttatggaaaagctctgtggtatgtgatacttttgtaggtctatataatgatgatttgctattttccaagcatctgtatcaggtgcttataaaccaaattactagtgtcatagttaagtgactgagatttttctattctcttatcctttgtgaaggcaggaagtatgaccattttgggcttgcagttaaagtgggtttagtgtgaaagtagaatgattgaagaaaaacagcacaaatctgagtggtaagtcttcatagttacaccttttagagtttcacttcttgtaaacaaaaggcaaataacatagagtaggaatttaacaaattatgccatgaaagagaaaaatgccactttgaagtgattgtaaataaaagatcaatttaattatacagagcagtaaggatgaaatatataaacaagaatataaaatagaatagaaattgcattattgaagtaattctacaaaatcataatatcaacagaaaggagaacttactgtttactggaaccaaacattctggtgttactcattttccatgtgacagctgttttcatgtattttaatcaataaaatctcataaagctctgcaaaactgtttggaaaactaattatttgaactacacagtcatgtaccacaattaatctatgtgaatgttttttatttatatttcactgtttattttggccaattttgtaactgggtaattttgatgggttaaaatttgaaatccacatggaccaatcaaatgtgctggtgtcttccttagtaatggggaatatcaattacatctagaggtgaatttcagtagtgtacttgagttaggagattatgaggctttccatcatgctacagtgtttggaggggatttatttcttcctttcttcctttcctcctttcctcctttccttccttctttcccccttcccttcccttttctttccttccttccttctttccttcccttccctcccttccttcctccctctctccctccctccctccttccttccttccctcctcctttctttccttcctttcctttcctttctttccttccttccttcctcccttctttccttctcttccttcctgccttcctcccttctttccttctcttccttcctgccttccttccctcccttccttcctccctctctccctccctctttcccttcctccttccttccttccctcctcctttcttttttctcttttcttttcttttccctccccttccctccctccctccctccctctctccctctttctttctttctttatttctcttttttgtctcaatatttgtagttttagtagagatggggtttctccatgttggccagtctggtctcgaactcctgacctcaggtgatccacccacctcgacgtcccaaagtgctgggattacaggtgtgagccaccctgcccagcctggattttcttgacaataaatgtaatcctgacactcactgatagatttgtagattttaaaaattttcattaaaagtgcattcttttctttaatactgtttcgacattcaaatagatgaaacaaaatgatttctaataacaatctagagatgtgagcctaagatcagatatattttacataaatatatcaacccatgtgccaattctttactttcttagtatagcgtcgtaataaatcttgatatctgaaacagaaaaactctcattcctgactttaatattatagataattcttgcctttcatttcttcatatgcatgtaagagtgatgttattaaatgccatgaaaatctgtattgagatttttcttagaattctacaatgtgtagataaatttagaaaaaaaagagtatattttcaatataccataatttttcatgaacatggtgtatctataaacctattaaaactaccctattttttcatatgttttatcatttctcttttaggaaacttgctgaattcttaacaccacaatttttatttatattaaaataaaaaatcagtttacatattttatacattttaagaaagtaaaaaaagttacaaactgagagaaattattctcacacatataattgaaaatatataaagaatttctatgtattaataaataaataataaaaagtggagtaaaagttataaagtagaattccccccacaaagcaaacatatatattcaataaacatgggaagaaatgttccatatcattagtggtcagtgacataccagtcaagtcaagaaagcaatgaattacaattttaaactgtttcattgtgaatatatacatttgtttattttagatatttcaaggattgaagaagatgtgatttttacatcttccatctaaatttaatataaattgtaggaatataaatgttttaactactttaggaatctgtttgacattatcatcttgagtaaactaagcctttcttctcctaaatatataccccccaaaaaacccttgcatatgtttagcaaggtatattttcataaagcactattaaaactatataagatctcaaaataatacaaatattattaaaaagagagtaaatgaataaaaggtggtatgttaatacaatgaattactacactacaatcaagattaataacaaatgacattaaaactgtgtacgaaatttagcaatatagtattaagtaaaacaatcaagattaataacaaatgacattaaaactgtgtacgaaatttagcaatatagtattaagtaaagagtaagtccttatgagaacacatggacacaggaaggggaacatcacactctggggactgttgtggggtggggggaggggggagggatagcattgggagatatacctaatgctagaggacgagttagtgggtgcagcgcaccagcatggcacatgtatacatatgtaactaacctgcgcattgtgcacatgtaccctaaaacttaaagtataattgaaaaaaaagagtaagtccttaaattcacatctataatagtaatttttttaaataaaattaaagaaagctacatttttttatatctaaaagcaaaattaccatgtaaacgtgacttagaatatcaatagcccagtgtgtagggagacagggatgaagtgaggaagacaatatgattagatgcatgtagttgttatcaagtgtacattctgcatgatagatttacagatacttattgcagtactgaatgaatgtaattatgaatcaatgaatcaatgcatggatcgaatggataaatgaatgcatggattgataattgaacaaatatgtaaacaaatacataaatataagccagacatggtgactcatgcctgtaatcccagcactttgggaggccaaggcggttggatcacttgaggccacgagttcaagaccagcctggccaacaggccaacagggcaaaaccctgtctctactaaaaatacacaaaaatcaacctggtgtgatggtgcgtgcctgtaatcccaggtgctcaggaggctgaggcatgagaatcgctcgaaccaagaggcagaggctgcaatgagccgagatggtgccactgcacctcagcctgggtgacaaagcgagattctgactcaaaacaaaacaaaacataaatatataaataacggccatacatgagccaatttcacaaaccaaggattatgattaatgtagttctgtgaatttagtttcaatagaaatagagatatccataattgtcacaaaatgttactttttgttgacttttcattttttcctaagagtttctgccctatgatttcaactgacttgtataaaaagttagttggtggtggatgtgtactgttgatatccaagaataacttttatctgttttgttaagtcgtggccaatttttcagtttgtaatgttatgttagatgaggaatgggctgggtgccatggctcacacctataattccagctcttttggaggccaaggcaggaggattgcttgaagccaggaattcaagggcagcctgggcaacaaagcaagatcctttctctacaaaaaataaaacaaaatttaaaaaaaattagctgggcatggtggtaaattcctgtagccctagctacttgcaagactgaggtgggaggattgctagagctcagaagtttcaggatgaagttagctatgattgcaccactgcactccagcctgggctacagagtgagaccatgtctcaggaaaaaaaaaaaaaaagaggatatgacttttacacttaaaaccctacatgaagagaaaagatcaattggctctcagtatattaatgtcgaattccaaggcagaatttttcttgctgggacattttagagaacagcaatgataacatgcaggacaatctttaaataacgggtattcactattcaccagtatgttgattattttctcaaacattaagaaaagtatatttttaaggggaggtaattacgcagtatggggtagccagatggatatgtgaaaataatttctattcactttggtagttggttcaacatgctctgccaaaaaccaacacaaaaatattatataatcatctcatcaagtaacaatagagaatttggagacttaaaaaattttattttgctagtagcttgaaatctcatagaggtatgtgagcccaattttgaatctgataattgaatttttttctaaagatttcaatattgtattttatgcctctgctgttagaaccacagttaagtcagttccagcatgaagaaactattcttctttaaccacagttctaaactcaattcttgagtttaacatctcttactttaggaaagtatttcattttactgtttttaaaatgtggataattgtcatttatgacgatttacctgtaaccaatgtaggtttcgggaaacactgttgcccaggaaaatatgttaaatagtggcctaaaatatggaattgatcttattttctttagagtgttgttaaccttaacaaatcacttacttcatttccataactttaaatgccaaatacttgtaaaacaatagcaaatatttaaaattaaactactcatagtgtttataataaactatactgtggacttgattatattttagggggaaagaaagctttctaagagttatttggtatccatgaatctaccctttattaatctcagaaacagaaacctattgtattctgtctcaaacagctaggtttatattaggttaaaaaagtcatactcagcatggtataaatacatcttaaatttggccacattcccatgctcaagaatatgacgtaagaagtcacacagtatgcgagagtgattaaacatctttaatctttggtccttctaggctttgtagctcaaagtcaaaaagaaagcccatatgatctatctctaactgtatacactgcactatggaatatcaaaagcagtcagtcctcactcaaagaagattgcactgctcaaagtaaatgctgtcttaccatgagttttattgctgaaagcaattcatgtaaataaaatgaggataaagcaacacaggaatatttcaccagtgatttcatttctttccacatttcaaaataacagttgtataatttggataattcctctaattcctactgatttaaggaaatagcccagccaagccaacagaataataatgacaataataataataataataaatcttacatcttagggatattatatcttgctgctggtgctgtaaattttaaaaccaaagccactatttgtgcagtatatattttaacatgacaataaaatattaagttttgaatgaagtaaatgggaattcatagtagcattttaaaaaatcaactaggctttctgaacttgtaactcaggattacagatataaacacatcacagacatttatcaccactattcttctcttttatgaccttttgaaaagaacataatttctcaaaaaaatatttttcagtaatctctgcacaagataatttgccctttttctaatcttcaaagtgacagattgcataggttgagcctttctgacttacatcacagagagtttcatgtttcagtatgctttcctgtctcactggctgacttgattgataatagttgaggtagtgcaaaattaaaaattaattaatttgagtgaattggtaataaagaggactgagcagttgtattgagatgctaataggtctattccagacctattctagccatctgatcctctggaatagccaacagctgtggtaggcaaaactgacaactgagcacattcaagggtaagggtcaagagtttgtcatctaaccccagtggggccaaagcaggggctgttcttcccaagactctagttctgggacaaaagcaggtcgcatggttgaaataatacatttgtatggcattactagaaaatatttttataaaataataatatagtctcagatgatgattttctgttttgttttttgtgtttgcttgtgaattagaactttctgagcaaatttctgtaagtcctccagtaactataatgcctgcttcattcactattttatcgggaaaaagcataattaatgcaattaagactagtagaaaaatacttgactggtattttgctatacatatagtgttatgcacatatttataccagcctaaaatgcaatacatttgtattattttaaaggatgaaaggcagttaattaagaaaattacatttcatgacacatataataaagaatattctttattttatgatagtcaaatatttcaactatccagtaaaccagtaaagtaggaggtttttatatctatcacaaaactaatatatagtgtgtatattttttataattatgcagatagtacccattcatttatgagatttttaataaaaattcagaatatttttagaaaataaaaaccattcgcattctagttaaaattatgatttttttgtctatctaactaaactatagaaaaataatattaaagcagaagaaattatggacaatttgttaccaataaaaataacagaaagcacaactgatttaggttatgaagatggataagctgatttgagacaattgagttcaataattattatagagtaaactctgagaaacaaaattttaaattgaaatgttaaattcagagatgaataaaataacacagtacatcttgaaaattaaggacatggattaaaataatcaaatgaaatgtttaatttttactttataaacgtataatttatcttttaaaaaaattttttttttcatttacctgaagaacacattatataccttgtagcttcctagagatagtgtcaccagcctgttaatttgaagcagtcaaatatctaatataaacattaaaaaaacaccagtcattgcataataatatactttttaatgtctctcctatttgatttctttttgtttttccttaggaagaataagaaaaagatgattagctattttactcgaaacccaattacctccacgtgtctggtgggaattttcacaccacacaccaatcagtaaatcagccaatcagtgttgacctactgtagctaaatattaggtatttgaaaactgattggcatttgccactgactgaatgcattcagctaaaatttactatagtggtggtgatgattttcttatattttagcaatcttgaaataactatttctattacatctactaacaacgccaataatgataacatttctactattgtgtatattaagactattatacctgcttattaattccactaccattactaatacatagcatttattgggctctttgtgacaggcattgttcatttgtatagtagtgtatttaatcctcataacaactctcattgacaaataccattattttctccattttaaaaatgagaaaatctagatggtttatcagtcagtttcttttatcacccccctgcatgattttaagagaatgcaacgtacattctttgtttctcatctgaatagtctattatttcttggaacacaactaaattaaaatacagtatatttcaggtttttgaaacagaagattaaaagaaaacatattttaagaaataaactaattgttttttccaatgatagtttaactttatccccctctcagccccgagattaagggatcatcaagcagatttataaaacctcaagccttaagcttatattgataggaaggtaaataaaattatacttctctgcatcagaaaacaagattaaattgtcctttagtgcaataaaatgctgatctcaaacctaggttgattcttttaaggtgctttctaatcaatgaggatatgaaaggaaatacacggttggcagagttgggaatccaactcaaaatctaaagaagacgatctttgtctaattgctacaaatgattgtaatatgagctgctgagttttaaagtgattcaagtcaagaactgtaattctacagagacaatcattcccactgcaggttaaaatccatagaccatttccattaaaaataattagcaatcatgtcttgggagatacacattgataagaatgtttcaaataactttagaatgactgtaagtttcagtgtgaatacaatgtccaagtgtgcactgcaacataatgttttagtattttcttttttgttgttgtttttgttttgtgtttgtttgtttgtttgttttttgagacggagtctcactctgtcgcccaggctgcagtgcagtggcatgatctcggctcactgcaagctccgcctcccgggttcacaccattctcctgcctcagcctccccagcagctgggactacgggcgcccaccaccacacctggctaattttttgtatttttagtagagatggggtttcaccatgttagccaggatggtctcgatctcctgaccttgtgatctgcctgcctcagcctcccaaagtgctgggattacaggcttgagccactgtgcctggcctagtattttctttctttcttttatttttttattatactttaagttttagggtacatgtgcacaacgtgcaggttagttacatatgtatacatgtgccatgttggtgtgctgcacccattaactcgtcatttaacgtttggtatatctcctattgctatccctcccccctccccccaccccacaacaggccccggtgtgtgatgttccccttcctgtgtccatgtgttctcattgttcaattcccacctataagtaagaacatgcggtgtttggttttctgtctttgtgataatttgctgagaatgatggtttccagcttcatccatgtccctacaaaggacatgaactcatcattttttatggctgcatagtattccatggtgtatatgtgccatattttcttaatccattctatcattgatggacatttgggttggttccaagtctttgctattgtgaatagtgccgcgataaacatatgtgtgcatgtttctttatagcagcatgatatataatcctctgggtatatacgcagtaatgggattgctgggtcaaatggtatttctagttctagatccctgaggaatctccacactgacttccacaatggttgaactagtttacagtcccaccaacagtgtaaaagtgttcctatttctccacatcctctctagcacctgttgtttcctgactttttaatgatcgccattctaactggtgtgagatggtatctcattgtggttttgatttgcatttctctgatggccagtgatgatgagcattttttcatgtgtcttttggctgcataaatatcttcttttgagaagtgtctgttcatatcgtttgcccactttttgatggggttgttggtttttttcttgtaaatttgtttgtgttcattgtagccctttgtcagaggagtagcccttcgtcagatgagtagattgcaaaaattttctcccattctgtaggttgcgtgttcactctgagagtagtttcttttgctgtgcagaagctctttagcctagtattttctttataatttttgtcttctttagttaatgcttaaaacacttgaactggtggagttcttaaagccatttggtgagacattatgtaaacgttatcccactgccaggactcatttatcttaccacttgttcttttacaccatcctatacactttatttagtgaagtacaaaaatatttccactcaggaaaaaaataaagcccctcactttgatattgtctcccctattacttctgacaatacttatatttataatttacaaatatggtgctgtgacttgtcttaggaatttgattatttaaaaatatgaaaatatggcccttacacatcattttacatttgtgtaatactaattttatgtgacattattgatacacaaactgtaattctgaaaaaatattattgggggaaattggctcataataaaatatttttatgaaaatcaaacagatttttaagccaataaaatagctaggttaccaggaatattaatttttagaaaatctgaatgaaagtatctttgttatattttgtttatgttgcttatgtgtttaaacttttatcacactgaaatatatgctaatatctaaaaattttaagtagtaagatttctaaaatgatatgagctaatagtattcacatggttacatatttctgtacatccaacatatttaaattttttccagttaaaaaaagatgagtaccttaaaaaatgttttatactatccattaaatttttgaagccaatgtatttatattatttttctgtatttctgtaattcataccaaagtatgaatttagtaattataaactttgaatagtagtattttcatgaatatgaatatgagaaaagaagtattatagaaaatacaaagaaatattttaaattagctctacttcctatattaaaatattatttcagccactgtggtagtaataccagtaatagcgatgtggatatgcagctttatcagtggctataatgtgaacatttcttcagctatatgccacacagttgaatgatccaattgcaggtctgggcttttcaattttgccaaattctggctattgtattaagcattggtttcggaaatgaagtgacacattttcctatgaaaatgcaattgagcagattgttctgggcaaagttcaattgcagttaaccctgcagatgaacagttacgctctcattattcagtgtcactcaggtcaatctgaattattaaagtgtattgcagaaagggtaagtattgttggccattcttgaagaaacatttaaaaaaattaccaaaccagcggtttgtttgcaatggttttgattcactttcattttattgtttcttaaagataaatagcacagatcatgcctatccagaaataattagtacatacatggtcttttttgaacaactttgagttactttaaagatttatgtactctttatgtccttattttaaaagataaatttaaggctagtatagaatattgttaaattctagaattctagaatatccagttatatagttatttgaagaatacttgaaggaacaagagtagaaaatagtaagatatatcagtgatttgtttttcttttaatgcatttcacagttaataatcttcaaaaagcattacgctattttcatgtctgtatactaatcaaaccttatgatatggttttatataacttgtaattgatgaatattataaacatgaaaaacaatattatgccttgccaaataagttattttcagcttgatttcataaaaagagaaagagaaatttaaagattccttatgttgattgttctggtgagatagagcaaatatagaaatctgttggactcccatcattgtgaaaaatcctactgcaatgggcaagattaatttgtaacactttctctgaagtgcgaattaaatctgatgtttcatgatgatctgtagtccatgtggatgcctgtgtacattatagacctggccatccagctggcatctactgttatcagagtgctagccctggctggttaaatggattttgcctcaggttaaaagcctttagggaagtgggtcaaattgtacaaggacagcttttctaattccttgcttgtgatgtaaaggtaagaggataataaggttacgtaaagccctgcaatatacaagctcatttagaaatactcacatggagaatctcaagagaataaattagatccacagttgggttttgcaaaaagtcatttactgaaatggtagacaagttcctctttaatttttttttcatattgtatgactctcttacgctcaatttaaacaataggaatgctgactattcaaagggaaatccactgagatagtgacttatatttcacatatgatatgtgatagttaaaattatgccaccttctgcattttagattatgtgattctgaagattgcagcatgtgtgataaatatcacacttccagtgcagtatggaaacttgaagtttatattttatttataacagaatttagtgttttaggcactcaaaggctgagagaaatcctcccaggaaagaataaataaacacttagaaatcactgaatcccacagttaattgtttatttgatatgtttccattttgagaaaaagtaagtttaaaaagttatttatttggaagatagaataacattttgatgggtctcacaacactttaacatgacataggacacagctgtctgtaccaggatcctctactgaataggtctggccccctgctggcctaactctttgaccctcccactaggttgtgtcaaagagcttgcaagggacacaatgaagttgccatcattcccatgggcaatggcagttcaattattttacatgtgaatatatcgaatatcaattgctactctgccctttatatgatacagtggacatactttcaataacttttctttgatagaaatatgtataatagctaagggaatgaaatatgagttgttgtaagaagaattccaggcttttcagatattcattgctaacatttacattatttaaatctttttttttattttgctccttattactgttgaaataatctggaagtaaggttggtttaatgtcctttggagcagtagattttcctgctggacaatttcaaattgaagttcttgtccttgagttcttactgatgctttatacagaacaagagcaaatgttagcatatagcatgtagcatgtagtgcctgtggtctttactgactcagtctcctgataagagtcttcagtaccattcaacgagtacttcttgagcatctactctttgtccatgtttttctagataccgggaataattagaaagataagtaaatcccagtcatcattaccaaaaagtcctagtttgggagataaagaatagggagaagacaaataaagtaaatcatttcagggcaatactgtagagatatacagactccatcctctgagactgggaaagatccagctcaagttgaggggatggggaataattctaaaaagcagataaacttaaggccatacttaaataattaatagaaaataatcaggcacataaaaggtgaaaatggataaatgaatcttaaataatatcatggcaaagttctgaaggtaataataaggtttaagcaagggaagtatttggtattgctgaaacataaattgtgagggattcaagaacagaaaatgttatctggagctttaactttatttatgtgttgtcagttcaagaaattgtgatgggtttatctagactagttttataaacctgtaaagaaagaagcagaacccaaaagtacataggatttgaagaccatggaaacaggttacttggaaaaagaagtctaggtaatgctgttttctgatcataggaaatatgaggcaaaaactagattgtgaaaaaagtgatgagttcagttttgggtattttgtggccaaagtcattgtgggacatccaagtataataattcagcaaacgaaatttgagtctaaattttattgtaaaagatatgattgacatgcagatttatgatcttcattgataacatagacactgctaaaaatctagagagtggatgaaattgtctatagagactaaaaaaagtagagacagtgctgatgtaaggaccttgggcaatgcagatgcttaaaagaattttcacttccttgatgttctttgtctattgtttatgatacatatatttaatttaccctttctacttgtccctctgttaatgaatacacctgcattctcccaattaaaaacaaaaccccaaatattttctcaatatatcaagtcaccttactatttatctcatttccttaatctagactaataaggcaatcaatctaatcatttccttaaatgcgctgcaacatctactgcctgcactttttcaccatgaaatccatgcccatttttctttctggcactgtatgaaaatgttgttcctggagtttatagcatgagacctccacgttaccagacagatgatgatttttctcaactcatctttcctgagctatctgcagcaagtgctctgttgatcactagactcattctaaaacgtctgacttcctgcaactcagggatttatcactcttggttgccttttaatccccacaatttgggtcaacctagctattttctccagttgaagacataagtgcccagttgccagaactttgtcttcatttttatttctcttcggctaatatttaatatcgtgaattctttaaaatatctttagcagctgaaatgcatttcggtgtagtaatagatacacttagttgaactggcataaacactgtatataatgaatataacattacatctcaggaagtccaaatgatagaagtgtttatacgatagtcaaccagattattcctgttatgctataatccctgcagcttcatcattggtgactggcaggaatttggttgtggcaattccaggcattatatccagaaaaagggagattgtctttctaggtaatcctactaatgaatgtgcagatttggaaaagaatcactttgcttctacataaattcatgttctttaaaggacaaaatgaaaaaccatgtgcacaggtccataacacacagcatacttcaaattcttctgaacagagagaataaggaagtcttgttcttacatgaaattaagtactttttaatcctatgtgtcagtcctcatgtggcagagattttaatctgcaccaaaaatctatttgcaatctccttttcccagtatcccttgcagttatatttgggtccagagggtagttcttaccaatgagctgtgagtaaaagtgactaatgccacttttgggtggaagaagttaagaattgtgttgcttcttcatttgcctattgcctttgccatggagagcttttgttcttgaaacaatcttcctcattcattaattcttcaaaggccctggttttgtctccttcctcattattttataagagcacatgggatatgagtggtcctggcattgagaagctttgacatctcacttcctcttgtttcctgtttgggctttaatttctttacatattgaacggcggtgacattttaatttttgctaaattcatggtttctttgttagtacagtttcattcatcgttattagcttctgatcaagcagttgtttagatttattttttattttttattagtattagtagtgattttgagacagggtctggctctggcacccaggcttgaatgcagtggcacaatctctgctcactgcaacctccacctcctgggctcgagcaattcccccgcctcagcctccctagtagctgggactacagtcgtatgccaccatgccctgctaatttttgtattttttgtagagacgaggtttcaccacattgccctcactggcctcaaactcctgagtacaagcaatctgcctgcctcagcctcccgaagttctgggattacaggcagttgtagcctttaaactaagcatttcttatagtgataagtttttgctgtttctatatctcaggataataacatctgttttgacataattcaaataaaaaataattgtttcctggccaacatgttgccatttcttactataacaaccacaagattcacccaacattcactctaatgctacaattctgatagatacacaattaatatctttatatattatggaaaatgccagagccgaatgcttgtaaaaaatgttacatcaccagacttactagcttcctaaccaaaaaatgtggggtcctcctgttttgtgatggatcttttcacctggacaatttccagttttaaagttcttttaattgaagttccacatttctagtatacattcctgaataaggacggtcacttttgatttaaatccaggaaggttaactgatgtcatacaaaaatcaaagtcaacattctccttatcaaatcagcttctctgagccactttcctctattagcaaagcttctttatttcttgagtggaatcatggaaactttatcaacaaatatgcctatgcatttactcagttgcttctttccatcatatttattgcccttttcccatatcttccatcctgtttcaggatttcagtaattttatcatgtaacatcaaggtattgctattttgttttctgtctcatgtcatcgtacctttatctaccctattatcacctgcaaaattaatcttcctaatttgttgttctagtcatgttactttcttaattaagtcttcattctataatataccaaattcttaaacttggttatccagaatccaatcttggttactttctgttcttatccccactgctaccctgtgctgacctaatacctaaaccaaactggaaatgcctgagttcaacaaactggatgtaataactacatcagaatttccttaaaaggctcaaacttatggcatcactgcccattagcaagatccttttctactaatctctttcttgaaatggcttctggatgtaaaatcctgccatatatttttaaagtattttatgtctaatagcatttacatacgaagccccaactgatcactgtaactaggtaaaatttatttccccttaatgaatgcttggtgatatctttctataagactgtaaacttcacaagcagcattagtcatgtgtgtccaagtaagctctgcagcccttctcaagaggctgtgtaattagaaaggattaacatctttcatggaactgctagaaacattagatatggaattatttctctgagactatgaaataaaaggtttagccttagatcaaagcagtcaggcatatagaataatgtataatgattttgcccttgaaaatttagaagtcttgacaggtttaataaccaatgttcttctggagatacttttatcaaactactagggttttttggtttgtttttttaaaatcagaatcttccagaataaaaaacaaactagaaaaacaagataagagaaaaacaaataaaccctcttgaatataaatctgtgggaaatcacctacctgggggattttttaaatctttccaatagattataatttttttaaaagaggagattaatataataacttatagaaagtgataaatgtatcaatcacagtaacaattctgggccaaataaatttatcatatataaattgaaaatgatatgtgggaaagatcactcaaatttatgaaagcatagtatgtgttagatatgttttgcataatattgcaaccctgaaggaagtggctattaatctaattaatagagatagaaaccacagtcagtaaaagctacaactctaatttaaatatgaatcaatctgattactaagcccctgctctttcaactatcatatgattataaagataaaatatattaagtaatcaagtgcaattcacaataatattcaaatatcatttttatttcataacaatttaaatttttgttaatttttctaatccattggcatgtcttgctttactcctaggatgtgttccaagaaattgtgtgtagaaaaaaaaatcagattgattagcatcacagccatacattcgatttaatagaaaaatataatgaggcattttaccattccaagtatttcaggccatctctattttaaagtatgttttgtatgtttattgttaattgctgtattttgttttattttactttttaaatggaacaagcatggataaaagtaattatggtatatacaacctaagagaaataaaattatgaattattactacgagtcttagtttctatagatcttctactcaggaataataaattataaaggaaaaacatgtcacagttataggaacatttcttttaaaaagaaatatgaaatattttcagagtaaatgtgattccatacacttcttatactgcaaaccatttccaaatttccacatatgcttgccaaaaccaatgataattaatgtttcattgaattctttgagaaatgttgaattccacgactggtttggaccatatttaaacatatattatgctggactaaattccagaatcagagagaatattttatattttttggctatttgtgttaagaaaaattctcaagtggagtacggacgtaaaatagatttggtataaaaacaatccatattctatttactagttgcttcttcagcatttaagaaactatttggggccagatacagtggctcatgcctgtaatcccaacactttaggaggatgaggatctcttaccccaggggttcaaaactggcctgggcaacacagggagattccatctctacaaaaatttaaaaaattagtcaggcatggtggtgcatgcctgtagtcccagctactgtggaggttgaggtgggaggatctcttgagcccaggaagtcaaaggggcagttcactgtgattatgccactgtactccattgaaacattaacctttttctccattcatatttttaaaatattattcaagtttttcatgctcttatcttaagagatgtcaacatcagatacaatatgatttgcagggagtttattgttcattaagatttttaatttatatatataatttttatatacattatacttaatataatatatgatatttcttatttaatggaatagtataaaagatcaaaatagtttaggcaaaacattgtctgaatttaggttctttaattggtttactttaaacttgctttacttctctctgcccccaacttagtcattctccattgccagaggctgtttagttattccgagcaatagagaaagatttatgcattgacaagtggggaggtgaaacgctggttaaaagagttctgcaaatgatacttctgatcccagcaggagttataggcttacagtttttcaaaaaaagcaaagttttccctgttaataactgtaaattatatactataatattttataccttttttctttttccaatgactaactatacctcactttagggataaaatccctcaagtgcatgacagagatgaatacaatatgtttatatttgggaaactcttgagattttctttgaaaagaatggatttatgagattgaaagacacacacaattcatactcacaccatgccctcctcccacctcaaagttacatgttcttttacaataaaagaacaaaagttctcaaaaacatacatggcttaaggcagtctttaagcattagagcacttctctgttccctgagcctctattaagacatgtatatagcttgaacttgaaagtatatgcatatatttattagaaagaaatatccacaggtggaggtcagttgtctaattcttgcaaaaatgtaaactttaaagatattgttttaaagaaatagcaatttaggaagacatccttgtttataaattttattaactgtcatcttcgtttcattttagcttacacactgagtttagtcagttaataaggaagtttctgactaataacaaagctcaaaattaagaaaaaaatctgatttgaaattatagtttgtggttagtttatatgaaatagaaaaaataagaggagttttttttttaagtagcaaaagcatgtattatgggaagctcatgatcttgcattttgatcattataggagttgaaatacctgcttccttttcatattttaaatatactgtaagttttagggcataaaaaaatcagaaaactatgtttaaccttcttaattagaagcctcataaatatatcaatataaatatagccatttccttgtccaacaatgtctacaattaaatacaaaatgatagtagaaaatgataaacaatattttcactgccctttcagccctccgagtttatatgttattctatagtaaaataatctgcttaattcatatttagactcttatacttagtaacaatataaatctctatagcttatattaaaatattttgaaaacatagcttggaatttgcattgtttagttaaaaaatttatgttggcagacctaatacatgcctgaaatcactttactctgcactgatcaaatagtcaataatccttgtacatttacttctgtgattagcattatttccttcagtgatacatttactctgaataatgggaggagccatcgaatggataaatctgtttataattgcatgtctaataaatcctggaattattttctcaggccaaaatgcttcaggcacctctgcctcatctctttctcttaaactccacatcctatctgtgtaaaactctatcttgataacattaaaaaatccaaccacttcccactctgtcgaattgtactcagctaatccagtcacatttaggtctggtcaagattgcaatggcttcctaactcctctccttgcttccaccccactcccttatccttataacggtttaacatttcctatctatatgaataaagcaagttcttttgaatgaccaacacattgatagcatttaatagatttagaccatctttcaatgtgtgactaccactttcttgatgaatgtcctaaattactaatgttcaagagagctggaagcttcagtgcccatcagaactggcaagacatctcatttctgaactctaaagggcttcctatagggaaggcttgttttaaatagcattcagtaacttcagttgaactaaattgctctgttgcctgaataatatagcaaagagaaggagacttctgttataatattgtgtcagtagaaaaatgctttctgagattcaaacaattaattcataaaaagttttcagatcagaaatttaacaaataacttcctttcataaaaaaagtttatgtaaaataactttcataaataatgtttacttaaaagaacttttataaaatattcagatattagaaaattcttatatatagcatatacttaaaaatttatttttagaaatattttacctcaagacggaagtctatggtagcattttattacacgtatgaccacacatttcattgtcagcaatagacctttttttaacatttgggattctgatattcttgctttaactctggtttcctatatcatggccaaagagagagagagctgcccttagtctgttcatttgggacttcccttaaattagggcttggtaaactatggcctagcaggccaaattctgcctgccacttgtttttgtaaatacaattttattgaaacaccgacatgttaatttgtttagatattttccatggctgctttcacatgacaacatcagtagttatgacaggggccatatggcctgtaaagcctgaaatatttactatctggctctttactgaaaaactgtgtccaaccctgcccaaataaaattccatggtctgactgggtgaggtggctcatgcctgtaatcctaacactttgggaggccaaggcaggtggattgcctgaggtgaggggttcaagaccagcctggccaacatggcaaaaccccatccctagtaaaaatacaaaaattagccaggcatggtggcacatccctgtagtcccagctacttaggaggctaagataggagaatcgcttgaacccaggagatggaggatgcagtgagccaagatcgtaccactgcactccagcctgggtgacagagtgagactccatctcaaaaaataaataaataaataaataaataaaaataaaaaataggccgggtgcggtggcttacacctgtctgtatacccagcattttgggaggccaaagccagcagatcacaaggtcaggagttcgagaccagtctgtccaaggagttcaagaccagtctatccaacatggtgaaaccacttctctatttaaaaatacaaaaagtagccaggcacagtggagcgtacctgtagtcccagctactcgggaggctgaggcaggagaatcacttgaacccaggaggcagaggttgcagttagccgagattgcaccactgcactcctgcctgggcagtagagtgagactctctctcaaaaaataaaaaataggccaggcatggtggctcacgcctgtaattcccagcactttgggaagctgaggcaggcagatcacaaggtcaggaattcaagaccagtgtggacaaggagttcgagaccagcctggccaacatggtgaaaccctgtctctactaaaaacaaaaaaattagctggccgtgttggagtgcgcctgtagtcccagctactcgggaacctgaggcaggagaatcgcttggactcagaggttgcattgagccgagatcgtgccattgcactccagcctggcgacagagtgagattctgtctcaaaaataaggaaataaataaataaataaataaataaataaataaataaataaaattctatggtctagtcctctaagtatatccctagatatgtcccatgaaggctaaaggaatttcttgtcaatgcatgaatttcaagcccagagtcttgctgaatatgcaaaaaatattttcattcaatagcaaatgttaagcaattacattgctctatcatttgtctgtcttttatgaagaaatccatgggtaacatagtgaaaatacccagggaaaaatcactttataccatacggtaatgaatctgaatctataggaatcttaatacatatgagcacatgtccttagaggaaaaataaggatgttgctaaaggagaatctctttcacaatctaatggtatttttttgctgatacagattgtaaatattaaagtaacagttcactgtactaagtatgtatgtacacacatgtaatactgaagataataaaactggatgtttcaatggctaaattatttcaccatgtttgaacaacttcaaatggctggaaaagcaaataattcacaacactgaacttttgaactatcgatccttctcttattgcacctccttccccaaattcccttcttctagcagctcagaccaaaacacttgaggcatctctgcctcatctctttctcttaaactccacatcctatctgtgtggaactctaccttgataacgttaaaaaatccaaacacttcctactctgttgaattgtacttggctaattcagtcacgtttaggtctggtgaagattgcaatggcttcctaactcctctccttgctttcaccccactcccttttccttatcccactcccttctcaaaacaacaaggtgatctttgccacttccccacacaaagggaccagggacttttggagaaatagttgattcctcatttgaagcagagaaagtttgaggtgattcttgagtatcttattatttgaaagccagaaagtgtttgaagactaacgggaatatagcaaagtcacaggggcttgaagtagcttccattggccaaacagcttaacttgacaattaaaagaaaaaaaatacaacatgttaggaaataataaaaataacaactggaatgacagtagtaatacaaatatcaacattatcaaaaactcttaagtccacactgatcctaaataaaaggtggtaggagtgagatgagagaaagaacatcttcacagagtgttagtggacaaatgcattatatttcaccaaccaatgtaataattaacttagataagcattatcaatggatgctaaaaccactggccaacatggatgctaagttaaagatgctgagaaacagaatattcacgtgaactctgtgtcactccataaatttttaaaaattaattacaaagagaataaactatctttaaaagcgaaagatttaatgaacactaacctattcaacaaatttagcaggactcatgagataaactgctgctctatgcctcatgctatgatgcagtaggaagtacacaattacttatctcatgttcttgctgaaatgtccagtcaaaatttgatcaggaggaaataatcagacaaatccatccagattgtaggacattcaataagtaactagcttatgtcctgaaagacaaaaacagggggccatgggggagacatggagctatttgtccaggatagggatgacgagagaaacgacaagcaagtgtgatatgtgatcttgactggatttttgatttaaaatttttaaagaatattttaagacaatgagagaaatttgtggcctatatactagaagacattgtatcaaagttaatcttggaaggtgtgataatgttgtgcttatgagacaaatttccctattgttagatgactcgtgtatttagtagtaattgccattgtacatgacaaatttctttcaaatggctcaccacatagagtaggaaaaacaacatgaaattgaaataatatatatggaaaaataaaacaaatcaagtaaagtgccagtatttgaaaatacagacataaagaaatacagcggttcattttattcttttaacattctatagatttgaattaagtacgaaaacaaaagaaatacatacattacatataatatagcagattatgccacttatttgctcaaaatcttccaaaggatccccacctcagtcaaagataaagtcaattccactaaaaccaatgacaggtggttgatagaggtggggtgaacatgtgacaacaaaaggaggacattttggggagcaatggaacagttttgcaccctgagtgttgtggtatctccataaacctgtacatgccacaaaatccaaacaagtttacaccaaacaacaatgaaaagtcaatgtatgggaaatctcttggcgcctgaataaggtctgtatcttagtttattgaattgtaccaattccatttttctggtcttaatatatatggttacatatatattatcattgagggaagctgagtgaagagtatgtggggatgctgtacagttttacaaattctgtagtctaaatttatttcaaaatattattttttaaattacttgcaagagtttgcatgatctgccctagttacctctctgacctttgctactctcaagctcaccagttcttcttcacctgtggccaccttgctgctgcttgcagggacaggccatccttggggctctgtgttccctaaccctgaccacctcctatcacatcacagtctttttagccattatgtccatcatctgtctttttggctaaaatgaattttgtaataaaacaagaatctttattttgttgaaggatgatattgcctgaaatatgcttggaacatgctaggcgttcactaaataagtgttgaattaactaacaaatcttgaaatgtctgcactggaagtttttgtgtgaaaagtggggcatgccatatttcaagagaatactgttttttaaaaaaggtaaattgtattgtgtatatttgaggtttaccatatgatgttatgggatacatgtagatagtaaaatggttgctctactgaagcagattaacatatctgtcatctcacttagttacattttttaaacacagaagctaacatctacttatttaacaaaaatttctaatacaatataattttagtcactgtagtccttgtgtcttacattagatctttagatttgttcatattacctaatctgttactttgtattatttgacctacatctccccatttcctttctccccattccacccatgaaaactgctgttttattttctgtctattttttcagatgccactataagtgagatcatacaatatttttctttctgtgttttgcttatttcatgtagcataatgtccaccagctccttccacattgtcacaaatagcagcatcttctttttcaaaggctaagtaatgttcctgcctctggatgtgtgtgtgtgtttgtttataattttctttatcctttcttctgtcaacagacacttaggttgtttccattatcttggctattgtgagtaatgctgaaatgaacatgagagtacagatatctttacaaggctgtgattccatctccttttggtatatacccagaggagagattgttggatatgtatggaagttctattgttaatttctgtggaacctccatgctcttttccacaatggcttttccacagtgtacattttcacccacagtatactggggttctcttttctccccaccctagccaacatttattatctcttgtttttttgataatagccaatctattgggtatgaagtgatatctcatagtggttttaatttgcatttccctgatgattactgatgttgagcaccttttcatatatatgttagccatttttatgtcttctttggagatatgcctgttttggtcttttgcccatttttaaatcaggttatttatttttctgctattgagttgtagggttttttaatataaattttggatattaaccccttatcagttgtgtgatatatttttccagtctgcaggctgccctttgtttgcatttggttgcattttgtcagtggttttcttttctatgccaaagcttttagggtgtaagatttacctaaagctttaacaacaaaatttaacaatattcttcagcttgctctattgacagaacataatattactcctttctttgccttttgttttgcacacagtcaaaatcaccctctgtgctgacttccacaccagactgattcatgaatggctgctttttcccattgtttcctgttaggactctatggtcctccacagcatttccactgaaatctttgaggccgtcctgctatttctcaatacatagcagctgctaagctatcctgctgtcttccattatctgcacatttccttctgtggagttatattccaacaaaggttcctgacatgctggctgagcttgctcttcttacaatgccatttgattttcagtaaggtttgctagcagatgatgagatggcagaggaagccagttatggtatttgctattagactcagtcttcaagaggctgtaaggacttccttgtttgaaaatctgctaaaaattattttatattcttcagaattatttgattttattgtgacacttgtatattctttcttcttgatgctcttagaaaagtcactcgtgcctcagactgtctttatacctgcatttttttcccatcagaatgctgacctcctgccttgttctttgtatgttcagctcctttgaatacttcagccttcagttaaaagtcatctgcactgagagctgtttccttacccctggattgaaaatacacttttacttgttcttctccatgcggaccttgcttagaacttgttatttttcatgtatttttaagttgtgtgcattgtctcttttccaatggcatgcatgctctataagagcaaggggatctttgactccccactgtagcctgtcacccagcacagggtttgtatataataagtgctcaaaataaatatatcttaaataaatggatatttgacaaaagtaatttctggatgctattagagcatgtacccagaaaataattatttgaacccaaagtggccacaagtatcagatacgcactcatttataactctagtatattgtccttaacattgctctttgaaagccattttcagtcattttatattttcaagtagttttttaaaaagtgatactattagtttggtgcaaaagtcattgcggtttttgccatacttttaatggcaaaaaccgcaatgaattttgcaccaacctaatacctttgaccaacacacagacacccacacatacatatgaacacacacatttattttatagcattattagtaaaatattgatattatttaattggtttaccttttcgaatgcctacatccaaagataacacaaaatatgcaatagtttaagtcacaattttagttttcactggaaagaacccaaataatattataactactatcaaaaggaactctcgtattcatatctacatggcctatgtaatatcaactccaactgttcacagatcactgtcatcagtattgatagtaataaaaataaaaatatatcagaatatttactctcatgagaaactgtattagtttcccagggctgctataacaatttactacaaactggatgacttaaaacaacagaatatatttttaattgttctggaggctagaagtctggaatcaaaatattggtggggccatactccctctgaggattctagggaaaatgtttcctttgcctctttctagcttcagacagtggctggaaatccttggcattccctggcttgtagctatgtcactctcatttttgtctcagtcttcacaaggccttattcacagtgtgtgagcattttcctgaccactttatgaggacactaatcattagatttacagtctaccctaatcaatatgtcctcatcttaatgtaactaattatatctgcaaagacctttttgaagcacggtatttccccgacccggtcgcatgatgcgtgacaggggtgccttgtttactcagcccacctctctcaactcctaacaggagggagtgcgtaagtgaacacagcggtaactggagtcagaagcactggaaccggctggctgtttcggtgcctgcaggatcaaactctattcactcgcacccactgcgttccacccaccgtgagagggagtgcgcaggtgagtgggtgcaggagccacagcaagcccttttgggcgcctgcaggagctaactccgttcaggcccctcagcagcatccaagcaggatgcatgcaacttccgaagtccccgagggcatgttacagcgctctttttttttttttttttttttttttttaattatactttaagttctcggatacatgtgcagaaggtgcaggtttgttacataggtatacacgtgccatggtggtttgctgcacccatcaacccgtcatcttcattaggtatttctcctaatgctacctctcccctagtcccctgacaggccccatgcgtgatgattccctccctgtgtccatgtgttctctcacatgtgagagcatgtggtgtttggttttctgttcctgtgttagtttgctgagaatgataatttccagcttcatccatgtccctacattgctcttttcgctctgctgtctgcggatggcttaagtgttaacagctcagtaggccctttgcctttttgcgtgaggaggctgccctccaccagcaagggcaaaaggccagtgtgataggcttttgtatccacacttgtggctcccaagctcttgtacagcatccatgaaaaatgaggttgcacgaacgaattgaaggatggtaaatgcgggggattttatcgctggcgaaagtggctctcagcagtaacgggagctgaaaaggagatggggcaggtaggtaatcttcccctgaagtctggccatctcgggccagattcatttctgaagttacgccgtcaagctgtctctctgaagtcaatctgcttctctctgaagtccagccatagtccccaatgtccagttgcttctctctgccagctgagtgtggggtctttctaggcacaggatgggagtggggtgggccatgggtagtttaggaaaagacagcattcaagcaggaaaacagggatagaagttctaattttgggccgtggtttcaggctttttggcttgatggtggggtttcattgtggaccctcccttttcttcctagaattgctctgccctctgtccctatcactatttccaagtaaggttacattccgaagttttaggtggacatgaatttctatttcaggggaggggatgcattactcaacccagtagagtctgccctctggcctcaaaaatccacgtccatcccatgtgcaacacagcccaacattcccaaaagtcttaacccattcacgcatcaactctaagtccaaaatctcatttaaatatgtttggttcaaaaagcttcaaatcttatcatctgaatcaaggatggccaagactctgggtgtgatctatcctggggcaaaatgtcttttcatctgtaaatctgtgaaactcttaaatgagctatctgcttcctaaacacaatgctgggataagtataggataggcattctcattctcatagcgggaaactggaaggaataaaggagctgcttgtcacaagcaagtgtgaaacccagtagggaaaattccactgggtttcaaggcctgagaataatcctctgtggcttgatgttcagtcctatgaatctgcagattcctggtcagccctgtcctacgttctcttccccaccaactcctacctccctcgtaccccttgctcagtgaaatcgtactcatttttcagtcttagtttgactgttagttacgtattctaatgtagatgagttctctttttataaattatcatataaacgttcattcttatctttgcttactagaaattataaagttgagtaatttcacaaataaattaatccttgttcccccaagcaggattcaaaggagaacaggagaagcatatgtcttatttgctgttacatccccaaagcataggtctatgcttgccacatcctaggctctcaggaaatatttattgaatcaataaataagatggaattctgtcttaaaagaaaacagtaggagttttgtgccttttgagttaaaataatgtcatgggcaaaatacctgatttcatattgaagttccaaagagtcattaagaatattaatgaaatgaaaatgtactcttatgctttaaatatttttcattaatttttgtgggtatatagtaggtgaatatatttataggggatattagatgttttgatataactcttatgcttttaatgtagtaattttaagattccagacagaattgcagacatttaaaaattttaacatatcctttggaaattgattaaaaattaaaaattatgttcagcaacaatatagagagactctcccataggtgttttggcctaatataatttttgttattatcatcattttctactgtaagtgcatctctgacttataattgtaataaataaaaaatgcaacaaatcttctttccaaagctacatttcccaaaactggtgtcatagagcatagcatttatttagagatgcatcaagaaaaatggggaatccctgaccacataattttgggaaatgtcatattcaatatcctccttcaacaattaattttcatgaagttcgttaggtgatataaatagctctgcgtagttctacagaaaaaaagttattttctaaaaaatgttgctccttcaaaaacttttattttaatattttttgtaaatatcttgatacaccattattttataaaataattttggcaaaatatgtaatgcaaaatgtgatatggcttttattatttaaattaatttatattctcatttaggataaagcagtttaacaatgccttctttcaaataaatataatctgatttcttgttatttctgtttatttgctgaaattataatttcagagaaaagtatagcagaaccaattgcttaatttctgacccaagtgcagacatcaaggagtaagcaatgcatcactccttttgtcatgtggacattatgaaatttagtacattctcggtaactgtcaagtcctgagaatgagcactggttagatacctgggcaaccttctttttgtaccctcttcctccatgtcaagtttctctgcctttggggaatgtgatactaggaaaaaatttctgtaagatatacacaaggtaatttctatttctcatttctactttaaaaagttttaggatttgattgaaaatttgcttaggaacttgttgttactcaggattttccagtctggcggacactaccagaagatatataaacacaattaaattcctagcttagctctgagctctgtcttctggacttcaagataatccagagagacgcaatcctaccaagacactctaaactcattgaataataaaaatagcataaagtatgaacccatttaatattcataaaaattctatgaagtgggcatttgtattgatttcattttatagataaagaaactgaaacctacagttcaagtcactagtcctaggtcacacagttactaagtgaaacagatgagatttgaaaccaggtcagctggttccttactcttaattactacaccttacagccatcatgttcattggaaactattgttttattgaagccagcttagttcccaggtagctgaatttatcttcacattattagactttaaagagttctgtttcacattttagtgtgtcagtgttgaattgaggatttaaattcaattttagcataacacataaatcagtgaacttcaattactacagattttgactaaaagtcttctgatttttttaaagtaaatatttataaattaactctcaatttttctccaaccctaagaatataacttttcttacataagtagcatattcggtcatcattggtaattttaatgctttctttatgtttctttatcctttatgctgtatatttttatgttctcctttgatctctataattcttctgatatttctgttcggactgtaaacaattggttttattaaaaaataatcatttacaaaaacaattcaataacaaatgagtagacacacaaattagcagtgaaaaatatgatcacataccaaatacaaaataacattctcaaaacccattttaacgtgttcaaatacaattttcttcagaaatagaaattcaccaattcaaccttgaaagggctaaaacctctgaaagtcaatgacttaaaaaaaatttcaaatagtatttcattaaaaaaatgaaattgtctaatgttttctaccacttctcatattatgcttggatgcatttttcctcagagagcataagacaatttgcagagtataagcaaactgaatgaatagaaatcagattctttctaaggcagagctagaaaggaaataggataaaacatgtaacagaaggtgagtgaaaacaaatcaggagcagtgggtaaagtaagcttaccttgccaaatgttccattataaaagttatagtatcaatgatagaaactttaggaaatttaagatggcggacatccttacaattttctttgtaagtacatttaaaaaagatgtctgtgtacttcaattggaagggaatgagggttgactcaaagcatataattaattatccttggctattttacactgtggctaattcagatgttactctctcaggaagacagggagaaacttgatttattttgtctggaatcctattcttattaaaaaagaaaggcttaggcatctactgactgacacaagtcacagccctgccattccccctggaagccaggaagcagaatagcaaagaaagggtgtttctaaatgaacattaaaagcccttcaccatggaggaagctacattaaaggtaacgtcttggcaaggaaatattgctgtttagctatttttttttaaattaactttatgaaggctgtcctggtatgttcaaataacacaaagtcaatctttggtttatttctgtttaagctttggcttgcttttttaatcaaaaattttaaaacaataaaaaattaaaagcttagaataaatgaaggccaaactgacttaacgttttatactagaatattaacagttgctgaggtgatgctgagctcaattttgagaaaagaacaacagataaactgacaggataacattttattttaaaacagtgtgattccattaggctacaagtatgttttgttagtaattttaactgatttgaagctctctttgctattgctctcatttcacattgaccttcagtaaagtatgcaaattgttacaatgatgcaaaagataacgtgcagttcctaatagctaggatgggcttactgatataggttaagaaaaattatgaagttaattacttgtggtaggttgatgtaactcaatccatttttcctagggatgcatttaaatgccaaaagaaacaattcacttgccccagcccacacaagtcagtagtagcacagggtggtgtttgagagggattaaaattcacaaattctgacacttagtctactaaaccacatcagtttcaaactgccctcagtagatcaactttcttctttctggaaacatgtgcttcctaatgctattgctgatgaaagatatgtctgttcatgtggctaatcttcattgcttagaaacaataagaaaggttcgctcatcttaaagaagttcagtgcattctcagaaatttaaagggatacttcaagtttctaaaaactccaaattttattttcctttttcttatttcttgatatgtgtggtctatctggttttcatgtttctgtttttttttaagccaccaacaattttatcatataattaatgtgtttgaaatcaagaaaattgaattcacttttagtagtgtagacagttaccctattataaattatatctatgacatatttaaaaagaaaacttaactgctgattttttaggaaaaagaaatcttgtctatagcactttagctatagcagtaaatcagctgaggtattagaattttacaatgttctctgaggaaagtgaaatttattattggcttttatatactccattattttcacaaagtgctataaaataattttacaagtttttttaaaccttcctgtgttgtgataaatgatataatttttcttatttataagttaagaaaaaaaaaacaacctcaggtcaaagcaaggttgtgtattttatacaaggtcgtgtgtcttatacaaggtcataggataaacccatgggcattagttagaattttaaaagtaatatggtattatggcattactacttttacttttctattcttttaaacatcacaatctacttcgagtgttgcttttgtaaatctactgaccaataagatcttttaagcatttaatgtatatcatgtgcaagacccagttttaagtgccttacgtggggtaaactattgaaacctcaaaacaacttatgaagaatactgtttacacattttacagagagactgaggcacagagactttattatgacatgtccatatccaagaaagagtatagagcagtgacttggaacattagtttccaaaatgtgaattccagaccaatagcattgatatcatctgagaatatattaaaaatgcaaatccttggttcctaccccagactgagttaaaagcttgatgtacagggcatagagaatagttttttttataatttattattattattgtagacacagggtactgctttgttgctcaggctggtctcaaactcctggctttacgtgatcctcagtgatcctcctaccttggactcccagaatgctgtggttataggcatgagccacccagccagagtgacaacaatttttttttctttcttttttttttttatactttaagttttagggtacatgtgcacattgtgcaggttagttacacatgtatacatgtgccatgctggtgcgctgcacccactaacttgtcatctagcattaggtatatctcccaatgctatccctcccccctccccccaccccacaacagtccccagagtgtgatgttccccttcctgtgtccatgtgatctcattgttcaattcccacctatgacaaaaatttttttaacaaatgattttgatgcatgcccttgtctgagaactactagttcagaagatagagtctaaattctctgcctttgactcacaagattttcatttacagggtgtgtggcttcaaatcactggtctttcagggtctgagttgggttatctttagaataacactgggaatactagtagctcttcgatggggctgccaaaaggaccaaatgtgaaagcctacttcaggcaggtagtatatcttctgtgaataccaaatccaaaactcaattttattatttataagattgaaactaattattatataaaagattcattaatttaatgtattaaggcattctgcatggtacctgacacttagtaaatggttagaaactgatatcatgttattatttttattactactactatgattcatcattatcactgtcagtcattatttgagttgtggaaaactaggctattggtttacctatgacctttatactcagaaatccctttccagcctccttctgccaggacttccacgcactgtctactcatttgtgtctgtctgtctttggccagctgttagtccacctgttttagtcatgtagacagcttctcctgatctacagccagcctgatcctcacttctgtcttatttccttaaggagagatgcaataatgttttaaattgtgtagcctgagtatgaattcagtccaccataaataattaaatgcatgacctctcttattgagtgtttcttttcattgatgttcataaaacttaaacaaatacatgtgatcaatcttgtctgtgccccagagttgtaactttttgaatgaattcaatgtcaacttgcaaatattatttcttcaaaatttcctctgtatgttattttttcttctatttatttctgataaaaattgtctgtgctttttgattaaaaagcaaacaaaacacactgggctcctctagcaaattatttctcaagctacatataaagtaaactagagaaaagaaaaagttattaagaaaatcataaggaagaaaaaatatatttgctgtttattaaatcagagtagatcatcatagcggtcatcctcattgtattcacattaagtaagctgaaaaggaggaaggggagggattggtcttaataatacttttctttaatcaagttaaaaaaactgatatggaaagaataagccctccctactatttgtagctattgtacaaacaaaatatagattatactcaacatgttcttccttattaatattgttatatgttctgcttcagcattgagacaaaacatctgtgtattcttattcttcaggaaatgttaggtccaataatgttgaggaaggcataattttacctataaagtcactgtattaccttttgtataagcaagaaaccacaagaaaagccgaaaaaaagaaaacaaagcttagctagaaatggcaatgtaaagtggggtttgttaaaatgtgaagaaagtattataattcccttgcagagtacagcaaagttaggtatatttctgaatggtgttcatgataaatgtatttttctaatgtttttttaatggctgaaattcctaaggtttgctatgacatggaggcgtcaagaaacctgcagcaacttggctttctctcacctttagtgttcttgaaactgatcatgtctaatatgctttcgatctctggctttatattcaagtcttccatttaactggtagtatgtaaaacaaaacgtatactgtttttacctgcctctatttatctccatccataccgatagctgatggttgattgtaatatgttgaaatagaagaatagcaatagaaacagaaaaaggaggaggatgagaaggggaaggaaaagcagaaaagaagaaggaaaaagaaaaataccaggaagaaaaagaaattactagaaattaaaaatagaaaatgccatcaagcgagtcacttttatactgggccctcgaacaacatgggtttgaacttcacggtttcacttatacatagattttcttccaccactgtcacccttgagacagtaagaccaacccttccccttcctctttttcagcttacttaatgtgaatacaatgaggatgaccactatgatgatccactcccatttaataaatagcaaatatattttttcttccttatgattttcttaataactttgtcttttctctagtttactttattgtaataatatagtatataatacctataacatacaaatacgcattaatcgactctttaagttgtcagtaaggcttttggtcaacagtaggctattagtaaagtttttgaaaagtcaaaagttatgcatggattttcagctgcatggggaatcagtgaccctaattcctgcattcattgttcaagggtcaaccgtactaccattttttttgtaccaaatgtattaccatttttttttggctatgatccttaaaaatgaaaataaattctattctttttaaaaatttaaataaaaatattttataagtcatataatttggctaatatgtcacacagctgtggttgtattgatagattacaaaaaatttcatcagctttaaaccaaagccctctcttaaaaatgatgcagtgtatttcaactttgccttgttaaagtgtcaagaaattttaatccattaagagttgttaaaatgtggaaaataaggcatgtgctatgccagatttttaagtgcccatgtgtttgctcttagacaaagagttgtgttaagtagaatcgtatttctcatttttctagttgtatgtgataattgcactttaaactcctcaaattcacttctgtctgacgtggctttgatcttttacttggtccacattttacttactctttttctctttgtccatgttcatactcataaccaatcatgtttaaaagtaactatggaacacatggaaagttggaatattattgggataatgaaagaacttattttttacaacttgatgacataggatttaaagtaaacgtaaatctgggaggtgcttaatagaattaatgttctctgatggtcactgtaaaacacttaagaaaccatgtatctctggcttaaaataaattctgactacattatttattacaaaattataatctacttacattggttaagtgactattaaaggaagtgaatatttttcttatctaagcaagtagcttgtaggccaaaaatacatttggtttgatgggaagataaattttcaacattttaaagtaattttttaacgtttgtatgcattgtgagccaaaatatttgatttcttattccaactgctttaactctagccatgttcttttgaagacattactttctctgagaatcactttgcttatttgttaatggaatatggaaatgcttgtaaatacctaaaaaggaggtacaagtgacataaagtaaaaaaccttaaaaggcagtaggaatgtaagtcattgttattttctttgttgccatttctgtattctatctattcatgttatatctctcactgtttataccttagtttaaactttatattaatagaacagtagccaacttttctttttgcccatttccatcagtcttatttgcacaatctaacttcgaagagagtttttaataaatataattgatgtgaatggatgcttgtgaagtggaaactggagtagcaaaaaatatgccaagagtgagaagatactcagttgtagtgtttacagtaagttttctttatccatggtagttatattgtataaagttgctgtgactattgaattgctgctcctaggggaaatacaagtttagcttcctgagggcacctggttacaacattgtcatcaaatgatcaatacatagtcttattttatgtatgtttctgttttaaggcaccttatttaatatacagttgattcattaacattaaaatcatggccaatagcatgcaactactgccagaaaggatattttctaacatgtattttctctgtaaggcatattacagccttcttgcatttaggaacactggctgacattttaccactgtgctttcgggccattttatacagcaaaatcactaacaaaaagcacagaaatgtgaaaaatgaggcactaaatagacagttatttacagtgtgagagttgaaataagaaggcagagagttgccttatttgacctcagctgagaacatgcatgtcaggcaactcaagtttttgccattctgtcatgtctacaaatgactagaaagtgccacaagtattgacttttgggtcacaaataagttttagcaaatatgtgaatttgcaaatacaaagtccccaagtaaaagatcaactttgttattttctatttacccaccaccctcccactttgtaccagcctcaacaataattgatgttttgtatgctgtgctttaaatttattttcattttaaagattcaaaaaaaatcattccatctctgttatgtcagtactctagtattttttgtttttagcattatttaatactttatgaatattgcaaacactcaaacattaactgactgaactaagtaatttctaagcaataagcagtatatttagggaggagaagagtaagggaaatttatttaagtgtaatcattagactttgtctaatgatctgtgttaaattcttacattttctaatgagtaaggaataataccctcatctgaaagccatagatttatgtgaattaatagagaacagacaaatatgtttaaaagagatatcggttgtatcataattaaaatgacttatctagaagtgaaaatcaacactcttgatagagccatcagtttaatatagtaaattgaatgcctgccttgtaccttgggctgtcaaagttttccgcacttttggagaatggacagcgatttagaatcgtaaccaaggagggaagaaaaggcagattaaccaaaaaattttaagaagattggagcccaataatcatgcataatcttcaccaagccactcctcccagtacaaagataatataagtgaaattgtcatctttcctgtccatatgtatcaacaaatttcatattgtcatttcactagcatgacagatatgtcaggcatgtcatttttactttataattctagtgctgttaacatcctgctccatagacattaatactttcagaactttgctaatgatgaaactgaagctttgagtggttgtgacttgttcaaggtcaaatagatagtaagtagtttaattaaaattgaagttcaaggctgagtgattccaaagtccataatttttccgctacatcaggttttatatatatcaacccaaaattcctactattggatatgctatgagacagtccttgcgggagcaatgtcaattctacacactcctttccctggagattcatgttcttcagaaatcactgacagctcctaaaatcaagaagctatggtggaagaaagaaaactgtcggcaccagagccccgtgattttcctaatatcagcatcttcatgactcaggaaactggatttccctctacaactatacgttccctaaaccttcaaagtgtgtagctgggaaaatgtggattcgtagtcatactaataaagttcttaatttgtgagagctccaaaccctcacctataataagtgaggattaggtatcttatctctgtcttggacactaagaggttcaaatgagatattgtaagtgaaaatgcctttcaaaatgcaagtccataacccatttacaaatgtgctcactgccaccagattcttttccaacaccaaattttctcagaaatatgaaaattcttcaatattttccacaagtgatagcagacagggtgaaatagaaagtttgtgcattttatgtgcagctttcatatttggtttaagttttctgactctgtatcacggaaaaatcttggtttattttattcattgactcaatatttattgaaggcatactaaaagctacgaactttgctgagagctggtactataataatgaataaagcaaatctcttccctcagttaaagggaatgcaatgcaatgcaatacaatataaaccatatttttcataacccaggaaatatacttggccaaattttggggagttgcagaaggtgtctgaactagaaccagcagggtgaatagcagtcagtgaggcatagtacgggggagaaaaagcagaggtagaaacactcaggaaatagaaaaatggctgtgcttgcatttttaaaatagatgctctcaaggataggcatcttctaaaaatgtccatactctcaaatcatatacaggtaatttctcccccagaacatactctgattgctttatcaatgtcacaggatgtcatccataaaaatatgtcaaccttttaaagaagtggaagtatgaaaaggctcataacactttctcttaatccccttccctctcagataggatgtctatcaagcattgtactgtacagaatgaggatgcctctgcctgggtacttaaattattgatcaaacctgtcactagcaaattctttaaactggatacattttgattgagtaggaaggaatgtttaaatggatgcctgactgtgaagagaatggttttgcaaatgtctccacagtgctcctaattgaagttctgataatatagcattgcaagataacttgttctcctctatttttaatatggcaatttaaaatgtgcatatatattaaaaaacacaggagtagaaagcatcagagattgataatactcctttcctctcctcttagatgttatttgggaaaaaatatgaaatatgtttgactgagtgagaaaataagttttaccatgccttctgtattcaggagaaagatttattattctaatccgaatagccttctcaggaagtctaggttcccatagaagacaggaaattaagtgtttttctatagcactaaaagacacataatgtattaaagagaatatctaaaagtccgtctgttttgaagctatccagctgcagtattctcttgaaaagatcatagcaacttttctcttatagtttccaaagtgatgttatggatcaatttaacagttttcaatgagtatatcccttttaaaatgtcatcttataaagttcatgattaattgcatgaatatccatatgaaacagcattgcctctccttaatccacctccccaatgaaaagctaaatgcatatggactagccaaaactttagaagacatggtatcttcgtgtgtttgctactgaattaccaacttgcatgtcctaggaatagtttaatatgaaggcatacaatttctctgaaaactactttttcttatctctaaataatggtttcttcatctcaatgcaaataatattaaattaaaaatgcatactgtaattctgaattttaaagtgggagaaatatacgtttaaagaagtaatgatacctaaagtccaactataaagtaacagtatgagaaatcctttaagctcttgaatatatttctagctaacattaaaatggatatttcattcagtacaatattcactatatagccatatcatagacgactagatttgatatttgaaattttaaagtctaaattggcaattcaaagataaatcttctccacaaaactttagttcagaactagatagcaatagtaaaattgttctagaccactgaaaacatgattgttttaaataaagtgtttttatttatgcatttaaagatatgtcactggggtagcatactctggcctgcttttgttttataggtttataattcaaactctaaagcacccagtttaatcagaaaaatgatcccagtatattatatttttttgtcataatatgatgccctagtgttctattgctcttttctcaaaaatttccggaaactttattttccagtgactattccttttcccatttatgaaaattccctatgcattagctaatatgatttaaagcaattttgttctgttttctcctttttaaacatctttcacacaatgattctcttttggaccctccatggatggtgaatataatttcaatggggtgtttaactcttacttctcataccagagtcaggaggttgccttcagctgccttttcaaggaaagttcctgaggtttgtctcaaatgtatttgattttttttgacaaagatctgtgcttttacaagctttatgatgggtttatactttctgcaagttgcctttctaaaaacatgtgtaattccccagcagtcctttaaaatagagtcaaaatacttttcttttggagaagttttaccccaaaggctagtatgttatatatatttcctgctttacttttcattttaaaagatttattcttaatcccaggcatattgaaacattattcagacagggtatcatgtttgctgggtctctgtggcatactggcagcctgcatcttgccacaagggtagctagaagcaggtctctgccctgtaggtggctgaagccagagaagcttggctcttccaggtaggaaatcaacctgtcaagaagagtcatggaaacacgattagtttactaacttcattaaatgaaaacgtttgcaacacagggctccctttgctctcagtgtctgccgttgctaaacaatccagtgtttcatggggcgaatggaatgccatgtgtactcccagcaggaggacattccagaaggccatgggcttcctttacctggtgatcttgtggacttcatgcgcaatggcctattttgtgacgctttctcttctgtatttctcaataacccataaccacaggtacacaaattaggaataaaatgaaatagaggtcgctctgctattttcagatcttgataaacctgatttaagatttgtatatataagctatcaacttcttgagtaaagcatttctgacgactaggcccattgccccagaggtttgccttaatttcccaaaagaaatgtgctaaaatgagtgcaaattaacttccaaaaagaggatagatttcattactctaagtgcctcatgctgggagaaaggtgctgttgagctcatatttaagggtgattagaactgcatctttttaactcgaggattctcaagtatgcattcaacttacttgctggtagtttaaactgtggaaaatttgaaccaaatgtgtatatagtgtttttttcccctcacatttttaaatagcagactgtggaagtgtggatcatttaaattctaagagtagtcttttattttaaatttaaaattgttttgcaagtaaatagctaagtcaagtgaattaaaaattgttttgcaaacacatagctatgtcactgttccttagagttttttttaattaacatacatacacacccaggaaacctcatttaggtaggcagaaatatgttctcttaagtaatgagtttgaaagaaagtcttttcttttaatggaattgacacactctgtttaccattctagaaaaagttagagaaaaggtcggtggcctgtacttgttctacactttaatatttataatcattgaatacattatattcataataacttatgtttgccatcattaattaattttaaatttttgggtttttcaaacaaaatatatagctacctattgtgttattagctaagaaatatgtctaagaaatgttaaaaaatacatgatactaaaagttataagaaattacacattggtattcagtgatgtgagctagtctgcaagtttatttttaatgtaaaactttggctaattgattttttttctcataccagataaatatttcttcataaggccatctttttctagagtgggtcctgcaacacttatttggtgcaattctaaagtaaaggtagtacaaacatattatatatttgactactaatttatcttctcattaatttggttacagtcctccttgctaagtagtgaacaagccttaaagaaaaataacaataaataatatcaaagggttcagtattattatatgctgcattgggaaaagccactctaaatataacacaaaaagaaggtaattacttcaataataagaaatgatctttattaaacacattaagttgtgaactatattttattcattcagcttatgaactcaggggaaaatatatagagttattgatcacaatgtttcaacaattcttgtgtgcacctgtgtgtgtgtgtgtgtgtgtgtgtgtgtgtgtgcattcatgcacatgtcagagatgggaacacggtataatattacatcaaaatagctagctacagaattgatgtaatggcataaatattaaaattacagatatttatttcctgcaaaaatagatttattcagtaagggccatatttcataataacttttgaataccatttcatagaaaatactgatattttgagtggaagttggatggacttttcaataggattcaagaagtgagtaggtatagacagtctgtttacaaatctgtgcttcaggtatatatagagagtatctcagagttaatagtaatcaataaaaagcctccagaggttgaagtaaaaaaatggggttggggttaggcaaagtgtggcacagtcgtcacatctcctctgtctattatacagcttatacaaatcagagcacttggtttgtgacaagggatgtttctattctcattgattagtgctgagtgaactattctggagggaatgattgttttcagagagtcacgtgtggtataattgggttttagttgcattgagcaatgcatcaatgtagttacaagacatgcatttggtactcaaaggcatctgcactgtatttatgcatgtttcatgtatgtacacatccataaaatatatcaaggatgtaccacctaggaataaatatggcacaatcatacctattatgtgagaacacattaacaatactgactatattacaactatatcttgctatctatgagtagggtagattttgagttattttccaagaatttgaaacaaattattgtaaaacagctaaagtctgtgacgtaatcatgattctcgtgattagaattgtatattttgcttagaatagtagcttataataatactaggtattatttactaaataccatccatggtgttcacatattatctaaccatatgaatcttacaagatttttattatttatttatttatttatttatttatttatttattatgacagagtctcactctgtcacccaggctggagcgcagtggtgcgatcttggatcagtgcaacctctgcctcccaggttcaagtaattatcctgcctcagcctcttgagtagctgggactacaggcccacgccgccacgcccggctaatttcttttgtgttttagtagagacgggtttcactgtgttgcccaggctggtctcgaactcctgagctcaggcaaaccacctgccttggcctcctaaagtgctaggattacaggcatgggccaccacaccgggcctctcacaacatattatagctgttttacatatgagaaaatcagagagggtaagtatcttgcccaagaccaaaaaccactagcagatttctgagccaagatatgaatgcagctccctttgaaatggaaacctgctctaattctgctgcaggaggttttctccattattgatactgtgccctaaaatattaaccaaagatgcattatgtacaaatgtacagccagatactgtctgtagtccatccttcctttcaacaaatatttactgtttaatattcgtataaataatatatgcaatgcaaatattaaaataagtaattttatttaaaaagtaatgttttcaagatgttccactggagatacagctttgttctatagtacatgggcttcaaggagaaatttagaacatatttacattttacattttgcctttctgcaacaaatcttgtgtcccctgaaactctccagtgggaatagtgaacagggaaggtgccacactaaacatctctctcgattttatgcgcactgtaaaaaagcatacacatggctaattccaatcattgtacatatgtgttagaaaatggtaatatagttctttcaacacctatttttaacagtgtctagttattgggctgatgtgtcagtttcaatttatctgataaaattatgattatcaaagatgcagattatgtcaattatatattaaataattcactgatttacctgtgaaagtttattcgtgcagtttcattcagtagttttattaaacatctactatgagtcagacatacatctagagtcagataaaatggtgggtaaatataggcactatcttggcttttctgacatttctcatgcttgaactaaaacaaccacaaagtatccaactaataatttattcagagttatgatgaatgctataataatctactttctaaggtcactgagaagtgacatttaagctgatatcctacaaatatgtactgagcacatactatatgccagactttgttttgagtattgaggaaatagcagatatttattctccaatatagaatttatcatacttgttgattaatcataagtacttttttgggagaaatatgtaaaaagcataggtcatctgctatatacttttcatttgggagtttcttttcccaccttttttttgtagtttccacttccatcatcttcctacacatggaagagcaaacctccattatctattttcatggaaatttatagttcattgcctttaataacaggccataattttatttgattgcataccatgttttcccccgtatttttatttactttattgatattcttaaaagatttacaatcaattataagtaccaatttggggatttaaatgtaaaaagtgaataaatgtgaaaaatgaactgggttattgaatcatgcgtgatctgtagccaatagagtgtcttttctttatgagaaataaacagtctcctgcaccaaaactgaaatgtgttatgactttttcaatataataatttaaattactgtgagccatgatgattattttgatcatgttaactgaaacatgaataataggagccactgaaaggctttgcctttatttcgttgtattaatccttgtgttgtacaatctttgttgtactaatctttgtataaatatcactttaaaagttgacagtttctgtactttatttgatacaggagaagccaggcaaaataattatcatggatccaatcaatacaaataactactcttggaagtgcaggtttaaggagtttgcttttaggtgcagtaacagggcatgaacaagttttaactatcattatgggtaatggaaagaatttattgttgatgaattagaatcaacagcaaagtgaaaaaagtttaaactgattagtggtattaggttttttgaagattcaagcccttgtgtaactgaaacgtcatggaattctaagtaggtagcttcctgaaacagaggaaaaacataatgtttcattctttctgacatttatctggtgggggctggtgagggaatatggtgggaaatagagcacctgaacatagaaagtaacaaaatggagtaaactactaataatattataagggaagaaaaactgaattacgtatttttacttcgtagaaaacttctggctaattttctgacagaagaataaacaaccaattctaaaatgcgacaactcttttaatctcaatatgcatttcccaaccaatgatgacattttacatatgcattgccacatagtgaaatgagagcagaagcaaagtaactgaaggacaggccaaattaggtcaaaaagagaacccacttctatccagttttattttatcatattataactcttcagatacaaatcttattgcacagcacggtgaaacacaagagagaattgatgttctataaacatggaggtgctcactttgctgtttgtgtaaacttgaaaattcattctttcccttgtaaaaatgctctaaaatcaaacaaagaaaataattataattaaacaaatggaatatgttttgtcttctctttattttttaaaaacagaagttttccatatcaggtttataatcaacagtttttagttatgtattttagtggaatactaaacatgaatacagagacatttgtgcagtcacaaatgtttaaattcctactgccacaccataaaagactaggattttattaataaaatttactttatacacatgtataaaataatgatcagaaactgttatcaaagtaattccaaataaatgaagttagatttatatctaaagcccacatttgttgttataggaatgtgttctggattatgtaacacctattttcactttttaaagtccatactcatttacattaattaactacacatttggggtagttctgtaaattcatcttgctacgtttatgatagttttttaatagactcaggtagagtgactggagtgattagtgaattggaagctattgaaaaaaataaaccatttctggtgatgagactgcggataaaccaatctagaacattcagaaatatctaacttttttacaaagtcagttcaaacagtgaaatttttatctaccatcacctttttttttatcagttatataatcttaagtacttaactttataattttcatgttactgattttaaaaccttgagtttgatttctcctgattatttcctctatgtagaaaataacaatttcctgccatacaaatgattatttagaataaaatcaaaacgatattttaaaacaaaataaaattatattatttcccgtaatctatgcctccatcagaccccttcaatggcactttcttttgcatctaaagtgaaattcaacttattaccatagcctaaaaggccccaaatgaattgtcctctccttccttctcagaacttggctcctttgtctctcctctttacttaacttactccaaccacgttcttccactttaacatagaattagaacaattattaaaatgtgttagccgatgcggtggctcacgcctgtaattccagcactttgggaggctgaggagggtggatcacttgaggtcaggagtttgaaaccagcctggccaacagggtgaaacccatttctactaaaaatactaaaattagctgggcacggtggtgggagcctgtaatcctggctactcaggggctgaggcacgggaatcactaaacccagggggcagaggtgcagtgagccgagatcatgccactgcactccagcttgggcaacagagcgaaactctgtctcaaataaataaatacaataaaaaaataaaaatatgtcacatcactcctctttttgtttaatggctgacagttttaaaggtcattacatctgcctagaatagtctgtgcctcaagtgtctaatgatccatctctctcaatattttgggctcagagaagtcttcctggtttaccttcatttactctttcatttactcagtaaatattgggaaaacacttaggtgctaggcaattttctatgcaattggaatatagcattgaatgacagacaaaaatatctacactggtattatttataccctaacagaaaagagataataatacaacaaaataaatctattaggaggtaatcattactatgaagcaaagaaatgtatagaaagttctagggtttggggatgcaattttaaagaggaccctactaaaaaggtgacatttgattaaagtcctgaaagaattgagtgggcaaaccatgctgataaagggtgagcatgtcagctatttacaaatgagcaaaggccctggccggaagagttgttggtatatttcacgaatattaatgtttccaaaacaccaaagattctgtctaggtcctgttgctcaatgcacagaaagtcaatcactgagacaacaagtattgccagggaagtagtcattattttattatactcctggtgatgtcagcagaagacaattcctaaatctgttcctacctcccaactaaagttaggagtttatatagcaggaaaggaatgtagctaagtgtggggaattaaggaattaaggaggggtaaggaagaagcgttggtcaactggaagcaggtgatcaggcaatcatgatagatgaggtctctgctgccttaattgtctgcatatggtgatcttgttagttcagtcccttgatactgtctgggaggcctgagagtcagtttcctgaggaaggaactcagataaggcaaatgtaagtttcaaactttaaactaggaggatcaatttctacgtgtgtgtgtgtgtgtgtgtgtgtgtgtgtgtgtgtgtgtgtttccataaacatcagttctatgggacccttgggctggttccattaagaaagctagttttcctggtgctacgtgaagtagggagagaggagtagagcgtgggacaagtgagtaagagaagtgaggcagatcaggtagggccaagcagaagtacatggtgagacttctgataatgttctgtgtgaaatcagagccgttgtagcctttgaactgaggaggtccatcatctgattaatgtttcctctggctctgtgttggaattaaacggtacattggcaaaggcgaaagcagggagaccaattaggaaggttctccagtagttaattgagagattatggagtcttggactatcatggcagcagtgaaagtgatgagaatgggtaaaatactgagtatgttttgaaagtagagttgacatgttttctgctggtttagctataaaatgacacagaggagtcagaatagttccagaggttgtgttcttggcaatggaaaaatgtcatttactgtaaaaggaaaagactgctagtgtaacaggttttaggaagataaccaaattatatggtatgtttgaaagtcatttttaatccctgggcttgggtgaggaaatgaagaagtgtacataaacaaaacagaaataatgtgttgattcacttcaacatcaagaggtatgcatatcagcaagtaaaagcacttttccccccactcccactctcctacactcttattctctgcaacatgtccttgttttgttttcttagttgttcttatttctacctgaaaataccttattttttagactcactttatatcatctttttgcctccactggaatgtaagctttatgaaaacaggaacatgttctatcttttcatagaacctgactactggcaagtcctccaaaacacttttcaaatggattacttaattttccaacctatttttggttttaacaggaaaaacatttcaagctgcagaacaattacgaacagaaaaataataattagcatttattgaacgtcaagcacagttcttagtctttacatgtaataaatctaagccacagaacaaccctgattggttagcattatcattatcctgattttacggatgggagaattttacagatgggatcataggaatactaaataccttgccaaagtttatgtgaagaatggtcagagaattgaaattataaaccaaatcagtgtccttttggcattcaagtgagtgtccttttaccatcatgttgataattctcaatgaaaagaaatgataatgatggggtcaataaaagcgtgacatctacgaggtttggagattttcatgggctgactcagttaagggaaggtgtgttgtcagctaagaaaaagaaagaagcattaccatccagagtaactctagtattctgggaatatatattatacaggcaagaagttaattaaacctcccaccaaaatacccagggacaaaagaaagaaaataaggaagagtgagccaacatatttaaatacacttaatttagtattacattttttagaagaaaattttaacaaaaatcactgaggtcaacactcttatctacagatagagaaattgtggaaattagttcatgttacacaagtagatattgacccaaataagtgctgaattttacctcaactctcccttcttcccactcaagattctcccgtggtatgacattgaccttgtgttttctttagaagtagaagaaaacacatcaactgtccatcttttattttttctgacagctaaaaatatgtctgtatgtgttaatataagtcagattactgtttcagctacatagggttatgcctacctgacaggaaaacataccagaatttattttttttggaataaaaaaactagaaaataacctaatatgtgcatgctttctgataaaagatgattactcatcatcttttgtaagattctacaaaagaatgcaattacaaatttaaaaaaaacacctggtgaatgcttgcatataatagttaccatcatgcaaaacaatgtcacgtagtcaatgttggatattcaggctagagtacatatgaatttttaaagtacagtgctctctgtgagcaaaccatctttctaaatggatgtgtcacaccattacttggtaggacatgaatgattatagccttaaactggtaatatgccttcctgacacaaatatagagctatgatgctgtataatgttgacatttatagccacttctatagacttcacctcaaatctttgagtggatacagaatgtactgtatatctattttaaggtgcctgtatgtggacaagcacagcaaccattaagtgattaaaagtgttataggcttgagtattctattactgcatggttttcaggagccaatagagataccgacttgaaccaatacttctatgtgagtggaaaagggttgctatcacccagtaatgttctcagatgaaaaatccaagtaaatattcccatcattagtttcatagtaaatactgtttgtgtgagcctttgaacattattaggcatattaaactcaaaagcaccataatggttgcataaatgatattgcatttcttcagtgttacaagaaaaggaggcattgtggttgagaaaatggtcaggtaattaaagtgtaagcttaaaaatagaaagcatgtttatttaacctgagattgattaaaatgcttctaaacagttttaaaagttctttggccttaataaagaattctgaagatactttcaattcatatggataacaaaatatcatttatgtatacattaaatatactttgacaattaccatcgtaacagcttatattaacatggcacctactatgtgtcaaatttctatgtctttacctatactaatccaggtagtcgtcagaagaaccctatgaggtaaacactgttacctggattttacaagctaaggaactacaacagagagataagtgggcatgctcatggtcacagagctagaaagcaatctctatctaccattggtgataactgaaacgtacaggacttaacttttctgtatctgatttccttcagcgtggaggatctcagctagcagagagaagctgaggcttggttctgccttttactctttattcccactgacagtacaggatgctcattaagttgccttatggctggctaaatttgatattaaagttggtactcaacattggtactaaaaattaatggtttcagaattaactcctgggggtgttctatgaaaatgaaaaaaaattatatgtagtatattaaagtaattcatcctgtataatgggatcctggagtagacaggctgtgctaagcacatttatctgagagccttgagccaactgttaaatttctgtatctgaggtatatataatatctttatatatatcctgtctgtacacacatatattaataggtactgtattgttagaaattaaaattttatctaattttataagttcttcccagtgacaggtaataactcagaggttcaatatgtgcgtgcgtgtgtgcatgtgttcatgcaaggggtgacagagagagttgagactcacagagacacgcacaacaggaaagaaatgtgtggaggagctaaaaggctgcgattcctaccccttgccactctgccattcttcctttgtttccactcaggtttgattaatagaaagtggatccctttatactgcattttagtcagaggcctttctgttgagtgaagccattgtgggtaaagtttaggtttctgggttgtgaacatcaaagaaagcacagcctcagaggtacctaatgtaacagaccatgctgttttgccttcagtttaggatttatcctctgaatactcacctgtgttttatcaaagataatgtcaaataatacaaactgtgaggctgccaacagcttcttgttggacggttcttctgttgtggttctaagagttcctttctggaggttttatcaccttttcttcttatcattctaactacacacttctctctgaggttttatataagtgcagataagcaaaaattatatgttcctttacaaacgtatcaaagtaatggatgtttaattattttaaccaatttcatcatgaattcaataatcttttgagaatttctgccaaacttactctgatatattcctcgctcctctctgatgaatcaacgaatgaaaatactgttgaacatgtggtctcatcagaattgtgtggggaggaaaacatgcttttacacatgtagcatacatcatatggaaagaatgggtaccctctcctccaccaaaacacttgaaaacaatacaatagtaagttatgaaaaaggaattgtgacaagtgttaattaaaaattccttattaattattactttgtttttcatttttagcacaatttaaagctaagtgtcattatgtgtttggttaacagtaaaactgtatcttattgcaaaggaggttgaggcatatctataaataaggatcacaatctctagttaattttaggccctgattttcaaagctttagcactgctgatgaatttgtttttattgtcactgtgtgagttttcaggcacataaagttcagttaaagtcattgagcaggcagctctcttttgagcactcaactcttttttacagttgggtgtcttttataattgaaataaattattaaatccacaagccaagttgttagatgtaaggttattaatattttgtttgttatgtatttttaatgacagatttatttaagaaaagaacaatgaataccaagggtatattgagttgagtgacagatagctcggtttcttccctgccaggctcaaatcacttggatgactggattggtgccatttttctttatataccctttgtagtcagcataatgtttgactcatcactggaactctctaattaatgaatgaatgcagaaagggattcaggttcagttaaagcatttactcactctgtgaccttgagtaagtcactaaatctctttctcctctaatatcatcatatatattatggggttggtctagtttatctttggagttcctccaacttctcatgcagtttattggattttatgagtcagattatatatctaagaaataattatggaggctagaaaactactgtacatattttcatttttgtgttgtattatagagaaaaatgagtgtgtactatggtatgttatgcagtatacaaaattttcagtattttggatttcaaagtattatctagaaattatgtaatgtgacaaagaaaaagatagagacagatatatagagatatagataaagaacatttgcttatgttttaagaattaatggttggtttaggaaaaccttccataatcataaaaagatgaaaaaagataagagttatttacaggattcttgagtagtaaaatcaataagagagggcagatgtaagataacttatggtcaattgtaggcacttaaaactgaagacttactattaaattgctaactgagggccttgaagtgtgatgttgcatgagattgtgtgtaaggatcatttgctccactttatgagtctgtcactttaaagatcagaactgttaccctgtgatgctcacatttggtctggtttataggacatgtgccagctggctaggctaaatgaaaatgtctacttcttcaacaaacttgtaatctatgatccttactctacttttctaagaaagattactgtggatgtatggtagcatcaatgtctaggaaacagaggtgatgtacattacctggcaattaaattataataatataaagttgacaaattcacatgctccagtgcccaatgaaactttagtctctctgagaatagtaagaccaattattctatagttctaagaaaaatggaacaaagacactataattccttccagaaatctctgtagtaaagataaagatcattttactggaaagtaaggagggataattcacttataagaattacagttagcgccctgtatccatgggttctgcatccacagattcaaccaaccatgaatcaaaaaagatttttaaaaagaacaacagtaataatacagcaataaaaataacacaaattttaatatacagtataactactatttccatatcatttacattgtattaggtattttaagcaatctagagatgatttaaagtatacaagagaatgtgcggaggttgtatgcaaatactatggcattttatataagggactggacatccacgaattttggcatccacaggggtcctggaacgagttccctgtggaacccatcccttgcggatgactataatttagtaaaacttttacatggaatgtagaaagcatacctttattgaataaaatgccctccttgaaaagactttattaatccaaattttgattttccaatttgtaaatatgtaaagaataaaattcttaactctatttgatctatagaaagcattagcatatcaattcagaaccctatcttccccagtaaactctgcaaatcccccaatatttcatttattcgtttaactttgttcttttcctcttacacacacacatagaaaatgactactgaagtttattacaaatttcaaaagtctttgatttgtgtacatatttatgcacaaggccttatttataaaggtatgtttcatttcttttggataattatggaagactgggctggctaaatcatgtgacttttacacttctaacaaaatgtcgacatgttttccatagcatttgaaacattttgtatctctgcctgctgtgtatgagaactctagtttctttatatcttcaccacccctttgtattgtcagtctttttaattttttgccattctgataggtatgtaatggtatcccattgtggctttaatttgcatttccataaagctaatgatgttgagtgtcatttcgtgtgcttatattccatatgcatattttctttggtgaagagtctatttaaaggttttgtcctttttgagcggggagattatttttttaaactatggaattttgaaagttctttgtattttctaaacacaagtactttatcagattataaatcaaatgatttataaatacttttttcccagtctgtattttgcttttcattctcatattagaatcttttgaaaagcagaattttgaatgttgatgaggtccaacttatcaatttaacaaaaattattgtgcttttgctgttatacctttgcctattcaaagagtcggggaactttcttttaaggggccagataataaatagtttagactttgtgctccatacaccctctgtgatatagtttgtatctgtgtccccactcaaatctcatctcaaatcgtaatccccatgtgtcaggggacgaacttggtgggaggtgattgggtcatggggacaatttccccatgcgtttctcatgataatgagtgagttctcataagatctgatgatttaaaagagtgtggcacttccctccttgctctttctctcttttctgctgccatataagatgtgccttgcttttccttcgtctactgccacgattgtaagtttcctgaggcctccccagccttgtggaaatgtgagtcagttaaacctcttttctttataaattacccagtcttaggtagttctttatagcagtgtgaaaacagactaataccgtctgcctcaactaatcatctctgtagttgtagtgtgaaagcaatcacaaaaatatatttaaatgaatgagtatggctatgttctaataattaaaatttgaattttacataattttcatgtaatgaagtagtatactttttccattccactaatcacttaaagatctaaaaaaagattcttagttcatacataatagaaatacaggtagagggtaagatttgtcccattggccatgggtaggttgccaacttttctcctaacccaaagtgacaatgattttgtcttatgttttcttctacaaattttatagttttaggttttaacattgtctataatttatttttattaattttgttatgtgttccaaagtacgagtcttagttcatttttgcaaatgactatctaattgtttcaataccatctgttgaaataaccatcctttctctattaaattacctttgcacttttggagaaaatcatttgttcaaatattctcccccaataccattgagaattacagttaaaaatgcattactaaattgaagtagcccaatgctcttcacattttaaaatgctttttctctgtgttcttcatttttggtagtttcatttattccttgaactttgttcttttcctcttacacacacacacagaagatgactactgaagtttattataataatacacatagatgattgctatcctttctcaagctcatgaaaattttcctgtataatatttaatctgccaccatccaattcaatgtatttttcatatcaggcattttagtttttatctctagttttatttgggcctcctaaaatatattccttatttgtatttcagtatttggacatatagagcacagttatattcactgttctatgtccatgcctactaatgctaacatctatggcagttctgagttgattttgactgattggtttctctctctattatgagttgtatttccttgcatgccatgtaattatttttttggctgccaaacattgtgaattttatcttttgcatgcttcatatttttgtattcttattaatattcttgaacttttctatgggacacagttaaattattgaaaaacagtttgatccttgtgagttctgttttttacatttgttacatggattcagagaagtgtttaatcaaggtctgatcattcctcactcacacttgtatgtatacacataccttggaaatattgtggatttattccagactatagcaataaagctaatatagcaataaaatgagtcacacaaatgttttgctctcccagtgcatatgaaggttatgtttactctctaccatagtctattaagtgtgcaatagtggtatgtctaaaaaacagtgtacataccttagttaaaaatactttattactaaaaaatgctgatgatcatctcagccttagtgagttataatctttttgttcgtggaggatcttgcctcaatgttgatggctgctgactgatcaggatggtggttgctgaagggtggcacccttcagctgtggcaatttctcaaaagacaataaggttcactgcatctttcacgaaagatttctctgtagcatataatgccatttaacaacattttctccaccatagaacttctttcaaaattgtggtgaattctctcaaaccctgcttctggtttatcaactaagtttgtgtaatattctaaatcctttgttattatttcctttttttcctatattttgagacagactctctctttctctgtcactcaggttggagtgccgtggtgcaatctcagctcgctgcaacctctgccaccgggttcaagagattctcatgcctcagcctgtcaagtagctgggattgtaggcatgcaccaccacacccggctaatttttgtatttttagtagagatgagtttccctatgttggccaggctggtctcgaactcccaacctcaggtgatctgcctgcctctgcctcccaaagtgctgggattacaggcatgacccaccacacccgacctctttgttgtcatttcaacaacattcatagcatgttcaccaggagtagatttcatctcaaggaataatgttctttgctcatccataagaagcaactcctcatccactgaagttttatcataagattgtagcacttcagacacacattcatgctccacttcaaattctagttctgttgccatttccacaacataggcagttagttcttcctctgaagtcttaaatccctctatgtcatccataaggattggaatcaacttcttccaaactcttgttactgatgatattttgacatcttctcctgaatcacaaatgtttttaagggaatctagaatggtgaattttttccagaaggttttcccttttctttagccagatttgtcagaggaatcactatttatagcatctatagccttacaaaatatatttcttagacaataagacaggaaagtcaaaattactccttgattcatgggcttcagaatgaatgttatgttaacacgcatggaaaatctttgtatgtacatcttcctcagagttcttgggtgactaggtgcattgtcaatgagaagtaatattctgaaagaaatctttttttgagcaataggtctcaatagtgggcttgaaatattaagtaacccatgctgtaaacagatgtgctgtcatccaggctttgttgttccatttgtagagcacaggcagagtatatttagcaaaattattaagggcccttggattttcagaatggcaaatgtgtgttggtttcagcttaaagtcaccagctgttgcattagcttctactaagggagtcagcctgccctttgaaacttcaaagctaggtattgacttctcctctttagctgtgaaagtctcagatggtattttcttcaaatataagactattttgtctacattgaaaatttcttgttacgtgtagccatctttatcaattatcttagctagatctcctggataacttgcttcagtttttctatcatcagtacttgctgcttcaccttgcagttttatattatgcagatagcttctttctttaagtgtcatgaaccaacctctgctagctgtcaacatttcttctgcagctttctcacttctccaactttcatagaattgaagaatgttaggacactgctcaggattgggctttggctaaaaagaatgttgtgaatggtttgatcttctctgcagaccactacaacttctttcatatcagcaataaggttgttttatttttctatcattagtttgttcaatagattagtaccttcaatttccttcaagaactccttttcattcacaacttggctgtttgtcattaagaggcctatcttttagcttctgtgggcttttacactcttcctcactgagcttaatcattctagtttttgatttaaagtaagaggcatgcaatactttctttcacttgaacacttacaggccattgcagggttatgaattgggttaatttcaataatgtgtctcaggggatagggaggccagaggagaagcagagagataggaatactgctagtgaatggagcagacaatatttatcaattaaggttgccatcttttatgggcatggttcatgctatcccaaaacaattacaaaaaggaacatcaaagatctcggatcatagatcaccataaaaggtataatagtaatgaaatcatttataatattgtgagaattaccaaaatgtgacacagaaacatgaagtgagcagatgctgttggaaaaagtggtgcagataggcttatttgatgcaaggttgccacaaacctttggtttgcaaaaaactcagtatctgtacaataagctaagcacaataaaatgaaatatgttggccaggcatggtggctcacgcctgtaatcccagcactttgggaggccgaggtgggcagatcacttgaggtcaggggtttgagaccagcctggccaacatggcaaaaccccgtctctactaaaaatacagaaactagctgggcatgatggtgcatgcctgtaatcccggctactcaggaggttgaggcaagaggatcacttgaacctgggaggcggaggttgcagtgagatgagatcatgccactgtactccagcctggacaacaaagcaagacttcctctcaaaaaacaaaacaaacaaacaaacaaaaacatccacctaacgccccatgaatcttgaggttttctaatttggctggtgggaacaagcatttttccatgtcatgtgcgagcaccaaatcccatgcctctactacatttggatagttctttccctgacctcaggagatttggtcacacatgggttgattggcactctgctaaaaactgaaggggaacttttgcaaatggcctttctctctctctgtgcagctttcttctccctggtgttctctgcaaaaaaactctagtcatcttggtctccctggactttcatcttcatttcctaaaacccaagaattttctgagctctactttggttttctgtcctcctgtttcagcctagaaattcttacagcagtaaaatattgcaccatagggtcatccatttcccttttgttaaggatctctgttctttgttgcctgatatccagtgacttgaaaactgttgttttagatggagtttttatttcattttgtttcttattttttgttttggttgtttcttgtgagatggtaaattcagtctctgttactttttcctgaccaggattcaaggattaagttttgttatgtattaattcaattaaaggtattttttgtgtttttaaaaattatacattggagatgccaagacataaaatcctataaaatagttaagtgtgctgaaaattattttaacatggagtacatatatgggatatgtaaattaaatattataaaacaggttaaagtaatatatgattaactgtcaaattaaagatggtaaggaaaagaactcaaaataagaataatttattgataattatatgtttagagaccccttcatgggtctctactatcatcatgaagatgataatacaggaaaactcttgatagctggtatggaatattttcataaagtccttttatgcaggtaaatgacattatataaagatgtgttgtacaaaatgattaatgaagagattattttatgtcagaggacaataaaggattaaatgtttgaagacatatgtaaatatcagattttagaaactttaagtttgtctttttatataaaggcaatagtaaaccattaaaatttttggcattcatttgtaataagatggtgaatgccactttgaacaagaataatcaggaggaagtgacaaggaagcaaatactagacagactagaaagaaaactattatacttaatcaaggtggattaaatcattgtaacaaagatgaaaagaaaagacagagcagcattacattatataaatttccagtagttggtgactaattatatgcaagaatgagaatatgggaaatttttaagatgaatgaaattttaatagaaagagcataatgaaactatcaacagaaaaatgtaacatccatagcctataaaactaaaataaaagaacccaggaaaaagtaacggcatcatcataaaatataaaaaataaaaaaattatgaagtgtgcaataagtgccagcactattaagtctttacatggaatacttcatttaatcactacagcattattatcagcttatgtgattgtctttctgtaatttaaaagtaagaaaataagtattctatccaagatgataggaagtgatgggggcaggatttgaatttcaatatatccaacttcagaatccagtctcttattacagataattactaaaacgttataggcatagttttaaagaaaatgtattgggcaggagtttgtctaacactgtatatgaaataggaaaatatagttgatttgtgtgatatccagccttaaggaaaatttttgatagccgtaagtaacgactactctcacagttctgcctatcaacaatctaagatagtattgcaatgttctacatatttaagtgtcgattatattaatttttcatttgggcataataatattattttattttatttatcatgatttggccactaagccaaataaacaacaacaaaagaatttaaaaatattaatgctagtacttaccaggacttgattcacagtacatttatgtcttcgataattgggattacttaactttctttattatttagctactcagtaaatctaattgacaagaaactactaaagtctcaaatctcataatgcattttctttacacaatggattattatttttttaatcaggaagatagtattactccagttatatttgttttctgtaataaaagagttatagttagtgtcactataaactactcttacagcctatttagaattgtcaaaatatcaaacttatatgtaaagttatatattaatatgtaaagtatatgtttcaaacttatatacgtaaagtttgatatattgacaatgctacacacacagagacatacaacacacagacattcacaacacagacatacaaataaacacacaaacacacacacaaactaataagcagagagaaaatggggggactgaattacttagtacatgctatgttacagacaccatgctaaacatttttatttagattatctcatttattactttaaacaattatctttattgtctgaaatctgcccaatgttactcaggtaataagctttggagccagatttcagcctttgatgtctgacttcagagttcaagttcttaaccacaatgtcatacggctctgtactccaagatatactgagtcactatagtgtctgccatttattttaataaaggatatcctgtgtggtgaggccaatttttaaaaagggaacctctcaaataaaatgcacgcctgtttctccttaccatacagccatacctgttctctagagatctctgagtttctctttcctcaccttcatttctgagttacctgatttgtgagacatggttataaagcaaggtagctgatgtttccatgaaagtaccacagatgtcttcagcacttttgtctccctgaccactctaaattaaatgcaatagcaacaaattctgatttttgcttaaggtgatttcacttttcatagtgcttgtcaatgatctagagtcaaacctggtggctaaaagaaatgaccaaataagaaataccatttagggttaaaaatacatgagtcatggattttaagcaccaaggaagtattctcatgtggctcataaaatgtctctcatggcgatgcagaaaagaattttcaaaaatattttgagtgtagcaacattgtaggacgaatgtacagccttctcaatctttcattttaaagctgccacaataatttggatttatatataatgggaaaatttttgagaggaaaagctgataatgtcactttttagtaataaaatatatgtctactcctaaaagagagggcattttgtgagctcactctgagactaaacagagactagtacattactagacacagggggttaataaatgtctttcagtaataaaattggatttcatattaattgaactgaatcacatgacccctcaatttacatatttaagtattttcactcctcatgttggtggatgtttatgatgatttcagcaactattttcacagaataattttagttatctaaatcttaaatataaaatgttaggtcactggaaagtagtgtaaattgagagttaagcatacaatatcagaggatacttatttggagttgcaatcctgacctctttcacaaaattgcatgaatggaaatgtattctaattttttattctctaggaagctccacagaatagaacctgccattaaatgatagtccggaatattatgatatgggtgttgataaactctgtaaaagtcagtggatgatgtttaagaaaaaatggcagggacataggaaactgaaaccaatgtgatatggctattttttgaatactaaccttttaaactttgagtgtactcaagtaaagaagggaaaataaaataaaatgtggctacctcactgccttagaaaagttataaattcttcataccacggaaggaatcttgtcctatgcggacaatttatttcatggataaataaataaaataatgttttaaaatgtaaaacaaatttttatgttagaggatggcatagtgtcatcttaataattttatgtttaaatctatgaaattcaaaaaaagttgtcatctgtcattgaaatagcaacctccttcatattctaaaggcaatcatattcatattgtatcataattttacatttttagtagtaactaagatctatttatatggtgacatggttttccctacttacagttcctttcccttcattcataacctttttttgtgtgttttatacagtctgtctttatactttattctggttgatataaaagaccaaaaggtgttctaacattcaacttgctctgtgggaggtagaaaattcttttattttctatccatttgaggagtttgactctatcctaagtcagtagaagctgagagtaaggaactgaggaggtggaaatgattacagaattacagtcaggggcaaagtggtgaaagatattgtatgtgaatgaagaataccatatggtattgatttcatttgtatgtcatgactgcttatttttctaatacccttctctccacatgttttaagatatctttaaaaaatcttcaaaatgtctatattttctgaatttagaatccatagaatccttgcttgctaatactcttctaaagtttagctctatacaattgttattttatgtctcaagttctgaataacactagcattataaaacatcagtattatatggtccagtagcaatattcatttattgtattacaggattatgcatagtaacatagtaacacttgaacttattctttttttattttatttaatttttttgagacagggtctcactctgttgcccaggctggagtagagtggcataatcagggctcacagcaaccttgacgccctgagctcaagtgatccttctacttcagcttcccgggtacctgggattactggtatctgctaccacccctggctaagttttttctatttttttgtagagacagggtttcaccatgttgcccatgttggtcttgagctcctaggctcaagcagtccacccaccttggcctcccaatgtgctgggattacagacttgagctactgcacccagcctcttggctttagtttaaactgtatttcttgcgttttaaaataattttaattgatggtatttgccctccatactccttattgctttttctatttgctatttccataattattattttctgtctattgttcactgtcttcttcaaaagcttctatcccagcaccagttataaatataaatattatttatatattttctctttaattcaaaagaaagatcttaaaatgcaaaacctgatatctataaaaaggcaaaaaaaaaaaagaagaggaagaaaataaaggaggaaggaggatataaaatgagggaagaagagaaaaggaagggatagattattaaattagaataggttgtcacatatagttttattattcctacacatgagtcaaaaagatcgatttcttatacaaaaatatgaaagaggcaatttagtccacattaaaaaattgatttttttctatatcaattatccaggagcattttaaagaaataaccatgtcatgctgctttgattagtctctacaacatatttagaattttttaaaataaagcaactattttttatgacatgaagaaatggaattctcacaccagaaagaaagcaagtgactttagtacagagaacttcctccatacatacaaatagttcagatgactctttgtgcacctctgtgtttttatgtccaaagtgactaaggggagtttaaactggctatcccttcatgtatttctgccaaataatagtatgagctcattctgtgtgggttttgaaccagacttacttttcttttccttgctgattttcaaactattgaacatctttagaccattttcttctacactggcaaactgttgaaatctgtaactaagagaactcttagtctctgttgtatccccagcccccacttcgctactcacttggtgtggaaatttaaaggtccttgaatctttggaaccaactgtggttttccctccaacttttatcaccagcactttcaccagacagcatttcagcaacaaactccccacttcttttctagtccagtatgaactgtatttcagcctcgatttcagccattcttaccctctaccatttattcccaacgtagacatggtgatattatttgttaaaattagtcaattgttgtttctctccacttccctccaatggttttcccatttattcagaattaaagccaaaatccttacaggactttgactaccatatacaatttgacttttgagactcgttactcaccccatcagtcctaccactcgaggcacactagaccccttgatgttcctcaaatatatcctcacctttgggatttgccctggctgttcactaggccaggaacagtcttttccaggtgtctgtatgactaatatcctcagctcccttaaatgtttgatcagatcagtggtgagctgacttttattcaaaatattccattcacatatcccttctttatcttcccagtgtatttttcatttttcatgttaattattatatcatacaaacaatgtaatatgcatatttattatgttcatgatagtttgtctatttccttttcctctctcccttttcctgttttctgctcactgcatactacaacataaactccaaaagggagaggttctttcttctacttactgattaatcctaagcaccttgaaaagatcatggaccacaattgccattcaatacatatttaaggaatttataaatgcaagtatttccagaggtgtcattaggttaataagcattttattttgatgttggccttctttagccatgcaattaaaagattgttcatttcatggattatttttcaattttatttctgattatttaagactgtgttggcatagcaatttttatgtgatccatgaatatctcctgcattcggaattgttcctattgttaaggaattctccatagatacttgcaatactttccatattctcacaagttttttctttttgttttttaacctctttctattaaaatcatcttcctattctgaatacatatttcagtcttatagttttatacttttcaacatgatgagttatttatcatagcaaataaaaattatcatttaatgaaaaatgtaacggccaagaaaaatattattttgcatggcaaatcatgccatctgttagcaaaatacagaattgacaagctttcactctagttttattctgtgaagacttgcacatttaaagtttacaaatacaggcacttttttgcatccacctgtaaggtagaagaagttacattggattgatatttagaaaatcttaaattaaagttgcttagtgttactatattcttattatgtaatatgaatatgtcatacctccaaaaggtattctttaatatctcctttacctctaaaattcagtcattctatatttgggtttcttgattgtaaggggaaaaaacctataatatgttttctgaactagtgtgtgccaccaattttagtgttgaccccattaaccccttggctgcttccactttcacattatcgctttcccatgtttgactccagtctcccgactatgtgcgttcaaccagactacttggccctattttataatacagagaataaaattttgtgttaatcaacttccttgaatgttttccttatttttctaacatgttatcgatgaaacaccagcttaaatatcataccgaagtaatttttatggaaagttctatttcctagagtaggagaagtaaacagaaaagaaaaggactacatattatgtgcaatgatcataaatggagtcaataggtaagccttcccagatgtggctataaacgtctcatcgtcattgtcgtcatcatcatcatcattactgtccttatcattgccagtgctttctgattgcttactacattccaggcactgttctcagtaccttaaatttaataatgattagtttctaccacggtggtactggggagttaatatttcagtccattacacaaaagataaacctgaggcacaaagagattaggtaatttttgaaaacgtatatagcttgtaaataataacaccagaattctaactgaagtgtctggcttgaagcccatgttcttaattactacgcccatttttatttcatcttagagcaggaaatttaagtcacctcaagacaagataattaactctattgaaatcatcatgaaagaccaaagtagaaagcattagatgatgctatgaatattctgtggctacagtagaattaatgttaacagtggctttcagaaaatttaattttctattttaaccatcttaacaaactttctctaaaagtattaaaataaaattttgaataacaagttatagttgaatgtggcccaaccttctagaaacaaaggaatgggctgtacaatggcagtaaaattaatgatagaaatctcagctctgatacattaccagactctctggcttctccaggctggcttacctaagctcagtctagccatccattcatagcaaattgtgaataatgctgagaaaagccctgtggatttggatctgtttggtcagaaccgtgctgtggtttggctagcttgaaagcaaagagcagaattctgtctttcaatacttgtgaagtggatacttgccaactatgaagttggtccttcgaattggatataattctttgtagatgaagcacctttcatggtttctttggttagggataaagaaaaatgtctcagaattgaaaacacacattaacatagttctctgttattctcacatttcaaaaatcagacataaaattatcaaatttaaaagaacactaatttgacattaaaacatagatgaatatatgcataatgatataagttattactttttgctaggtttcaggaagtttgataaattcctattcctcatgtgcattgactatggtataggttttcaaagctagttctctaaaacaaaaatgttgaaaataaaatctagcataaccatggaaaccaagaaagcctaaaattgtcttgaatgttttcaagaaggaaacataaacttctttgtagccagcatccataactagttttggggaagccttaagattttcaagcgcagagtcttggctaaaaggattgagttgctaaacctaataaggaccaaataaatcaaaacccatgaaataaattaataaaaaaagacgaagtctgaagaaatacaaagtttaaaggcttaattattcagctggtagcattattcaactggttaagtgtgtggaaaaagtcaagaggctaaccacatacaaatattgtctaaatggtatatatatggttaccagaatagtaacagtgctaatgtttgttggattaggatcatctctctctcattttataatttgagacaaggtctctgctgctcaggctgaagtgcagtggcgcaatcacagctcactgcagcctcaacatcccaggcttctacctccacctcccaagtagctgggacagcaggcatgcaccaccatacctggctaatttttgtatttttttgcagagacagggtctgttcatgttgcccaggttggtcttgaactcctgggctcgaatgatctgcccacctgggcctcccaaagtgcttggattacagacatgagtcactgttccaggcctagatcatctcttttggattgtttaccttttttccatgtacttccaaagtttggtttaatatggtaagtttaaccatataagtggaataaaatgtagctgacagttgtgatttacgatagcatctagaaattattgctattgaaaattgactctttagagtgtaatcattaaacgcatagtgattgcctgaatcatctaatgaggtcttggtgattttttaatgttctttgccaattaagcaaccattaagtaatggttgagtgtgcattatatacttggctttgtgataagttgtgtgaaatatttaaaagaaggataaaatggtattaagtctcccttttcaaagaacaaactgtagaagagtacgaaaaaatcctacacatgaaaagtagtacataactgtgtataagtaaagctaagttgcatgatacaaacagtttgattatatgacattaattaatacatgtaaaataacacaaagataagagcaaaatagtttgagaagggttagcaaggtcaactgggaccatcagagatgaaaacataacaagaaattaaaaagggaagctggctataatagtgtgtgggtgggtggtagaggcaggagtgcaagaagaacatcaggaaccctggcataggaagcagctgattatgctgaagtgacggttatgctaagaattctgcttgcacaagttaggtagaaacaactaaaaaggggacacattatttatggactacagccaagggaatttttttttttttttagttttccaataatttgcaactacagattttgagtagagaaatgacattcaactcagcaaacattataaatcctcacctgggttatagttggttatagtcagtataagtggggtgttgagattttgaaatagtggaaaggtttgtgtaaaggaatctgggaataacaattttaatgaaactcggtaatcttttgtagataacattgaattaacgaagaagattcatactgaatgcatatataaaatggattagatgacaaaggcaatggattcaggaagatattcagtcttttcttagactacttttccattatgattgatcacttcttcctaactacagcatctgggaggcaaacagaggaagattctgagaagtgttctagaagttggacagtaaaatgagagagtggtgtcttagaagccaggattaggaaagctttaaagatgaagaaagtagtgaaagtatcaaatgttgcacagcagatcaagtaggctgagtgaagaaaaagagcctttggatttagcaactgggagattatttttgacagtatccaaatggtttcattgaattggtaggagttagagaatgaatgggtataagaaagtagaaagagaaagaataggatactctttccacaaatattttcaagacgaaaacttaattgttacatcagcattttgatacggagaaggggaataggagagaatattgttttgtttgcttcgtttaggaaagttgtatcttgagcctatttagaaacctctggaaaagagattaacaaatgtgagagacatcaccttttatggtgtctaacatgtgagaagtagagagggtatgggagagggaaggaataattctgagttttagcctctcaaagtcatgagatgttctattatttctgccttgcactttcaacttcctgccatgtacccacacaggcacacacgctcacatctaacagtacttttactagcctatcccatattggggcaccagagcactaagcgtagctagattaatctactttactgttgttattattattctaattcatttatttgataggcttcaaatagaaatatttttggtttcaggccaaacctatgttccctaggtcaatagtaatatgtcgaatttctaaacattcaagaaaaaaatgtttttagtaaataattaaatacaaatttaaagaagaccttaagagatctttgggcccattccttctttcttctcttttcacaataaaatgccaccccccaccccccacacacaaacattccatttcataatgccattctcatatcctgtggtttttattactacaagttacaaatcttgtgaattaaaacttggaagcaaactaaatgcatcacctcagaattaagattcttataccaagtcaggtctctgatggaaaactcacagggtgagctccacatgcctttaaactctctgttctctatagaaaacagtacaattgttaaaatgttcactgacttctctcagcagagtttttaatgagctggtacctgtatagccctttgagcagttcaggccagggttctttatatataaagcagacatataaaagtaaaaggcaagtgagtaaaaagcataatagtccatgtgagtactaattgtaagggataggaaaaagatacaatataatagctttaaaggaaaaatagaaattgaagaccttatcacaattatccttataatgcacagaataatgtcagactgctttggaaaattcattaattttttttaaagttagtattgatacgaatttttggggtatatcttctcaatgataagtaggttaactgaaaagcactttgatttaggagatgaagtctaatttaaattatgttaaccccttcctttcttattgtatacttagtttttacattttttcatagcctgggtcttacatcctccaaataccttacctattcacctctccaaaaaacagggacacagtctgttaagtaagtctaacagaatatagatattatatataccatgcaatttaatagatactctatatagatgtctatatagatattcataatatatattaattagaagtaaactcctaaaggtcaataaacaaagtgaattccctgataattcatcacctcatgacttgtcatctgtttaactataagagctagataatttaattggaatgcggatgttttatgacaaatatatgaagtatcagcaatagtaaaaaagcaaattttagtcttctgaagctgtcttagcctgtatttttttgaagcacagtgatttgttgcacagtctttgaagccaaaatgcctaggttcttatcctgactctgccatttcctaactagttactccacctttctgctatttggttttcttatctgtataatagtgttcatagtggtactgctataaaggtctgtaatgaagattaaataaaatgctggagcgatacctggcaaacagtaagcattttacaaatggttgcagttattatttaagaaattattttaaggacaaaaagtgtatacatatatgatgcccctccctatgttataaaattaaataaaatgcatttcagattatggattacaaagagaagaaatataaaatgaaagcatttaacgtcaacacatttccctttgttctcctaactatgaaacttgataaaagagtgctgacattttgaagaaatggactttttggtgaatattacaatttctttgttcttgcttttgacatttactatttcaaccaacaatctaagtgaaaccatgcaaactttggtgcctaaaatagggacaaaaggtggtggtgtgatttgagtaacagaggaggattttaaaattctgcattttgtttccatatatatcatgtacttagcctggaaagaaataaattataatcataattgagtcaagatattttcagaattttgagacatgctcaagtttaacattctctccagtgctagccaaaggacccaatggatttagaagattcatggtccaagccatcaactgtctcttaaaattcatgtttattattctggcttagtgaatagggattgtctttcttcagcaaatgccagctctggaattgtttattgagtgtctacatcattaaaacttccaagggactctttgacctcaagcgtatgtttccttggcacagacacttgtattttcaacacttcggagctggcaatataacttggaatattttgtatttaatgtctgaataatatcctgggatttgttgtccaatgtgaaatggccaagaatattgaagagtggctttgaggatgacacaagtaggtatgattttgttgaaaaggtgagaaaagaggggcacagaaaacaaaaacaaaatccttaaagaaaattaaataacaaataaaagacatagaggtagaagtatagaacctatatagtttatcaaatctttgcacctcagttttctatggtcagcacattactccctatgtatttcctggtttcacttctttcaggacttttggtcacatatatttataacctctgataataatataatcaaaatgtaatgtaaacaatattgctgaaggacttagtgcacttaaagattataataatgtttgtctttgatttttatttattaattccatgcatttcaagaaaactctgaagttggggaagacgttttttagagaaagcttaaaatgtgagagttcattcgcagttacgcaattctggttttttttttttgtagatttattaagattttctacatacacagtcatggtttatgaaataaagacagttttaattattcctttctgatcttatctttcttctttaaattgtgtgcattttgcctcagttttttccgtttttagcttgatatatttataagtattattttttcttattatattgatattttcattatacccgttatagtttcttttcttttcaatttttattttaagttcaaggatacatgtgcaggtttgttacataagtaaacttctatcatgggagtttgttgaacagattatttcatcacccaggtattaaccctaatatccattagttattttttctgatgccctccctcctcccacctaccatgctccagaaggccccagtgtgtgtggttcctcaccatgtgtccataccttctcatcattcagctcccacttataagtgagaatatgcggtgtttggttttctgttcctgtgttcgtttgctgaggataatggcttccagttccctccatgtccctgtaaaggacataatcttgttattttttatggctgcataatattccctggtatatatgtaccacatcttctttatctggtctgtaattaatgggcatttaggttgattccgggtctttgctattgtgaattgtgttgcagtgaacgtatgtgtgcatgtgtctttataataatattatttgtattcctttgggtatatacccagatattattattttccttgaatccgttttgtgcaataatagagttatgccaattattttattttacaatatgcatagtaatcttctttaatctttccactttcaaattatttttgtttctaaatttaaagtatctatcatttcttacagatagcatataattggatcttgatttttaaatttaatctgacaaattctgctatatgtttgaaaagtttcattccctcacatttaatttaaacagtacatttggctttaggtttgccatttgctatttgttttctgcttctctcaatgatgtttcgttcttctgtttttcctttaatcttttgtttttgttacactgttagtttaacaaaatgattagtaaatatgtaattttcaatcctccattgaccttcttgcattatctgttcatattttctctagtgatttcaatgtttatctgtaacttattacaatatacttcaagtgggcactaaattacttctggttaaatataggaaattttcataagtctatgtcctctgtaggttccatgctgttgtttccatatgtattatatcatatattttataaagccaaatatacagtcttatgtttactttaaagtagtcatgtgacttttaaacaatttgaaaagagatatattagtgaatggtaacaaaaagtgaataaaagcaaaaattatcacttccccattacacctgtcattccagcctctaagtactacatattgttgtttaaaactgtcagcagtaaaataaaaagaaatattctcttgttatcatggcaggtatatattttttataaagtaaactattcttttaagaatttaaaatttgatttttttagtgggaataacttagaagtaagttaattttaatattaatttgatgctgtatgtacacacacacatgaagaattaatgttgtgtaatacttttcatttgactaggcatctcaacatgcccttgtccatttggttatatttgaggtagctgctatcatggaatttttcacagaagtcaaatatgttttgagaggtcaatttcactatctcaaatcatatagtcaaatttcaaattttgtcaaatttagttgctatcttcaccataaaataatcagcacaaggtcaaattaatgtttgcccctatataaaagctacttttctattttctaaagtttctgatcagtattttaggttttgtttcttctcatagtgatgttagaggtatgtgactaacttttttatataaattatgaggatcacatgggggcaaataagatttttttttcaaacaaagatctttaatagtgtgggaatcaatgctaatgtgatacaaagcaatctatactgtattaatcaaagatccaaagcaccctgattataaagagtgaaagctcatgcaaataaattatgaaagaatacaaatgaagacacacttacatgactgcctcatttccagagcctggtgacagtcctgctgttctcagcatgctgcttcatgatgacctcatcagtaacataagatgcattcagctatctggcacctagatggcagcctacaaaatctaaacacagtgatttcaaatggaccataaagcctggctaaaatcttacaaattagtaatagaaatacctgttacatcatgacatcatttgggtacactcagcaaattattccctgatggaaattatttgaaaaaaatatatatgcagttatgcgttacttaacaacgggagtacattctaagaaatgcatccctgggtgattttgtcgttgtgcaaatatcatagaatgtacttacacaaacctagatagtatagcttaccacatactttggctttatggtgtagccttttgctcctaggctacaaatctgtacagcatgttatggcactgattagtgttaaggaaataataacacactggtattgtgtatctaaacatatctaaacatagaaaaggtatagtaaaaatatggcattataatcttatgggtccactgtcatgcacgctgtccatcattgactgaaacattgttatgtggtatgtgactgtatatattacatatatgtcatatatattttttatatatatggtttgtgtgtatacaatgtgtgtgaatgtgtgtatgcaaaatacttattccatttgttaaaatataatatcttataatgacagtgtatgcctacaaagatgaaggtgaatagaacagcagttaaggagcacggtttgtttctgaatcaactatagtatgtgatgagacgtggtgtaagtgctacagttcagagctcagggaacatgaacacttcagggcaccttcagggattaatgaaagctctttttgtcctgtggatgatagcgattcatacaaatgtgttaccattgatttggcttaaaaatcacatttaatcattttttaggagaatcttccctaaagctaaataaatatcactatcccttttgatttaggatgcttgaaatctgtgaagagaaatttcctttttaataaaaaaaaaaaaaaagcaatcttgtccacttaaccatctcagcttagcagttctgaaagggttctttttcttcaggcctcatgctggatttgccttgcagttagtttcatggagaaaaagcaacaatgctaaaattataggtgccagtaagtctaattgtgatagatgatgcatggtttcagaaaagggatttattcttatttcagaatgtcaaatttagttgacattattccttgagaatggaaagttaggacctggatcccctgaatcatctctaaagtattataagaaaaatctgttccctgaggtacttatcagtcaagggacagcctgagtgtggtgacccacatgtagagtcagggagaatggatgaatcataaaaaggtccacttgaaatgcctttttaaatacttaatataaatgtaaaaggcactccttgaaaaaataacgcaaaaaataagttgccataacccacagcttgcctgggacagaatatgaaaaagaaagcgttcatcagtgctgtttcaaatactatagctggcacgaaagtaggcacaggaggagaaaatcaccctgaattataaatgttgtgtgctattttcatggcaccaggtgggaatgttaacacttaatcagtctctctggcactatttcccatccatattgccagctttatcaccatgaaagatgctttgatcctcttctgtggtgtcaaaaacaacaggccacagcatcaatgacattccaatcagtggggcatcactgcgcattagtttctatcagatatgacgtttcactaacgcattttgacaacatctggtacaatacagaggtctttcagagtatacactgtatatatatgtgtgtgtgtgtgtgtgtgtgtgtgtaatatatatatatatatatatatatatatatatatagaaaagggtatatacctttttcctatgccctaaaaaggagattaatcacaaagcacttctcttttactgttgtagattttgaaagcaggaggaaaagttctcttttaaatatgctacagttttctctttggtgatacttaatgctctcttatggaaaatgaaattcttagatttctaacatactggagagttaccttatgttaaaacaatgcctttgaaaataggcattgttaagatttgcacggaagtatcagttgtgaaatataactgttgtgtaatggcaaaatctttcttttagtaagtacctcctttgtatcagacactttatgaatggtcatttcaatgttcacaaccactctttgagggagatatttttgtactcagtataaatatatgaaaataagttcagagaggctgaataacctttctaagatcacttagaaagtgtccaaactctgatgctccctgagatccaacttaccgtaccatatccatcctactgccactcaaggctgccctcctttttaaaatctacttaaccaaacgttaaattattctataattagacaaatagaaatttttggccataattaaaggaaaaatgttgcaacatgatatcaaatgatggttatagaaaatcagattaaaatagttcaaaacatctcaacaattagatttttctcttggtttgtcatttcttttattgtttactgataaactcactaggtttatcagctagcaggaagaaagacaacaggacttttcctattgatgtggagcagatgcaagatagatctggagcacaggaaaatttcagatctggatgtgtttaaatctggccctgcactgccaataggaagagcatgacattactggcaaatgggggtggagagggatatgtgtaaatagagggataaagcaaagtagcaaaatattataaaatgaactcacaacatactccctgattccattaaggccagtcttaatctctatctataccatgataagctgtatcttgccatatattgacctgaaaagttagacctatgatatattgtaggtaaaaaacaaataatcatttttgcagtataacatcaaagaaatgttaaaccttcctcatttcctgccccaaatgtacacattttaaaaagtaatgcaatatatttatattaatatattctatccattcaatatataaaagttagcctagacacttttatggaatatttttacaataaaaaagttagaaagagaacattttgtattagatcaaaaataattcaaagaaatgaggtaatgcattcttttgtatcacttctacataagcaatagtctttgaggtttctaagtggcttaaaaagagatttgataagttaaaatattgtcttttctcattttatagccagagaaaaatagtacttgtctggaatatatataatattgcacacggggttaattaggttaggaatgaattaatttgtaacaatttccgttatttgacaggcatcaataatatagcagcatattacatgcgttccagacatcagcatacttccatgacccagtcagattcaatttggaaaaaccttggatcatatgaatattttattattgatttttgtaacatcatattttacaatcagttctggtcataaaagaccataataacttgaagagatattttagaaagccatattgttgatgaatggaaagtatgctttctgcagtgaaaagaaaacttactgtctttttcctgagacaaaatgtcaaggtataatttgtactttattaacagctatcaaggaagttcattttctgagcaattttttcatcctttgatttgatattttgggtgtggggcatgggggtatgatgatagtttgtatttcttggttgtcctggctactttcaaattcttttcatttcagactattttctgttgaatgatttgacttctcctaaaaatctttccggtatcctggccctcaatcatttgcacataataatccaataaagtatcaaagtttgcagtaaatggtcagacggccggccagcttgatacagaaaggttatgttgatggtacccatgtttaaatgcatttcatttccaaacacatgcttacattcagcagaaacctaattgtagaacttttgcttatggagatgctaagcataatctattgaccacgtataaaaatacaataatgacatctctaaagaatggtagagtaaatcacaagacttgatattagttatgagttttcttatactgtctgtatttgaaaatgtgtaatacttgacacaaatactgtgttagttacatttaaacaattttgtgaaatcagaacacacacacatccttccccagaggagtgcaaatattgatgttctgtaggctcaaagaatgattgctcaaatccacatttccttggttttcttacttaccatatgttattcagaatattttgctcttagttatgcttttgatgaaatcattgatctctactatcagtattcaccatttgtcattttctgaatctccttgccagtatcacttatcttttctccaggttccaaaatgtaagcaattttctgatattctggtctaaatgccattttcttcttttactcctttcttttctactatagaacctaataacttctggggagaaagattgagagtaagagagaggagggagaagagaagtaggagcagagacttatatcatgccatgacatgtatactgagtattatcagtgcacaccaatgccccacacatgtatgcatgtatgtatgcatgaagtttatttgtgtcaatgaataataattaccaattttgtattaggcagtattaggatatccgatacacaaggatatataggacataattcttctcactgaatttacagtgtaatagggccaaagccccgaagagagctaatgacaatacactatactaaaatagaagcatgcacagatgttaatattacaaacaggagagctgcgtagtcaccagagagccagaaagagtggtgaaaaaactgaagctcatagaagctcagcacaatgactatacccatcaaaaccctatctagaggaagggccctctcttatggctcaatttattctgtcaggagagagccttttatcgtttgtgcaaaaactgggggcctcagatgacctaaactgatgccataaaatgttaaaatagctcctctctcttttaatttctaagctattatgtgaattccctataattaaaaattattagtggttttcagtagaggctcatggtgtaacagcttgatcttaatgtgctttctataactaatctggaaacttttaaaactcgtgggcttgtttttaataagtaatggtatatattttatataatgctatatacaataacagaacaaagtggtatttataaatgccttacaggtacctacaggcaaaacaagtatgtatttaagcatgagttttttcagaatgttcacaattctgagcacaagacaatttctgatattgaaaaaaatagcataattctaagaagaatgacttattctttagtcattgctagtcaaaactagtcttactagtaatatatagaagaaagatatacatacttgcaagaacaaagaattcaaaaagaaaataataaaataatgggggaaaccacatgtaagtgccagctcctacagttatcttccatgacacccaagcctttcacttcctctggtgcagcagcatttcagtggcctccagctgggtcagaatagtgttcatctcgtgctattctctagtgtcccaaaggtgtttaattttcaagttacagttgacacagaggaatagaattcagcaaatgcaagaggaacttgagataagaaactaaaggtgactacagggatattatcttcgctttaggggaaacatattctccaatgtaatcattgagccatcttgtgtcatcttctaatcctgggagatgagtgctaaatagatgaagaactctatttactctaggatatgagattttaaatgaaacaatcccatggactttttttttaagccatgaggctacatggcaagattttttaaatctttgtttacacttaattatatgcctatttaggatcttgattaacaaaaattagatattagattgccagcaatgaatgtagatgtaaaacaccacaaaaatatttgaaagtcttttataactcctgaaaaattgttactgaaatattcaaaatgttactattcaccaaaattaccctattcatgtgatgagtatgtaatgatctatctctctcagtagttgctgtgtattcctctgtaatgtgaaattgagaagattcctaagacagaatcaatatcatcttggctactgaaaagtcactcctgtgtgtatagtaggtgatagaggaagaaatgatgggctatgtatattttatgagagactgcctttttttttctctctctctataacaaagttcacaccactggcttgttgtatgacactgttcctggttttcagtatattcacacatgtatgcggagtaaaatatagtcaaaagtacatgcatcccttgttaaactgacccaggaacaatttgttagcttttttttaaggttctatgctgcgagcataatggaagcagcatgtgagttgaagaaggaaggtcttttggcaagtccttctccaccatccattggctttgagatctgggactagttcttaatgtaagacactagccagctaaacagtgccgatcagaagtaatatacagatctgctgcctcctagtctgaagctattccttttcctacatgaaaaatgccattcaataaggaagctgtgcctatatacttcaagctcatttaaaataacttctgctctaagaaatgttctgataccactccattaagtcagttctgaaataccttgggtacagcacttcctttaaatgtctgctattcctttagaagcaccacaatattctccttctcatttgctgattacttgtgagtctaagaaatgtttaacttattaccaagtgcgagcaaatagaaaaaggttggaaagaaactgaaaggagcatggcagagccttataaaccagtggggacaaaagagcatatttagaattataaataaaggtactgtatataaaattgaatcctaaaatatgaatttaataaatgccttaatagcaacagattgaatgttgtattacttttgaagaataacaagaaaaagaaaatttggttaaaataacattctataaatagcattaagcttcttgataaaaagtcatttacaaaactgagctgctgcttctagtatcatggtatttagatgtataaagatgttgtcttccattactttaattctataataccttatgcagcatggaaatgaattatcttatttctgagcttgcatttggtataaagttaactttagaagtttggtagaattgtgtgaattctggtacagattattcaaatgagtctacttcagtggaaaaatccatggaaaaatagtaactgcacacacacacaaacacacacacacacacagaggggggttggagagagagagagagagaaaacagtatatacttatcgcattcaagagagtttcctatttggcaccatggaattattcaagtatccattgagtctttggaaataatgctatgatcacctaaaagagcctgccaattattgccatatgtgaatgtggtttttataatctggatacttatgccctaggatttggactaatagctctaacctttgacttctcattaactgctagaaaaactatgagacagaggagacattggtcagtgtcaacatgatataaatttggacaagtggctgaaagttgagaggattagtatcaccttagcgatggtactgtacttactgagaaaaaagactgggaaaactaaagtatttgaaagtcatacatgtttggaaactatgtaaatgaaggctccttccaaaagtgaggacgagatgtagagggaaggcagccaggtttggaagtgtttgctagtgcatgtggcagcctaagaaataaaaatttataattgccagtattgggagtgggaagagtgtacctatataaaaaagcaaagcagctttgagctacaaagtcaaaggtaatcatttcaattacccctgaggagatccattcagctttggtgcttttaccagcaagtacaaagatttcagagcatggtaaacgtattagatatatgtgatcagatggcctggcatatacaccaagaaccaaaagcaaaaattgctttgacttgtctaatttgttaagttatctagacatagtttatctatggaaatctctaggctcataaagtagggtgtggcaaaggacttgccatatatctattaataacatacttggaaaagaaggtgctcttttgtgatatatctttgtgaattatatttaaaaagtataattttaacagaaaaggatgttggtataatattccaagaaaaagcaaatgtccaatacatctccaaaagtagaagactaagtaaaggcaaatgtggtttaatattgcttaaatatattgacacatctacctatgttgcagattttaaaaatgtttatacacaatatgtaagcatttatttatataaatgtgtgtcaatacttactaatttctaatatgctaatgtgtattagagaatatttatactcacatgtaattcctacaaaatcctattataaagttttcactatccccattttacagacaaactaaagcgtgaggaggctttgtaacttgttcagttacatatatagtaactggcagagccaagatttgaacctgagcattctgaacctgggctcttaacaattaaaatgtgcagatcaaaataatatctcctattgatttaccagcattgaggatgcactttaaattgttggtccaatagtcatgacatgatttttgttggtatgatcataattttttcttttctattttgttataaatagtatttattagccaacaacaacaaaaagcttatattggagttcttaaaacacaggctttctatttttgaagacaagtatctggttcataaagaaatcaaaaccagtattctggtttaataagtactatattctaagacaatgaatcgctcaactcagtaaagatagtttatttttcttacgtatcagtaacgtgaaagatttctccagcaatattttattgaattatttttacatagaaattatgtatttctagatcactttggcttctctagaaatccatatttttgctaaccaacttcatttagtgtcaataaacagaagcctatgtgacaaagaaaactaaatgtggcatttttcataacatgaaaatattggaatccatttttttttgcagtacaaatactataaataccacacgatttactacagcaaatgctaacttggcatttcctattggctaactcaatgtaacacatccaaattataactcctgtgcctttgctcatatagccattccttctgtaactcaaaaaataggaatagttcccaactgctcaatgtggaactttagatgtcagtctttttttttttttttttttttttaatttttgagacaacatctcactctgtcacccaggctggagtacagtgatgcaatcttggctcaccgcaacctccacttcccaggttgaagcgattctcatgcttcagcctcccaagtagctgggattacagatgtgtgcaaacatgccgtgctatttttttttgtatttttagtagagacgaggtttccccatgttggccaggctggtctcatcctcctgaactcaagtgatccacctgcctaggcctccaggcgctgtggctcacgcttgtgctgggattaaagacatgacccacagctcccagctagtttatttttttattttttttattttttattttttttaactagtttatccagatttattttttctacttctattgctatatcattggcaaaaattacatatatttaaggtatacaatgtgacaatttcttatacatacacactgtgaaatgattacaaaaacatatctatcactacacataattaccaacttttagatgtcatcctatttttttataatttcaagttttattttagattcagagcatacatgttcaggtttgttatatggctatattgtgtgatgctgagatttcggatatgaatgatcccatcaccaagatagtgagcataatacccacttaatttttaaacccttacccacctccctctttccttgccattggtccccaatgtctattgtagccatctttatatttgcgagtacccagtatttagctctcagttataagtgagaatgtgcactatttggttttctgttcctgcctaattcacttcgcataatggcctccagttgcatccatgttgctgcaaaggacatgatttccttctttcttatggttgcgtggtgtcccactgtgtatatgtactatattttatttatccaccactgatgggcacctcggttgattccatgtctttctatagagaatagtattgtgatgaacataagagttcatgtgtctttttggaagaatgatttattttatactctcttccactttgcactctgcatcatctaaaatcttcatatcatctacataatgtatctcaaataaatacatttctttctatgtccataatcacttctctacctatgtcttatgatttcttatttagattatttcagtagtttcccatctgttccattcttgactcagtttaatacattttcccgatagaagcaagcataatctctttgaaatgtaaatctgattatggtgtacctcatgcgtgaaacctttcaataacccctgataacacttaatgtagaaaaacaagccaccttaatataagcctgaagacatggcatggcctaattggcctgcatgtgccaccaaattaatctgaggccctcatatcatttcttttccagctatactctttttctttacctttcatttactctccagttctttcctgcctcaagacttttaccctagaattctctgccttctactttattttttccttttacatatcatgtgaatactgtagtactttgtacatatcacagaaaatgatagatctcttttaaaggttagacactgtacataccataaatattattcaactggaaattcacttactccatttcttttctatgccaacttaaatttttatttaataaaaaaagtttccttagtaaatgtaactcatattttcctttatttttgtgatattttctttaatataattaagatttatatacagttaagatattatacatattaagaatttttaaaaatgaaatctttaatataaccaaagattatattaaagaatacaaaattaaaatataattaaagattttgttttaaataaatgcttataggacactgggaagtcctttttttctggttttaaaatgtgattatgatgatcattaattatatatattattatatgttatgtacatattacatatattatacagagttgtcccttggtatcaatgaaggattggttccaggacccctgaggataccaaaatccatggatgctcaagtcccttgtatataatagtgttgtatttgcaaatagcctattgcatgcttccatatactttatctctagattacttgtaatacctaatacaatgtaaatgctaataagtggttgttatactatattatttagggaacaatggcaagaaaaagatctgtacatgttcaatacaagtacaaccatcttttttttgagacaagatcttgctctcttgcccaggctggagtgcagtaatgcaatcatgactcactgaagccttgagtcccctggtctcaggtggtcctcccacatcagcctcctgagtagctaggactacaggcaagtgccaccacaccctgctaatttttgtattttttgtagagatggggtttcaccatgttgcccaggctggtctggaactccagagctcaagagatccacctgtctcagcctcctaaagtgctaagatttcaggagtgagccactgcacctggcccttgactagccagttttttttttttaaattgatctgtggttgattgaatccatagatgcagaacccataaatacagaggccaactgcatttctgtatttagcacctaatgaaacacataaatatctttacaaatttgtccatcctctttctgtttttttaattcggaagcttcttgatggattcatagcatgagactgattatttaaagggaaattagacctactaagatatatgtgtttggttggaccaagtaattgggcataggacatgtgataatggagaattgctgtggagagatgaaagaggcctccattcttccctgaaagtttttcggttgccttatataagccagtcattctagtacatggtaagaaataaaggtaaataaaagaaagatgcccatgaagtgcacttaccttatctatcacactgcagtaacataataggagtggagttttaaacacatgtagaatgtgctttctacatgtgttttatgaaaacatgattatactgtcagtgtttagagtgacaagattgccttacaagatatatcaattttcaactgaatatagcacactgttttagaaagaagattttcaggtagttgaaatttttatctggcctgtaaacacacagatgatgaaatgttaaggcagttagaaatgactgctagaatatgagttcaaatgattttatagaatacttccatgaacttgcctagtcataaaaattttcttttcagatatatccccacactatgtatcatcaaataaactgtaagcgctaagaaaccaagacttactcagaaggaaagtggtacagactctatcatgtgttatactgagggcacgttaggtgtactattagatgtgtttttccagttctaattgacaaaagtgttattggtttgtaaatactttatttaattgtgccaaatgtataatcaaattggtaggtgcagttgggggacagtatggaaagtttttttaggcatcttttctgaagtgcatcaatatacccctgaaagtcttgagaactgtgctttttttttgtttgtttgttttgtttttctctgtattgctttcagatacatggtacggacacatagtagggcgttatatctgtaaatgccataaactgtttctgatcaaaactcaaagaacttgggaggctgaggcgcatggatcacttgaggtgagaaatttgagaccagcctggccaacatggtggaaccccatctccactaaaaatacaaaaataagctgcgcatggtggctgtcacctgtaatcccagctatttaggaggctgaggcaggagaatcacttaaacccgggaggcagaggttgcagtcagccgagatcatgccacggtactccagcctgggtgatagagtgggactccatctcaaaaaaagaaaaaaagaaaaaaacagaaaaaactcaaataatttatgcaatctcactttattactttattctgtcagacgttaagcacactccactaattttggaacataaaatgctttattttttccctctacccaataaagttccgtgtttcgactaataacatgtagtagacagtccattacatgggaagcaggcagatccccccacaaaataattcagcccacaaataccttttcagcaggtttgcataaattaagcattctctactcctaataaagtttctttgcatcagagccagtcacttgactagacctctaagatattgttgaagaaaactactgtgaaactaacagtcactggaaagagataaggtaatcaatttccctgtgtgccttggaagatgtctctatcttcatagtcacccttccattaaattggttacattatttttacagtgcaggattgcatgttaatgctacattagttgttcttttacagttttacatgaataagaagaaattggatgcaaacacagaatacctatgtcttggaagccctcaaacataagtttcatttctgtttacaacacttaaatcttgggataaacagccaatgcacttaatacctttaagccctaaccttctcctcaggaaaaagagataataccagtctcacataattgttatgaatatggaattaaaacacaggtgcaatgctaggcatggagtaggtttcagtaaatgctgctttttacattacctgtaggtatgaactgttctctccaggtacatcgttctggaaaaggtgatgtaaacattgtagttcaatgtgcctgggttttcaaaggcaacaaaatgtgtgccgctgtctaagatgtaacaatctcagggaactaactccctttcccaccctcttcccaatccctcacctttttaggtctcatttttttgcatgttataaaaaggacacaattatcctgaatgagtatctcaaggcaatcaatgaaattctaaaaagtaactccaaagggttaatggaatatgtaattatctctactaagaaatagggtgatggtttaaattcatatgtaaacatacacacataccctcggcgtgtccattttaacacacacaaacacaacaattctctctcctccttctccttcccactccccgctccgcccccaccatcctctccacacttctagggtagcaacactgaatacagatggccaagtctgaggttatgtgacatttccagataaagtgaacaaaaatggcagagattcttctattgttcttccttatggtccacattcctaatgtgtcccagttatttatactatgagtgttttatatttgccaactataagcaatccatcttaatatttccaatacgctattttctcatcttttctcccattcttcctgtcctctaaaaggacaggaagagagaatttcttcctcttaaatggatttaatcattgtattccttttattgcaattcatcttccaagttgaaagtaaagttttagcataacatagtgaagaaaaaaaatggttatctctatatttataaattaaccattttaaagaatgtaaacctgttatagtgcatcttgaagttttgggatattttattttcataacaccattaaatactactatatattgctgtggtatctgcccatgagattgttccatatgcttgagaagtttcttcccaccttcactgggagaggggaatatttttgtgtttctgacatacaaatgtcagtgaatatacaaatctgaaactttatagaggcaagtttttaaaaatatttttattcttagaaaaatattttttattaaataagatagaactcattttatgtgaaaatcaaatatataaatgtttctatacaattacaaatatttatgtctttatagtttcaaaaaagaggattcttttaagatatttaaaaaactcattcagtcaagttttgttgatcccctaagcacttatttatcatggtgtttatgttttccttgagaaatccattcttatctatttagggaataaatttcaggataccttaagtagaaaccccctttccatcttagaacaaatacttaccataaacataaaaataaataaaaaacagaccctaaaattacactaactcttactttatttttctgttacctgataaatgtctgtctgccatgaaatcactcaaagcaaatattgaatacttttaaatgataaacttctcctagttggtaatattatgtgataataaaaatccaatgtataaattatatatcataggttttttttaaatccattggctttttaacaataatattatcacataagtcatagtaataaatttcgaaaaataaagtgggatggaaagctgataggatgatatgaaatattaaggtgtgaatttgaaagctgagttaattcctcagaatagaaatgtatgttaatttaaaataaatttatctaaacagtaaagccaatttaaaggacttataataaaatgcaatgatgtcaccatttttcaaagttccagtttgtcatcttttatttgcagagtggataatcaacaatataactaagagagcaaataattgcacattgtattttgcagcatccacagaaatttgtcgtttatccctctaaattttccgctctgttttcatttaaaatcctggatttaaaaaagtgctatcttctgtatacatcttaccaagtggggatgcaattacttaatctggaaagtgtgaaaattcatgttagtggactatcaaaattttctgtcaattataaatttcctccatgttgcatgtttttgaagggaaaaaagcaagaagaaaaaggaagctcttagatcagtgaaatggaagtaagaacaaataaaaactgtggtgagtggatgtttgtgcatctgtatgtgtgtgtgtagacagagtgagagacagatatggatatgcagatgtttgccccacatagagtgtgcaagtgtgcaatgtatttacatacgttacatgtacataactgcacgcacatgcacccaaacctcaaattatacaaacacacatattctttgactaagatattttgattttttattgtgtatgtgcaataattttacttctaagaaccttttcgtttttaagtttatgaaataagtgatcaagttaatgtttgatgaataagaaagtacaaacaacaacaaaattatatatacatttttatcctgcctttttcctgtaaaaatattatgagcatctttccatgtgagacactaataccattatacaaatgtatgagaatagcataacttatttataaaaatgtgtgaacatagcataatttatttagctgcttttctaatttaggtcatcacactttttttctaatttgccaattttataaatagtgttgctcatataactttgtgtagatgaacatacctaggacctaagtgttcttcctacattcatgtacaatattgatcctttagaaattacagcatctaggttttcatcatttctatctcagactccttctctgggtggcattggacactccaaaattcaatttatggtggtaattctgttcatctaaaattaaattataaaggtggatatttgattggtaaccaaacctcatgttctagttatgattccaaatcagcctgggaaatgctaatttatagtaaagagtattcagatgtagtagtgatttagcatctccaaaactcctttctaggagttttcctatacattccaatgctgttctgatatttaacaaaacaaacaaacaagcaaacaaaacacttcagaaaagcttttcagcactattctgaaaagcttctccaggctgtctgctaatatatcctgagtatagagttgagctttatgcattttgacattcaccttaataacatcttcataaataagactttctatcccattctcgctctggcccttcccacataatcgtctgctcattacatgcatattctgttaattgatctcattctctgagcactgatcatgaagaacggaaaacccaactagtgctactcttaggacatacagttccttgaaagtggacagccaaaaagctggcaaaacaccaccatcctcaggaccagaagctgttttaacattctctttgtggcgaatgtacattggacatattttagtgttactggcacctgtcttactaaatctgatgcaataacaacaaacacaataaagccttgttactaagctatctttgagccatactggattgtgattgattttgctgtgtttaatggtgtggtggcattttgccttaggccttttttatagaacagtggaaggaacagaagaaggaaacacttgatcactttgtaaatgctgcacattgcaggcagagtttaatgactgaacgtagccacttccagtgtattgaaatgcctgggccttgcctcaacgcattgtacctctattcagatggcaaagaatagagttcctgtaacattgtggagtgcagctcattttgggcataaacagttgctgtgaccttgtacaggcaaatagaccctgtcaggcctggaattgcagggccaggaaatcatctgtttagtcagtgctggttctagtcattagtttgtgtttatggctgggaattgctaatatagccctgtgtggagggagctaacgtctgaatactaaaagagacctatttaccaacagctttatttttttaatttaaagtcaattcaaattgaaatgagccttttaacccttaattaggaccatgtttcttctaaaagtcaaccacattagtcaaccggagacaaaattcactttgcaattgaaaggctgccttctttctttcaacagtagccaccatggtttactaagtgcatttgtttccctttcactatggtaactttacccattccctgtatcagcatagttcaaagtcatcaattacaactgtgacaaaaatgtgttttgtgctttgggaatgaggccaagattctatctggaagctcttccataatgattattcattgtataggtagtgctcataatactccctgtttcatacttgtttccatattatttttcagagctggcagtttgctattttacccccatatgggcccacagtgtttagttcctgttttattgtttccccttcataaatatgaaatcagcaggttcccaaaatatttctaattcatccactacaaattggtattattttggcttccttctattatcttactcatatttttagtatttcttaatagaaaattaacattttgcaaaggccttatctaatttgtttcactgtggcccattctgggtgttttttaaaataagttttggtgtttgctcgataatgcacaagcatgccgtcactaactcggcacttaaacttgaagagctgaagactagattagcaagaaaagggtaaataaaacctaactgcaggctgggcagggtggctcatgcctgtaatcccagaagtttgggaggttgaggcggggagatcactaaggtcaggagttcgagaccagcctgaccagtatggtgaaaccccatctttactaaaaatacaaaaattagttggtgtggtggcatgcgactgtagtcccagctacctgggaggctgagataggagaactgcttgaaccaaggaggcagagcttgcagcaagccaagatcacgctgctaattccagcctgggttacagagcagagcaagactccatctcaaaaagaaaaaaaaaaataaaaaacctcactgcagactaacagaaggcaaatgtgctctcttttcagttgtctttttaatactgtgcttatttttcttgtcattaaaagagaaaatatcttatatttttaaaattagaaataattttgattgatgttatcaaatttgatttttatgtctattcattcccataaaattcacaaacttccaaacattcttcacaatgtaaaatgtgggaaggggatgactatcataacatatagttttattatgttattggttatgatgaaagtataacagggaattatttgtttggcagtcaatgtatatcattcagtccatttgactataaaaccaatatgccctttgaatatacactactctgctagaggaaagcactgcaaaatccatcatttctttttcaagtatatttgttctcagccaggaaagaatttcatttccttgttctgttgccatatggcattttataatttcaatggctaattttaatccttaaagcagtgatgaacatgaagttaatttgttcttttatctccacttagaaagtgttactaatcctacagatttgggcatacagggtattaacattttaaagtgtctaggctaagaagagtctttagagataacttagttaacatctgtcattttttaaatgaggaaattgaagtcctgataagacaactggttgcaaataattcactcactttaaaaattcatctcattcactgctaggtgctggatggtgtgccagatatagggtgcacaaaatgaataggaaataactcctgtctctgtatggctcaggctctaatctgggaatacgtaattacttagggtagaaccttagagttatttatagaagaggaagtcactgtctcaaacacctcattaaagtttgaagatacctgatcagtaaatctaagccaacacctatttaataggaaaagctagatcaaaacatgccatttcccgcttcctagtccagtgcttttcctctaacatgctgaagacaacttgaagtattgggataaaaagaagaaatttcaggaaattgcttagtgaagataacatataagtgacatataaaaacgtatcttgcaactccaattctcaggtgagaagatccatttataaaataaccatgatatgaaactgatctcctttttaaaagctgggattttgacttttattactataagacacaataaatggttgttttcatttctttgggctgctatatcaaaataccataagctggttagtttataaacaatggaaatttatttctccctgttctgaaggctgggaagtccaagatcaaggggccagcatattcggtgtctggtgaagacttatttccgggttcataggtgacacctgctagctgggtcctcagatgatagaagggacaaggcagttctctgggacctcttttataagggcactaatctcattcatgaggactctgccttcatgatctaaacctccccaagatcccacctcctaaaaccaacatattgttcattagatttcaacatatatattttagggaaacacaatcattcacatcatagcaagtgtctaggtcattttaggaaatcgatacatgtttgataaaagtgaaggaatgaattcaaacattatgtgaacaaatacaattcgtagcaaatccaggatgatatctagtaaggcttgagaaggtgctgccttccattttaattgttatcaacttagactcatggatcatcttacttgaatatatcaatataatgttaaagataagagttcctgccacaattaactagtttaaaaatcttcttacaaaatgggagaaagcatctctggagccacataaaaaggtggcaatttgcttccacttgaaagattttaaactattcaatcactctttggttttgctatcctggggttaagatccatgaataatttttccacgtgtttgactgacaagaacatttactactggattacctgagggaagacgtaaatcagaattgtgtcattttggcagcagctttttgatatgtgtgtatctgccttagttaagtattgatttaatagctggtctccactacagacaaccttgactgtatagctggggctttgtattttaaaatttgtctctggataaatcttttttccacccttcttgtctaatctcttttttctttggtattctctaataagttgactgggacttattttcattaacaaaaggaaagaaagcacattaatacatctactttttatttcctacttttattctcttatatgtgcaacctccttcagcctataaaaatgcttaaatgagagaaatgtgtagattgttactcactagttttacattcaaggaaggaaaggagatgttttcaatatacaatcattgtctttgctactataagcaaagataacacacacacacattcacacacaaacatagatgctccttaaagtctttaatactcaggatgattttttgaaggataaagaagacatgacagacagacaggtaattgagcacaagttgatttactgcaagggagagagattgcttattgatgatataaatttaaaaattggcttgttagagaaaaatacatttatagagattgtttctttataaaataataattttatacattctccactcatattctcaaattcattgaacagttttggtggagaattgagatactacttggacaagaaatggaaaatttacttatatgcctcccaaatacagcatgtcactgtcgtcctactcgtgaaattgaaaaattcccactgcccttccaactaaaaggacacttactcatccgcccataccaatgttagacatcaaatagatagcaaatcctagagaaaggctgggtgcagtagcccaagcctgtaaccccagcactttgggaagctgaagggggagaaactcttaaggccaggaattcaatactagccaggtaatatagtgagacctcatctctactaaaagttttaaaaattagccaagcatggtagaatgcacctgttgacccaggctgaggtgggaggattgcttgagcccaggaggtggaggctgtagtgagctgtcatcatgcctctgcactccaacctggacagtagggtgagaagagcaagaccctggctcaaaaaaagaaaaaaaaaaaaagaaaaacaaaaatcctaaatcctagagaaagacatgtacgagagagcattagcctttctgtgatgttttctcacttggaatagatgacaaagtcttgcaatttttaattaaataaaagtttaaatgactatgtttcaatttcatatcaacagtttagaattggtagaaaaataatttgtgttttaaggaagtaatttgctttcaatgattgatttttataaaattaaaagaaagattccttccctgttcaaactataccattgaatttctttgttatcttgggcatgctgtcctttccattggtgcttcaattgtacagtctataaaatacacagactgatacctacaccgataatttcaatagaactttgataagatttaattgagatggtacatataaaagtcctaccaaagaagtaaagacatctacaaaaattaaaatgttattatagaatctagcattttactctgcatatagttgacattaaatgactatctattcattcgtggttaaagcctatcagctagttatcaggtgtcagatgttgcaatgtctgtccctaaactgtgtgtcacttaactttctggacttcagtgacctcagatgtaaaacacacatacagatcaatgtgatttctaaggatcttttagctccattaggctattattctatttaattagcacatctcaactgaatttcctattcatctagtcactcaggtatgccgtctgctacaagtaaaagaaacctaggccacagtgacttaaacaaacagggtattgtctttctgacattataagaaatcttgagattggtggttcctggatcaagtacagaaaacacatcatgctgaatttcttggcctttcactcatgatcacatgtaagctgctgcaattccagccataatgtccataatcaaggctggaataacttggcttcaagttgtatttgtacatcttgttagaaaacaaaaaggtatcacaaatattttaatcggacttctgtgtacatttctttgcccacctttttgtccataactttggccgttcatctctagcttcactggtctaaggaaggaaggatttggctggcttcatctgtgagcaaaatcaggattctgctggcaagaagggagcagagtttgggtattgagtaccaacactacttgccataaaattctatgtaacagtttgtatttttcatgttgatttatttgtatattgaattatgcttcatactggccacttctactatctatgtatgatctttctcaaatggcgctccttctgtggagtctcttccaaccaccaatcacaatgaagtgattgctcagcatgatttgtattaaatgcccgctgcccattttctattgcaagggccctttgggcatgggcagaattagggacatttttgcctttttgggaatcaaagagcccaaacaagaatagatgtttgacaaatatttatttatttatttatttgttgagacggagtctcgctctgtcgcccaggccggactgcagtggcgctatctgggctcactgcaagctccgcctccctggttcccgccattctcctgcctcagcctcccgagtagctgggaccacaggcgcccaccactgtgcccggctaatatttgtatttttagtagggacggggtttcaccgtgttagccaagatggtctcgatctcctgacttttatggtttttacaacatttgttatacaggtattcactaaacactcagtcactttttgtttctattacagatggctatactatacgatacttgaaaagagagtcacataatcacttcctaggtactgcacaaattatcaagattattgatagtatcttgaaggtagctacagttaataaacctaaaagttaagaatgctactcaaactagtcactagactttatccaattatgactaaataataaccctgagataataacagtaaaggatacgtaggcacatatacatacagcttcataaatatttgtcggcctgtggcggtgactcacgcctgtaatcccaggactttgggaggccgaggcgggcggatcacaaggtcaggaggtcgagaccagcctgaccaacatggtgaaactctgtctctactaaaaatacaaaaattagctaggcctggtggcgcacgcctgtaatcccagctacctgggaggctgaggcaggagaatagcttgaatctggaaggcagagattgcagtgagccgagattgtgccactgcactcaagcctaggtgacagagtgagactccatctcaaaaaaaaaaaaaaaaaaaagaaagaaagaaaaattataattgttagggcagtagaattgactatatgtaatggatctcagtgtgacaccaaaagttgttcaatacattggaaattggtcctacagcagccattcttggtaggaactagaaaacagtaagactagattaatgattgctatcattttaagttattccagtagtttattttggcagtgtatttcccttgtcttattttaagaaactttcagtaagaagatagtctaccatggatatattgtatttcttttcagaaacatatttagtgattataaatattgatttgttcacacaggttttactttaatgcaaataatcttctcttcacaatatgaagttaatataagaaaattctagaatgtaatgaccatctatagggcctattctgtatataagttctgtaaatcatcaagtctatttaagttctgtaaatcatcaagtccaaatgtggcactgaaattgagctttagaagttttagaaattattgacttccaaggatcatcttgaatctaaaatttacatcccaaattccttctcaaatgaattactagagacttcttggaattttcactatgattttagttctcaatgtaattataaaaatgcatcaaaagaagtaatgcagcattttgaattttctatcagacaaaatgaaaataatatagtagaggcagttttaggcatatctctgtaaaacagtacatagatgctgaaccctaaattataagctgaaatcaatgttcgataaccagttcaataggcttacaaaaaccattttatgcagagatatggccagaaattaaaaagataacacagttattaaaagagctctcatctagtaacagttcataagtgtattagtttaaataggaactgtatatccctctgtatttcagatatagacaaaggaatatatttaaatctttattttaggccattgccataggaagtaaggaaaagtactgtcaagccagaaaaaaatattgtagctcatgaaaattatttatcaagaatcttaaaaatatacgtgaagccatgatctcttctttcagttgcttacactttgtgggacgaagttgtacccacagagcaattagaaaactagtcaatgttaatatactgcttgctgcagtgcagatagtatacacattgcatcatgttttaaaaagggaattactacatggtgacatggttttgctttattttctccacaaatagtccaatgccaagtaaagctgtgaaaacacaagctggaaatttcatcatacactagtgccaaaataatctaaatcttgtgtgtgtgtttttcttcttaacatttggtgcaaattcaagcatttatgtagaaaaactacagtaggctctgtcatttgcttctgtaaattcttggaggaaaaaacttgatttttatttataataaattcatattcgaacttacttaaatctgttttacatattttcaaaaaaattatcacagacttttaaaagagagtcattttgtttgtagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgtgagtagttttgctgcaacccatgcctccatgtttgttttgttttcttcttgttactgtgctgtttgtttttgttttaaagcatttggcccatttccttctgttgcccgtgtgcaaattgaaagctttctctgcttcactccccatgcttggctcaccacaaatgcaacatttatcacacaaaatgaattaaattttaaagcacttcctgcaacacaaccccctgaaagagagaacattttctgtgtcttgtttagatcctgcattacatatgacaggataggggaggttatagacaggggatttatgtttttacatttctattccctcttgctgtatgttggtcataggtcatagggaaaaaggactaagagttataaaactaatactaaagttttcataactattcacaagggttttgaacatagtgatgagttactttgttagaatttgtgaatgtatccttacctttgagttaaaactccgccattcacagcttggggaagacagtgttcttgaatccatgtgtctataatatcatggatcctctaaggatgaactgaaagttgataataaagaaaggatagttatttacctcattcagttccattgtaaattatctatttcccttgtagtagaaaacagaagtgaggctcattaatctttgttgaactactttgcaggacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctggtgagtacatactagatgcttcttactcttatcatatcacgtctgagtaatggttttgactctgggtggaaaactgggcggaaggaaaaaaagattttatagaaccccaggattttgccttctaacacatttaaacagttatggcacattaaataatttaattcttcaagtgagaataaaccatatttgttaggtgatttttaaactagtttatacccattgtttcccaatttgaaatccttaaatatttgaggctctcagatagtagtagaggggctccttgggggaaacatttttatatttcagagaacttaggcaatgaatcttagctttaaaaaaagttatgcaggatatgaaaaattgtaaatatcttcagcttagttaaaattaggtattcctttgttatttcatacttctaagaagttctgtgtattataactgatagttataaatctctgattgcttaataataactatgtagattacttatggattttacttgtgggattttaattgtgaatctctcaaacatataaatggattatatattacatagaaataatgcccctttgagatataacaatcatttttcaatattgataactgataaatgagtaataaacagttttcttttgtattcaaaatgtcttgtacaaagctaaactgataggtatttgttgtgcttaaattattgctacaaaatgtcagaattaggtatacatcccaagaagctcaattcagagatattattgtcttatttttacacatacacacacacacacacacacacacacacacacacacaaacattggagccaaagggagagggaagagagagacaagatgccactctgattctccagagaactaccgattctccagttctctcccaggtggggtcacctctgagctggttgtcaagattgagtataaactcggcttctgctcttcatttggcttacattatggacatccctctggtccctagtgggaatcaccccttgctctgagaatatcagaatgtgtcctggatgctctaggcaaaaggaaaccagaggtgactaaattatcttatcacctaggtcttctagtagccaaatcatgagccaaaaaaactcaccacattctgtttccatcacctggcttactcagaaaggttagttcaactagtaaagacacagagtaagtgtcatctacaaaagcaagtatgcatcaatatgactctgctggttgttaacattttcatctatttatctactggttaaatgtagttctagctgttcctgcaggttattacagaaatgcctctctactggttaatttctcaaatacactgagtagtcccctaagctcagtatgtcaggtccatctccattctccccatcattcagcaaccaaagggataaatctttgcataagaggggtatacagagcctttggctagcacccgtctttcttgaggggcccctgtcttccccatgccaatggatagatattttaaatataagccatggcagagtccatccatattcaaatatgtatctttctgattctaaatttctctttcgtttccactttgcttctggtctcatatattgatgaaaatcttatatttttacattcctcatgatgataagtaaacttaatttgtggaaaatacatgaattttaaatgaagtgcactgaatcattactttaatcttgctcactgtatctataatttctcccacttggagctagatcccagaccaaccagtatatgctttgctttgcttccgttaatggtatttatactttgtaactaatgatatttaaaagtttataacttaggtttatttaactgtcttctatgggaaaaaatgagtactgcaatactgttgctatatattgcatgattatggcttctcatcttcagctaacacaggaattttaacaaattatgatcatgtggcaaatggttttccggagcgctatatttcaagctgatttactaccttgtttaaaattgtagcatcaatctgtgttacaattatctcttaagtcaaacagaattgtataaaaacaaacaagagctccttatttcctatcttatcattcccctctggctttctgacaatgcatttatcaggaaactaatagttccaaatatacacagtaaatgaatctaggcaaagtggcaaccaagatcaggccaagacattaaaaaataaatgagattgatgctttggccctcccagttacaaatcacagtttaagacagattcagcaaaggtgatagaagttacttaccctagtctctctcccatttaaaaaaaatcactaatgtgtttataatatgcaccaccaggcattttatatatttatttcaggatgtctgtatcattttgtgtgcctggggagatagaggtctttgttctatcttcaaatctccagggtaagatatataagcatgattagaagcaatgccttttctgaagggagtgtttctttgttttcctttatttttgttcttgtgaaggttaatggactggtagccttgaaaaataagctccctaccactggaaggatatggctgtgacagatatgatgccagggtgcttaaaatcctcctagcctctatctttgacgtggatataaaggggaagcatgaatgtgtcccttttaatttagtttgtgagatcgagtttgttgattcttctcttgatgacattgtaaaagcattgtgatgatcaaatgataaggcaccttttaaattgtagaagattatgttgtaaattcggatattagttctcagctctcaatactttcacaaagtatgtcagtgagataagaaagtaggccaccatataaagattgtatctgtgaatccatcagtcaagtaaagaaagaattgcagattacaaaacaaaaatcttcaaacttataacgacataaattgctgctttttgttttctttcacagaatgagtatattcatctttttttttcttctggacaaaaacaatcattccactagtggaatatgcatatctgttcattcttaactgccattatagaatctgccgctttccactattctatagcatataatgatctcagactagaataaggagcactaatagagaatgtatgtggccttggggtttggaggtccacctctactcttattttactacttggatgaactgatatctgagaagctttttcaacatttcatcaagacagcaaagttctgagtaaattgacatttcctccctttaccagtttaccctattggaattcagcatgtgtatgtacaatttctatcaaaaaattggattcattcacatgtgtgaaaatattgcaatagtgtgcattatgcctatataccttcacccagatttctcctagattaataatttattccacgtgctttatccgtcccacccccatctctctttctatgtaaatgttacttatttctgaaccacttgcagatattatgaccttttcctcctgaacacttcagtgacaatttcttttttttttttcttttttttttttatactttaagttttagggtacatgtgcacattgtgcaggttagttacatatgtatacatgtgccgtgctggtgcgctgcacccactaactcgtcatctagcattaggtatatctcccaatgctatctctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagatattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagctcctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgggttcattgtagattctggatattagccctttgtcagatgagtaggttgcgaaaattttctcccattttgtaggttgcctgttcactctgatggtagtttcttttgctgtgcagaagctctttattttaattagatcccatttgtcaattgtggcttttgttgccattgcttttggtgtttagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttgccagcaccatttattaaatagggaatcctttccccattgcttgtttttctcaggtttgtcaaagatcagatagttgtaggtacgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgagggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcactcatgatttggctgtttgtctgttgttggtgtataagaatgcttgtgatttttgcacattgattttgtatcctgagactttgctgaagttgcttatcagcttaaggagattttgggctgagacaatggggttttctagatatacaatcatgtagtctgcaaacagggacaatttgacttcctcttttcctaattgaataccctttatttccttctcctgcctaattgccctggccagaacttccaacactatgttgaataagagtggtgagagagggcatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagagttgttgaattttgtcaaaggctttttctgcatctattgagataatcatgtggtttttgtctttggctctatttatatgctggattacatttattgatttgtgtatattggaccagccttgcatcccagggatgaagcccacttgatcatggtggataagctttttgatgtgctgctggattcgatttgccagtattttattgaggatttttgcatcaatgttcatcaaggatattggtctaaaattctcttttttggttgtatctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattgatctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctctcaaaaaaccagctcctggattcattgattttttgaatggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgtcgtgtctttgttcttgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcttccatccttttattttgagcctatgtgtgtctctgcccatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcagctggtaccagttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttgagaatgttgaatattggcccccactctcttctggcttgtagggtttctgccgagagatccgctgttagtctgatgggcttccctttgagggtaacctgacctttctctctggctgcccttaacattttttccttcatttcaactttggtgaatctgataattatgtgtcttggagttgctcttctcgaggagtatctttgtggcattctctgtatttcctgaatgtgaacgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccatcactgataccctttcttccagttgatcacatcgtctcctgaggcttctgcattcttcacgtagttctcaagccttggttttcagcttcatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccattgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctgtctgtttgttagttttccttctaacagacaggaccctcagctgcaggtctgttggaataccctgccttgtgaggtgtcagtgtgcccctgctgggggatgcttcccagttaggctgctcgggggtcaggggtcagggacccacttgaggaggcagtctgccggttctcagatctccagctgcgtgttgggagaaccactgctctcttcaaagctgtcaaacagggacatttaagtctgcagaggttactgctgtctttttgtttgtctttgccctgcccccagaggtggagcctacagtggcaggcaggactccttgaactgtggtgggctccacccagttcgagcttccccgctgctttgtttacctaagcaagcctgggcaatggcgggcgcccctcccccagcctcgctgctgccttgcagtttgatctcagactgctgtgctagcaatcagcgagattccgtgggcgtaggaccctctgagccaggtgtgggatatagtctcgtggtgcgctgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctgagtctccatatattccagtgacaatttcttaaaaacaataatgcttttacatagtctcaatatatttattaaaatcaagacattagcattgttctatactataatctcatctgaagatactagtcaacttttgttcattgtttcactcatatccaaatggcaaaaacaaattgatgttctgtttacctccagtttctatttataataataacatatactgatataatatagttcccatccataaaaataaataagtaattttctgtaaattcaaggcagatgcaaaaaaaaaaaaaaaagtggagaaggaagaagaccaacacttattgataggactttccaggtgctggatatgatgcagggaatttcagagttgccattccattcaaaaatgatcagcaaattatgatatttaaaagagagaacgtgacttcattttatgtagattttcgatagaaggtgcactaatttatgtaaaggaaaagatctttgaggctgttagctataatgaaggaattcctatcctctgctttagacagaatgacctctattatctacttaatttgatgatcaaagacaacctccttcttttccccttagataaacgccttcctttcttctggctgaaaattgccatccattacatgaagggattaaactggaaatccaataattatttttgtttttaatttattttttggcattctgggactataattcaaaatgttgtcactaatataattttaaacaattaattatttttgacctttaagaccacctatggactcacttactataaaaaacgtttataggctttctcgttcatggttttatggccttttatttcacagaataaagcaatagtatccattcgttaagaaaagtaaatatctttaataaatgttaaataaacaagatatacttaaaaaaagaactgtaaaatattagagccctttgactaaatttagaatccacactaggctaggtgtggtggctcatgtctgtaattccagcactttgggaggccgaagcgggtggatcacttgaggtcaggaattcaagaccagcctggtcaacatggtgaaaccctgtctctacaaaaatacaaaaattagccaggcatgatggcaggtgcctgtaattccagctacacgggaggctgaggcaggagaattgcttgaacccaggaggcggaggttgcagtgagctgagatggcaccattgcactccagcctgggcgacagagcaagactctgtctcaaaaaaaaaaaaaaaaaaaaaggaaaaagaaagaaagaaagaatccacagtatttttttgcatttgataaagaaaatatttctaagttttctgtagtttcattctggaatatgtttcctctagccaccttatttttcttttggaacttagtgtatgtagatatgacaaagaaataactcatgttgaagatatcagtcaggcttcagcatttctgaagaagcaaacattttaaaataaaggtagaataaatgcttagctgaatctgccattaaactatggccacctattggtatagtccctatagaactgtatgttgccgtgtaattatactccttggaagtaaattaaacaccaaaaggatctacatgaattctttcagaacatgaaggtagacatttttcagcgccaatgtagcgaatcggaaactgtaaacataatgaaaatcacctaacaaaataatgaacatcatatgactttagtaatgttctatgatgcatccttctctttgtttcattttatgattaatgaaacctaaaaatcaaagtcttaacattttgtttatctcaacaaacaaatgacgtctgaatttggccctgagagtataagtggttatatacattatgattttcacagtacatcatgcttgactggcaattcagcttcttcctgttttgaaatcaaggcagatacctgtgcatctgggaatgtcactgtgcagtgatgtgtcatagtgtggccaagccttccacatcatttaacacattaatgatgcctctcagccatcacaccctggtatggaggcacattgcgtaactgtagaatgagcaataagctgtagcaaaagcaaaaaccatatattgtcctgacagttattcaaaacccttatatgagcttagaggccataacaaaatggaacatgagctaaggaagacagttggagagcttcatgaatctaaactgaattttcattccgtcttcatttctggttttatatacgactctaattaatggagaagacatgtacgtggaagggtatgattacaactttcattcaagagttttcactagaaaaagaatattaataaccagttagaggagtaaatatagtgttaactaaagcacatggaaattaagaaagaattagacttttgatgctaacttgttgtatgttaactatattcccccaagggcaaaaaatatttaattcacagaaagttttctcatccttattttccaaggagaacatttttagtctcaaatcacaataaaatcatattttatactttaaatgtgttctacctccctaaagttaactgaaatatagtccttaggatataatagcatcgtatgtgagtaattgagaaatttaataaatgcaagtatttagaaagaaagaaaatgttctgtttccaaaagcagatatattactaccactggcaaaactctttcataataaattcttaattatatttcagcatctcccaaagtgttatctcagtgtgaataaccatcatacagctcagcattctgactttataatcctatcaatatagtaccagtgttcaaatagaaaaaaaaaatacatccctttcttaagtgactttatagatatctatcaggaaattattgcaataagtatccaaattacaaagactatgactatgaggtatggcacccctataagcaggggccctgacattctataccattcgcaccaaagtaaaagaatgccaaggccaaagaggtgagaagttcatattttctgctcctttttattattattaattgctgacctaactcttcttgacatgattagcactgcactccagtcctttatgtaattatcttattcaatcttacaacaattttatatggctataagtgaataagtgtcttgtccatggccgcacaactccagagcccctatctacatattctttttcctatgggttgcaaaggagaggctttgcacaaaatctaagtaaggctgaagaaagaaatatataaagatggttattttattatagtaaaatcttgactgcctggtacacaggtggtgtgatttcttctttgaaatcaaaatttcacatgattgtatttactcttaatcaatgctaattcaaaagcaccctcttgacaattcatcatccagaaataacctcttactcctttcccttttcatttcaattggaaaaaaaataattataacaaattgacaaaaaaaaaaaatctgtctctggtcacaagtttttcctaggaaatagctttaaaggcaaggccatgtgcctgagtaagaagagttctggaatgtgtgtccaaagaggtaaatattcatcttgatcccactccaattgggcctcagagtaggtcagaactattgctttatctttctgtgaaatgtaacatttggactagaccatttctaagtttctttccaattatatattctaggaaactaagttaatgcacattgtatcatgtacttaagaaaaaataatccactgtttataagtgaagcaaatatgccttgggaaaaaaaggtatttgaaaaacaaagtggaacaggacagtagcaaaagtccaattgtaaattcaggtactgtcacttaataatgaagtgactattttttgtatttttaaatttggtttgtttatgcattcatttgcaattttgtttagaaatgaatttaagggagttattggactaaacttactggcatctttgtatcctttttgattattggtacagtaagtcctacacatagattgttgtgaggagtaaataaaatgagagagcatttgtgactgggaaagggcttgaataagttgtgctctgtctccataatgatcatgcagatcttcccgtgtctgggggaaatagaaactcttttttttttaattaaaaatgtgaataaatatatatatattttttattttattattattatactttaagttttagggtacatgtgaacaatgtgcagattagttacatatgtatacatgtgtcatgctggtgtgctgcacccattaactcttcatttagcattaggtacttctcctaaagctatcccttccccctccccccaccccacaacagtccccagagtgtgatgttccccttcctgtgtccatgtgttctcattgttcaattctcacctatgagtgagaatatacagtgtttggttttttgttcttgcgatagtttactgagaatgatgatttccaatttcatccatgtccctacagaggacatgaactcatcattttttatggctgcatagtattccatggtgtatatgtgccacattttcttaatctagtctatcattgttggacatttgggttggttccaagtctttgctattgtgaatagtgctgcaataaacataggtgtgcatgtgtctttatagcagcatgatttatagtcctttgggtatatacccagtaatggaatggctgggtcaaatggtatttctagttctagatccctgaagaatcgccacactgacttccacaatgtttggactagtttacagtcccaccaacagtgtaaaagtgttcctatttctccacatcctctccagcacctgttgtttcctgactttttaatgattgccattctagtaagatcaaattctgatacatttctttggtgtgattggcttaggccccaagtttttttcaaaatcgcaattcatatctataatgcgtgacaatcctcaatgtaataggtcattctcgtgttgttcgttgcacacatatacatatgtatatataatgtatgtatatccattgattctgtgccatcactgaggtgccctacataggatgtaatggaaatgactgattgaaagttatatatattggcctatatctcttagttgggctagaacaagaaccaaaggcacacataaaataagaaattgataagactaataaaaggacaaccaacactttgggcagccgaggcgggcagatcaggaagtcaggagatcaaaaccatcatgggaaacatggtgaaaccctgtctctactgaaaatacaaaaattagctgggtgtggtcgttggttgtgcatctgtaatcccagctactcggaaggctgaggcaggagaatactttgaacctgggaggtgtaggttgcagtgagccgagactgcaccactgcactccagcctggtgaaagagtgagaccctgtctcaaaaaaaaaaaaaaaaaaaaaaaaaaaaaagcacaatcaagcaaagatatcggcaaagagtaaagaaaagagacggtgatacgggaagaaaccaggtggcaacaaatgttctaataatcattctggataaagagttagaagaatacactttaccaaggcccaggttgtgacaggagacaaagattttacaactacttaggaaatgctcactttttaatttttaatcactagactgttagtggttgactttttctacaagtttattttaatagattcactgtaattccaagatgagaatgtcagatgaccccaaaattaattgtgcataccatagatattttaaagaaagaaaatttttgcatctttacttttatttgtttagcttatcacgctatttgaatatactttgtgggcaaagttcgtctatctttgtccacctaaggagggcaattgggtatatatcctctaaaatgaagtacatgttatggatatttatacagattttcaacatatcaaagaataacattctctatttctgtttcaagtagtaaagcttgttttatttctcttctattgaaatgatttcaaaaggtttttcatagttgatatctgggatacattgcctactgttccattaactcccagttaaaataaaacaactaggctaagaacatagcatgcttttctcttggtttgaattgatatagtaaaaaacttcagtttaatttgacatttttatatctgaaaagtttgaaaaaaatcccatccatcttccctgaggtatgtttccattctaagctgcttttacaaattcttattattgcagatataagatagatgtccttattaaaatcctaatataaaatggctagaagaagaactaggttttacaactattcatatgtgtatgtgtttatatttgtatattcatgtgcgtgtgtatatatgtacatgtataaattaggaatgtaaagatctagaaataataaagttatagaaagtatatggagtctaacagatatgaaagaagagagacttttttttactaaaatatttgaacaggatagtctttttcttaaccatctcatctgttaaataagggttatggctacattgagatattgtgaagtcaagaaaaaagcatatataataccttgtgtggtgctggctgcttattaagtgatcaatacttggtagttaatatctttcataaacatttggaacatttagcagtaaatgtggtctaaaaaaaaacccatttagataactccaggttttctttggcaataaataacacactcaattacttgcctttttctgttcccaaagcattgactaagcccttagtatgagccagttactatactggatctactgggataaaatgatgattaagatgtagtcactactttcaaggagctctcaatttaggacatcttaaaggtttcatgaatacagcatgaagttgattggtttggccaagaaaagacaggcaaagccagctgccaagagaattcaaaaagcatcaacagctcaatgaagccccccagtgaaagagattggtcttgaattcacagattatatgacattaagtataatagttttatctttttttcattactaaagcagaggaaaaaaagaaaaacctactgattacacatgatgctaaaaaactcgcatgctgtcccaaagtttttcactaaagagaaggaaagtaaatgaaatgctttaagttatgtacaaattcgatgataattgcatgtgtattttaatgatctctcaaatgcatgtatctggtttatgaaagcacatagaatatgtgaacttataacaatgggacaagagcaaatgtttaaagttgtgcagtaaaactcaccacattaatctgacttatttgtctatctgtccatttacttacctatttgattaagcttattgttattagtttggaattaaatattctagttaaatagacagttaccacataaagtatataaaactagaatgcattaaaatataatcaacagtaattagtatgaaagtgactccttatttcagataaagacaatgtctaaagtttagaaatgtttagaataatcattttaattatgaattataattgttttgaagatacctggccagaatttgacactaacataatagtaagtcaggttttactagtttgctaatatttgttaagacatacatgtttacaaaccttgcctatttgtgaaagttaaaagatattgctttctctgtatgaaaagtaaaaacgattaaaatgagtttcaaaaaagatataaaggaaaaatccactattttatctatgttaatctacatgcacactttgttgagaagtaagaatttagctgtcttgttgggtagtacttaaggagattttataatttatgtacatttcacatgtaatactggtatttacacactatttgctgtattttttagcactgtatgatgttttttaaattgtgatacattttcagataatatatattcctctactatcagtagccatttcttctttagatgaactggcaaacattatatattgtgtgtgtgtgtgtatatacgttatatattgtgtgtgtgtatatatatatacatacatatatacacatatatacacatatatacacatatatacacacatatatatacatatatatacatatatacacatatatatacatatatatacatatatatatacatatatatatatgcatatctttggattgttgcagtggcctgagggaattgttgcccacattcaaaatcagaatatttattatttaaactaacaaccaatactgtactgtactgtactgggcattttcgagatatcatttaagccttaaatcaaccctgtaatggagacattattacccttatttttagaagaaacttatcaagagtttgccagtcctatttatctaactcaagttgctagggagaatttgaacctagatctttccagtgcaccaataatttccaaatttcagtaaacaacttactgcttttaggaattttgcttcatccatatgccaccaggactcctacaacataatgtgcttaaatcaagcctctcttttttttggttttgttttgctctgaaatgtgaaaacagtttgctcctataaatagaaaactaatgttacttgccaaaaatttatgactaattagataataattgcttgtccacataacacctaaaattctttcaccaaacaccatgagtaaacttggagcactatgagtaatctgctgattcctatcaacactacctcactggcaattgcttataaggatcactaaaccacaggccatcccatttcagctaactgcaactctatgcttttagttatttcagtcaaagctgttggagtcatttggcgcttctctttctctcaaactgtatatctacatcagcatagtctatacaacatgccttcaacatatcacaagaatctcaccacttcttacaagatccattgctaccaccctagtagcatcatcttccccagattatcgaaaatgctcccaactgcatttcttttttcacccttgccttgagaacacatggacacagggaggggaacatgaaaaacaagcctcttataactatactcatgtttattattatttattttattgcataaattagcaatgtttgcagttttttaaattatgtcataactaatcaaatttcctgtgtaatttcaaatatttaattcacttctcatgtattatttccaaggtgactggcattactttttaattgaccaatgacaaaatttaacactcacttctcatatgaacagataggtttgtttaaaaaatggcttaggcaggaattgctagtgaacatgtgcccttaaatgctaactcacaattatggcaacttactgagtcaatggtttgggcacttggcaagtctttcttcagttaacatcttgcatataaaatattcattttcagaattttacctagagtgcacatatggtttttcaactcaaaagactacactaaaacaattggaaaaaagatgccattagtgttgcccaaggtacagagaaggccttcttgtatcctttgcctttctttggaaataaagacctatgaattcctaatctatactttttgttaagatccctttttaaagggtgtcatgtgtagcctaagatatagcttgaaagttgatatgagtggtgctttgtgacagaaccacagatgttcagtacatgatatatttattttttaccccagtggcccttataaaaagggctagaaaatcagcttataacaagccaactaatgacatgatatagagaggcccctggttcaatgactgttagtacagctgtgtcccattacatattagatacctagaacatacttgcattctgaatggcatttatcttttgaatttcaaacattcctaccataaataaggattttatgcttttcacaaatgtttcacagtttagtctagggaatactgaaaggttgcttttacttaatgaaatttaccctttaaagtttcctggagctaagacgaacattttctgagcgctcacctcaacagacctgcctcactctcctctatgcccattctctgctatccccttagcctggagaggtgataataacttgagtttcacaaaaccaacagtgtggggaccacatgagagctggcttttgatcatggtttaataattccctctttgttacttctccctaataagaggtatctgagtctaacatagaattgctacacttgtgctgtgggaaaagcaatatttttatatgtattttgtttgcaaaatgcacactatgtctaaaaattactttaagtgaaaatattttcacaaccccctcaaggtcctgattataatttgaaggtaataaagactcatacttctaaagtagagtagtatgacaccttaagaaatgttatgtgagatgacctcacttctgaaataatgtttcagaattgtttcgttttaaataagtgtgatggtccatctcatcttcttcaagcgcaagtagctgctattaatccagaagatcttcatttctttttgggttgaacatatctgctatcttgaggaatgaaccatgaaaaagaaggaaagtcatttcttgtgattcaggcaggaactcagtcattttccttttgtccttcaaataattgttgaaatggtgggagattagcctagatagtgactgctgcagtaacaactgctgcctagaagtgagctttattccacctccatgtaaagaaagcagctgtctttctattgcagttggcgccaggcagctgcttttactttctgtatttctttatagagcccttcgtcttaaatgcagtcacctgcacacagcctacactttttttagtcacaaaggctgcaacaagaaagcttcatatgactcctgtaatgagcaatgcagaaagtaatatggaaagatgttccttgagcattgtataaggagtgtactgggtggacgttgggagatggggcaagggagaaggagtttaacatgtgtgattgggtgtttgtgaaaagcaccagattgtcagatggcaggatgtgtacaacatgggatgagtggcaggaaaggctccagtggtcagttcttgtcctgcacaaaaaattcacagcacaatgagaaccaaagatatctccaataaatgaagttttacttcttcccagttaaaagaaaatattctcattgaccaaggttatatttactaactcaaactaagattatagtctggtgtatgtttcaatctcctctttcctcctagagttttactaaagaagatttatgcaaacccaaactgtgataagatttgtaagatgattgactgtggcaccaaagaaaattactcttatcatttcatcttatataaagctaggtatctatctactctctttttaaacataggttttggtttcatgcatagatttgcaaagtcatttttcaattatattagtccacatattaatgaagtttctccagagaagcagaaccaatagactgtgtgtatctatctatccattgagagagagatagagagggggcagggaaagaatacaccaatagactgtgtgtatttatctgtctattgagagagagatagcgagggggcaggagacagagagagagtgagagagagagagtttaaggaataggctcatgtgattgtggaggctgccaaatccacagactgcagggtaagctgataggctggaaacctagggaacagctgacattgcagcttgagtctgaatgcactctgaagctaggattcccttggtcttaagggttctctattttttctcttaaggccttcaacggactgaatgaggcccacacacattattggagtacaatctgctttactcaaaagtgtgccgatttaaatgttaatatcatctgaaaaacaccttcacagtgaccccagactggtgtttgaccaaatatctgagtaccatggcatagctaagttgacatataaatttaaccatcatagtcagtggtgtgtgtgcgtgtgtgtgtgtgtgtgcatgcacatgattgctgtttctcttttgagttaatttctagactatatttttaaaagaaatgtcaagataaattgatataaagaaaatactaatcttttaatttcacccactgaccatattggaattctcttttaatggatcttcattcttccttgagagtctttttttaggtttttcttggaagacaatgcccagtgcatcagaaagtgtcccctcccctattcctatctcaaatatattcagtttgaaaatctcacttggatgaccacttatcaatagcaatgtaaactgacaaactgctttgtggaaaaggcacactataggttttttttattggtaaatattttcatgtcaacattacccttttggagatcaccttcttatgtgccttctgtgcatagaatttcaggaatagtgtcaggcctaataagacagtcttcactacactgtttccctttaccgacctttgagagtcatccctattttcaggacagtgctgtggctgctattagcaccacttgagggcttgttaatcatctttgggtactgctattgatgaaaactctcagctcagtgatttttgaaaccagaattgcttaaaatatcattcagaggcctttcagaacaccagtatttacctactccaagccaatcctacagatgcagagtctctgaaaataagcatagggatccctagtagcacatgcatttttaaatcactctacagatgaatctggtcaacaagcacttgggaagttcttaggaagaaaaactctttcccagttgcaaggctgcagacaggcagaaaatttatagctccttcacattacagtttgtgcttccatgaactgcctggcctgaggccatgcaaattgaacttgcagaaagagaagttggataaacccttgttaaaaaaccagatatatttatactaatattatcttggcctcaaaaaggcaacacttgtttttctagattttatgcaaatttaagatattgtcattatcttctcaatatcctctaaatgtctttaattctaaagaattatgttaaacctgctgaagagtaatgctgagatggccaatcagtgtaatacagagattgtacttaaaactgttcattaactaatactgagttatcttttcttctgcattttcatcactccttgctacttttcaaagatttccttaatatttgttttataaagtgactttacttcctaacaatgaaatttaattattcaacttaattccaacaatatttgttgcatactgttatgtgaccaacactgtgctgtatgttgtggtgagagataatgataattgatacctactttctaccctcgatgaatttataattacctcaacatttatttaactaaatatagtttgtgcaaagaaaacacaccataataaagaaaaagaatgattattctctgtctgagaatagagaaaggttttcttgaagaggtggggtttgaggtggacaataaaaggtaaagaagggtttaacaggagccagcatgttgaagactggaaaaaggaataaagaggttgggaagataattgtcccctcagatatagcctttcagctgaggcagagtagaggggaagactgaaagggcaatggtggatggaatggtggcttaaggtctacaatcttttggggggattttgttagtccgctggagtggacacacacttacatttccaaacatatttagtcatagatacaaaacataatgcaaataaaggggctacaggcataagagcagatacaacatagcttttcaccttggtttgattttccacagggcaacacttgactgtctgtgcagcaagggccctgccagacttggaaacatagactaatgttgctgcaccattgcttgttagtactcagttctgtgtcaagaattccagaaaaaataacaccaagaaattgtgttcatcaatttaagggactattcacacacattgacttccttttggttcctgaacctacttagcatcaacaataccaacaagtagagaggaatagaggacaaagcggtatgactgtcctcatgtccttgaatagggtctctgcctccactttcccttgaaacagaaagcccatttccctgcagagcctgccatgcaatttcttcacctgggcagaaatgcatgggtattttttcttcattttataggtagcggtgcttgtgtatgatatagatggtttgggatgggatggtttagcagaaatgcttcttgatttttgtgtagaaaagtgacacaatcaggcctatgacttagaaaaataaatgaagatgcaaggaaaacaaaccagttgacacactaatgatagcccaaatgagagattataaaggtctgaaataaacctggggaaatgagggagatgacctttcagagattaaaaccagaataattaaaaccatgaccagttctgtgtcatgcatttgggaaaaaaacagaaccaatacattcatcagtttaagggaatatttacacatattgagttccttttggttccagaaccaactcagcatcaacaataccaacaggcagaggggaatagaggataaattgaccagaattgaataaaggagcaaggggggagttgtagctcactcaaacatgagaataatttaaacacatgtggaagaaaggatgataataccattgatcaagatcaaaaacatgaacgcataataagataatatacagcattttagaattgatgaaattaaggcaaaaaacaggtattctatgcgggtggttgtacaaagtaagcaattgaccactaagatctgattcttgagaaagatcttaaatataatttgtatatttgaaagccatgaaagttgaagagaaaaagtgtagataatagagcatggaatttaattttaaaatagcatcaaggaaaagatcttgagaacagcaatggatacctgctgagtatagacggagtcagctttggaatcaaagcccagactttaactgggaaacagttatctacaaagtcatttatgaaatcttactctgtttttgccctctcacttagtcctcctcaaggaatataagcctaatgagggtggggaattgttgttcactttgttcattagtatgtattttgttcattttgttcattagatgtgtttcctcagcaactaaaatgtattggatatttttaaaaattctatcaaatgaagatgtagccagttagcatgtcccatagattccaccagcacaaactctcttctatttctataacattcttcctatcttcacttgatattactaacttcaggttctcatcaaccctcatcttgattattacagtagccactagtctgcagttgcgtttccacctcatctgttttacaaagtaccttaatccaagtgctttactgtgacttacaaagctctccatgaactgtttaaagactacctgccaattaatacctttccactttatgctccatgaatacattttcttgtaaacttgcataaactcgctacaggttcatgccttttaaaatctatttatatacacgtatggaaatttcaactatttcccttctttacctgttcatttctcatctctcaaaagtcagttcttgagtcacttcctgcaggatgtttcccatttcttcactagagtgagctggcctcccgtgtacccacataggaatcagtttctagctctgtcactgctcttataggtgaagtgactcctcaaaggcagggacctagctttatccatgtttgctgaactcttgataaaatcattgtcagattaatcacattagcatatagtttcaatcacataacttagctcctttaaatagtggcttccattacagaggagaaaaaaacaaaaacaaaaaaaaacttcttagcctcgaaattaagattcctcttatgtggcatcacacaaatttccaatcataatttcctttactccttgttacaaagatagatatatctccttcctattctccaggatattttgaaaatttggtaaccttcacctaaaatacaattattctatatgcatgtgtttaaaattttttaattctgcaagactcagactaagtgccagcactttgttaatttttctctaattcttctcagctggaaatagttgtccttttatcacaactcccatagggctacagaatcgtttatctgtatttctcttatggtgctcctctgttctaatttgtattagaatgctacttcatatgcatttaatctttcttactgcactctaggttccttgagggcgtgaccaaggcatggctcacatttgtctccttcatagtggctaacttgggccttatccaataggcatttttatatacattttaagtgagagagctgtaagaagaagaagagctgagcagaagatttcagtcctagtggtttcatataattagatcagaatactaaagtgtgtgctgttggtagttgtggaggtatggggttttttaaaaaaattattattttaagagaaaactgagtgaaatttgggggcagaatttagatcataagtgttagagtacattatttaaagcaatcttcattaattaaaaaaagacaaagcagaactataaggtagtatattagttagggcactccagaaaaacagaaccagtgggttatgtagagatatgtaagaggagatttatgatgggaatttgtttgcataattatggaggccagaaagttccacaatctgttgcctgggagctagagaaatagaaaagactgatacaattcagtctgaggccaaaggcttatgaaccaggggagtcaatagtataacttccagtatgaagtccaaggcctgaaaactggagggtctgatattgtaattcttagaattagcagacccaagaagctggatcttcaatatctgaggtcaggaaaagatagatttcccagctcatgaagagagagcaagttcactgccctctgccttgttctatttaggccttcaatgggttggatgatgcccacccaccttagtgagggtagatcttctttactcaatccatctattaaaatgcccgtatcttctagaaacacccccatagattcacccagaaaaaacaaaaaacaaaaaacaaaaaacgcttcaccagcagtatgagcatcccttagcccagtcaaattgacacataaaattaaccttcatagttagcaaccattaattttccagtttttcaatgtggaaaactgaggcaaggatgtgaagtaagatgcctagttcacactggtgttgctgactcacaatttgaactcaagtaatctgacagctgtgcccacattcttagtcatcgttttctctgctattgaagcgtgtcatggaagggaagaagaatatgaattagcaactcaatgacaagagagactgggtttcttgagaactcaaggaatggtaagaaggaatggaaacaacaaaaaaagagcccgcatcaccaagtcaatcctaagccaaaagaacaaagctggagccatcaggctacctgacttcaaaatatactacaaggctatagtaaccaaaacagcatggtactggtaccaaaacagagatatagatcaatggaacagaacagagccctcagaaataatgccacgtatctacaactatctgatctttgacaaacctgagaaaaacaagcaatggggaaaggattccctatttaataaatggtgctgggaaaactggctagccatatgtagaaagctgaaactggatcccttccttacacaactaatttatacaaaaattaattcaagatggattaaagacttaaatgttagacctaaaaccataaaaaccctagaagaaaacctaggcattaccattcaggacataggcatgggcaaggacttcatgtctaaatcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggaaaaggacatgaacagacacttctcaaaagaagacatttatgcagccaaaaaacacatgaaaaaatgctcaccatcactggccatcagagaaatgcaaatcaaaaccacaatcagataccatctcacaccaattagaatggcaatcattaaaaagtcaggaaacagcaggtgctggagaggatgtggagaaataggaacacttttacaatgttggtgggactgtaaactagttcaaccattgtggaagtcagtgtggcgattcctcagggatctagaactagaaataccatttgacccagccattccattactgggtatatacccaaaggactataagtcatgctgctataaagacacatgcacacctatgtttattgcaacaatattcaccatagcaaagacttggaatcaacccaaatgtccaacaatgatagactggattaagaaaatgtggcacatatacaccatggaatactatgcagccataaaaaatgatgagttcatgtcctttttagggacatggatgaaattggaaatcatcattctcagtaaactatcgcaaggacaaaaaaccaaacaccgcatgttctcactcataggtgggaattgaacaatgagaacacatggacacaggaaggggaacatcatactctggggactgttgtggggtgggaggaggggggagggatagcattaggagatatacttaatgctaaatgacgagttgattggtgcagcacaccagcatggcacatgtatacatatgtaactaacctgcacattgtacacatgtaccctaaaacttaaagtataataataattaaaaaaataacaaaatacattagttgtatatagacaaaaaaataaaataaaataaaaaaagaaggaatgcaaacaacaaagtagaaatgaataaggaagtctctttctctcaacattgagaaaaacaggaagaaagtataggagaaactaaaaagtcaaattacctgaaacaggttgtgaagtgaattgggcaaagtgttaagaagttgctaagacttgaaataaaacagtacagtagcccctcaaactggtactgcagtttttcatcttttctgtgcacctagacaaaacatctacattttggtaatggatataaagtaagaaaataaaagaactaccaaggaatttttaaagtgaatatggaaattttattatatctgctcttaaatggtatgaaaataaatatttcaaggtagtcaggttctctgggaaatcagctttgtatagtcattatagatttgtgtttaaaaaattctttatattagttattcatatatttgtttgtttgttttcattccagtgattatttttatttaaacttgtttttggctgatgattttgagacattataatttgtaccaatgactacagttaccataaaattctacttgagcacatttaaacaaaaacatcttttatctgttctcatatctttaagtttccctggaagattactctctttactcatttaatgaacatgcccttaactatcgtcgacattttggtacctattgtgcaggaatcttttcattctgggtccacttctatcaggtaaactgaagaagagatgatacaaggtaagatagataaaagataagataagaaatgataggacaagataatgtgtgggctggtttatttgtattccttataaggagatttgtagagtttctctctcaaagtactgactgtcagccagggccacctccagttcagtaatacacaactgtaccgtgtggcacatttagattgtttaagggaagtctgttaatgggaagagttttgctagtttgtcttcctctacttggtttattgtacaaggcacagtgatacacatacacacacacacacacacacaacacacacacacatatgtgtatgactgagattgacaagtagcaaagttttaagactggataatttattatatggaaatctttcatatcctagtcaacactgcttgcctatattgaagagaaacagtttctaaatgactcaacatttgaagagttactagaataagtctggagtgggctttactctcaaaccagttgtttctgtagggcaattctctatgattaacttccagcctagggagttatctaaaagctttcttcaattaaaaaaaaaaataaaaccattttagcagagagagggaggaaagaaaaaaaatgtcaccacaagtttaagtttctgcataactgatcatcaatctggtctgaaacattccgataaaattggcattgacatttgcccatcttggaatctatggattgatccatctgaaggttttggaaccagtcagcctcagtgggatgtactgacaagaaggtagggtatctcaagacaggacatcctaggacaactcatagcttcactagtcatgacctagtattgaagaggcttcatatacaaatttaaggcttaaagactttatagtgtgatggagactattggttacttctagcagcaaccccctcaccctcatacttaggttcaagcctttatattccaagatatttttaaaaacacagcagcttttattcatatatagcacagactttttattccttctaattgaaaaaaaaaaactttgcaatttgcaattggcatatgtgccacttctaggaatgctcttaaccacttcatcagacttggcactgtctggatgttggttttgattgccaacctatgaaagagaaaggaaatcacaaaagagaaaattaacaagtgagcacagttccaaaatttgttcgacaaatgtgttttaaatcaaatgaatcatcctttggcacaagctattcactttatagtcattcatttgaacagcttagtctctgtctcctacagactgtggttaacattattcttgatgaatgagacagttaccttaaaacataaataaaacaaatagaataacttaacatctgactctcaaaggaaggtatgttatcttaccttgcactagtaatatattttaaataaaagtattcagaaaatcagctaaaaccacaaaagaaccaaggatatgtctacatagaactgctgcatgaaaaaagtagtttgatcaaatacatatatcttgattaagaaaatatgtgacccttccaaatattttatcagttttcttttctagtctttcactccataaaagtagtttccattcttattatttttacttactaatttaattaaaagtctctggcacaaaatagttttcacgccatagagtattgtacttattgctgaaatcaacattttaaaattaatttcaagtctttgcaagggcaaagacttacaaaagtaaataattatgtaaatcttaacctgtaagataatctttttttcttgttgttttttgtcatcccatttaatctttacttttaaagaaattatattgctaatttaaaatttcctccagccactttttgaactgaatccttaggcaagataacaaccttttaaatgtgtagaacattttttcttatttatgtaggctttatatagataactttgcatatatttctgcatcattttccaacatccatcttacctcacaaaacaaaaccctggtgtaataattgtgaaatggcaatgttatttcagaaaattcttttagcagcaaatgggaacttagagagtcagaaacagaaaagatttctgtgtaagcccactggtctcattcctatgtgacaggtgtctctgttggtgaagtctgctagtcagtgggaaaccaggatatcatcaccctgctgtgaatgagtctctcccagagggaactcacttatctgcctctgtctctgactcctactagactctaattctcactcaccatgagaattgacaggaaagatctattcagagatgtatttcacttcactttccatcctggatcaggcttctatttgtgggtttgttcaacatattatattaacatagaactaaattgcattttataaggctttgagatgtagaggataaggtcgatgtcattacatggttttattcattctaagtactagaatttaactctaagggtcaaatagagtccatttggtctgattactatgagataggtgctattcaatactatatataataaatatcagcttttattaagacaacaaaaggatttgttaaaaatgagtttccgaactaaaatttcaaatatgtacaattatacactctccacacacacacatactcagaaatatagtcatatataaaatgttcagtaagatattttcttgttgcttgggaattggcaactagaataaaaaagtcaggcaaaaatacaccaagtataccacatacaaaagagaactgcaaacagttggagccagacacatcttgaggcatttttaagaggaattaaatgggtccttgccatgtagatttttgcagaatcatctgaaaacgtcatgagtgcctacagaaagctagcacacaatagtaaaagtcagtattagtcaagaaaacagtggaagtcaacaaatacagtgcaaatgtgtgcacagctaagtataacctctattttccaccatctctccacagtcctccaacattggaaaagggaaggaagatgtaaatgagctgacttttttcctcttccacccatgaaattgctgttttatactgttatacactgggcattaataaccaaaagtgaagagcaggctatgagatattacagcaatttcatcaaagaacaagaacttgaggttcaacagatcagagggtctctgttctctgtatttcactttttagaaaaatcccattggtctggtctgcattaggatgtctgctgcttgtttgagggccaattgtcatgatacatctcagctatttcttggtcatttggaatgaccaagtaatgaagtagctcttattttctaacctgagaatgccacattccgagcacataacagaataaaaaactaaatttttggttcagaatagccacccaacttagagtagacagaaaaatagagacttcattgaaaaaaagtaatgccactaaacctctatataacaccacaaactatccttcattccactatagcaactgtaggtcctgttaatcaaataattttcaatattatctgtatcacagcttacaactcaatttcacaattcaagaataagtttgaggcatcgacgttgctggggtagagatatatttgtgtatgtgtgtgtgttagctctgtgtattcatatgcttgtatgtttgtgtgtttttttagttttcctaaactttgtcccactcaaagccaaaactacccagtgacacacaatgagccattaactaaaatagacttaaactgttaaagtgtcttgaaaacccaaataaagctttatatggtctcggctgtcaccaatattcctaagtatttacaatgatgcaaggtctcttagtttgaattctcccagaagtaggcattgagatgagaatttgaatataggttgtttatttgggaatgatccctgaaaacacaggcaggggagcataaaaatgaaacaaggaaaggaaggcagccactgaagaataagtattaatcattttaccctgtgggaaactggagcttaatcctgttgctgaagagtgggagcccgtttggaatacttgcttcagagttatcccacactagataagaggaagctgggatatttatacatgaactcttcatcagtcattgactgagagctgttccaaagatgagaggtaattgaagagtataattttttatccccaagacttccagcctaaagtgcatgaatagaagtgactctgataacaaaagaagccctcagtcatacagattaagtagctgacatcttgaaattggaaagttgcccatatagtaaattccaaagggatattgtacagacacaaacaaaataggcccattaggtatcctggaagagctgtagtacttcaaatccttcagtggttaactgagatgatgataggttccatatgcatttgagggaacataggttatcagagggaaatttgtaaagaaatccaactctagcaatgagaatgtttcagatctccataaaggcaggcgacacatctgcctttttacactactttaaccttcacaccttacatggcacctggcatacagtaagcacagaaaatcttcttgaatgaaatcattttatgatatttactttaataatttttactaaactgataagcaaaggtaagcaaaaaggaacacataaagagatattccatacattattaattttaaaaagaccctagaaccataataaggagcactataagactaattaggatgctttattgaattaaatgcaaaattgtctttgaaacaattttcaaacaattccagaattttttagattacttcgggaattaaataaaagaatacatgaatctaatatataatgattagtaattgagctttatgtaggatgtgtgtatataaatatatatatatacacacaactaaaagtgtatatttataatatgtatacatattttagatattgtatgtacatataagtatgtcctccaagttgtacctttaaaattagtacaatcagattttgctttcctcagttttctttccttctatatcaactgtgaataaatgattttctaactggtgtagggtttctgatgattcatatggtttaaataatttatgttttaatttcatcaaatatttgtgcccatatttttgtgatttttatattcatatttaaaaatataaacaaagtctcctctatactgcatgtcttccacctatatttggattaaaatgtgttgataagatttcaaagactaaagaaaggttgatactaagccttgagatgccagttttcacagcagccactcttgggatagtttgtcatcagcgttatttgccatttccttaaatgaacattggtagttagcaatttgtagttcataagggccttttaatttgtcttcgaaaagtggctttgaacatatgttattttgttaaattatagatgttaactgaataaattctttggttgcatgttttctttctacaatcacttgattgtttcctataaaaccctgctgactttttaaggaacgtgttggaaaatttttctcacaactttccttctgtgcctgtagtttttggagttgcttccctcattataaatgtaattgccaggggttttgtcacaggaatatgatcttttttagttcaaaactttcattctgcttatgtagattgttttttcttatctgatttcatgtcccattgtgttactaaaatctagtggtgaattacctaaagcacttcccaacctgtctctatacattcttttagtgaatgaagagaatacgaacattatattatgtgtaattgcctgtgcatcagatgctttatattgaacacaaatgttatggaagattcatttcatatgtacccatttgcaaactttacatattgtttagaaccaacatctggtcttactgaactcttatttcaggatctccttttagagattaaaccaacccattaaagccaaaaatccatttaacagttattcctaaggttaacaaagagtaaaaataccacactttagccatccaggaaggtaaggtataacatagattcatagatgcatgtatgaaaaccaactgtgaaccactctagaatgtaaagggtaacgaaacccactcgtatttggaaaatagactaccagactttgtaaacttcaagtttgctttgcctctagcatttttccctcattttttttcctagctaggtgcattttgaaggaaatttaacttgaaaagcatgtttctaaagctaaaccacagactgtgcgatgtgaataataatgattcttggcttattgtttttcaattccagaagaaatctgacagaccaggccagcaacactttataatgcttatataatagtttcatacagatctttttttcaacaaatggctctgaaaattagaaaaaaaatatggaacacatagaaaaatgttcaaaatcattcaaagacatgtaattagtttaactaccccttaattctggtaaaccacatgtactactttttactccaggttattcttttttaaaactaagtgtattggcaagaacagaaaaccaaacaccgcatggtctcactcataagtgagagctgaacaatgagaacacttggacacagggagaggaacatcacacactggggcctgtcacagggtgggggactaggggagggatagtattaggagaaatacctaatatagatgatgggttgatgggttcagcaaaccaccatagcacgtgtatacctatgcaacaaagggggacgttctacacatgtatcctagaacttaaagtataataaaaaattttttaagtgtattgggatatattcacatctcatgaaatccattcatttcaagtggacaattcaataatttttagttactttattgactcatgccggcatccccagaaatcagttttacaatgattttacaactaactaataatgatgataaactcatcattgcatttttaactatttttcgtgtcaattctaacttaagaatcattacatgtaatttagttttttacaaaaaatctcatcatgaaaaggcttaagtttacttcacaagcttggaaataatgtttagaatctttccacacattaggtaaaatgtagtatctccctgtaaaactgaagtcttcacacctgtgtttgagaacacttgctctatataggctaatgacaattttctgtaaactactgaggttaacaattagaagtgcaggaacctaaatacatacattggattgaaagccaaatccttgaaagaaacaagtattgctgtatttgtatctgcatgatttcctttttagctttacttatgaaatccaaaaattgagcagcttaaggctattttttctaatgtgttgaaattgtaaaggcgtgtataaacatcaatcagttaatcagttctcaaaattctgagatcaattatgtgaaatattcataatggcaaaaataagtattgatgcaatttacttatttggatggacttaagaaatagaatcgctccaaaatttatggctagctgaaaagttacttgacaaaaattcttcagataaattaatcctgtgtgctggaactaaacaggtcaggccacaagcatcatggaaattaagcagcaggtaatctgtctctgcaatttcccctttgctttctgctcagatttttaaaaatttctgtttgtgaggtataaagttatttattgccactcaatgtttgcatttcttaatcaagtaatatggggcagagaaagagtaaatttgtttgggataaaaagagactgagaagtattagtaaacccaagcatagacaatgcaaattttacagccaaaatagaaattctgcaggcatgattgcttttggaaactgtaagtctctgctggtgttcactttgtttgtataaatatgcaaacagacccaaattagcatattccccacctgcacccttcagaaagctaaactagaaactattaatacacacaatctctttttgtagtacttaatttgttaacattttaattgaaatttgataatgggtttaggatatatacttggaggagaagtagagtagatattaggattccagttataattgtcaagtgcatttcactttttcgtattatatttttaggtgattgcttctaagttagaaaacaaagactgtgctctttaagagtacgcctatgttacaaataagtttctggtatcgtggtaacatggaactagggcttctcagaaagatttcatggtaatcaaaatgttttacattgtatacaatgaccaaccaaaattattcttattttctgaaatactatattgtcccattttttcaagccaaatgagtatttttatgtgtgagtaaattggatagctctgagctaatttccaaaatctgatttccaaatgtttgaattgacttcataagttttctgttatgggaggtctgggattttgcccccttaaaggaagggatcaacctacacaactttcaataggacctctctttctgcttcaattagtctctattgcactttgggtggggttgtcaggcatatacaagccatatgggccaggcatatataggccatatgttaagcaatattttttttctgtttccacgcacatggtgaataatattttgatgcaatgcatacgtctatgttgtccaccatattaaaaaaattttgaagagagataattccttttgaaaactcatgagtcatataacaatgtagagttaagcaatggtgactcactcaggcatgtgatatgtataaggacagttgtcatttctgtaggagtaaatcaatttctttctcactcgcctcagaaggtatttatgtgagaatgaagttataatggagccacagttgaatccatacacatatatatatgcatgcgtctgtgtgtttttgtgtatgtttcaaatttggctcctcaattaaagttagcagtttattatttgtcacacagaccccaaaaacaacagggtttgtgtatgacgcctttgataactctggtctggtgtaacaatgccctcattttcttttcttacttatacgaatgaaaggagccagccaagactaaacaacattgtttattttgggcctcaacagtaccaaccaagaggaggtagtgctagaaaaggggtttagcttataatttagtataaccatctaattaataatgtaagctgactaaaatcagaggcgctaatcagcagagacacaaagcaacatatagtaaacttgtaagtgtactataaactgtgactctttaaacagcataataggtagtagctttttttttttttttttaatgaagttttgctctgttgcccaagctggggggcagtggcgcaatcttggctcaccgcaacctccgcctcctgggttcaagcaattcgcctgcctcagcctcccaagtagctgggattacaggtgcctgccaccactcccggctaatagtagtagctttttaaccaaagctgctataggctgtttgtttgtttctttttttgagacagagtctcgctctcttgcccaggctggagtgcaatggcgccatctcggctcactgcaagctccacctcctggtttcccgccattctcttgcctcagcctccagagtagctgggactgcaggcacccgccaccacgcctggctaattttttgtatttttagtagagacggggtttcactgtgttagccaggatgatctcgatctcctgacctcgtgatccgcctgcctcggcctcccagagtgctgggattacaggcctgagccaccgcgcccggcctataggctggttttaaacctgtgtataagttaaacatcaaagagtgcatcatagacgtctttcactatctgaatgtttctgtcccctccacatttatacattgaaacccaatcatcagcgtggtatgatggctcatgcctgtaatcccagcacttcaggaggccgaggtgggcagatcacttgaggccaggagttcaagaccagcctggccaatatggcgaaacccatcactactcaaaatacaaaaattagcccggcatggtggcacatgcctgcaattccatctactggggaggctgaagcacgagaatcacttgaacctgggaggcagaggttgcaatgagccaagattatatcacagcactccagcctgggtgacggagtgagactttgtctcaaaaagaaaaaaaaaaattaggacatgagcccttggaaagatgatgattaggtcatgagattagagccatcagaaatgggattagtgctcttataatgaaggctccatagagctaccttgtccttccatcttgtgaagacacaatgatgctagaatgcgcaatctatgaatcgggaaatagactctcaccagacaccaaatctgctggcaccttcatcttgaacttgccagtctccacagctgtaagaaacatccattgtttataagctgttcagtttgtagtattgttatagcagcccaaatagattaagacaagaactctgggtttaaagagtgagaaaaaaaattacagcaagattgtatacatgccaaatagccagctatttctttagatagcttattacctctctgtcaagcagaggtcttttgcttgcttgaaaaaagttctagattatatttctctactgcaattgttttgaaatgcatgttttattgtaactcaggtatggtgcggccaacagatcaggagaaggttgccactaaaaaatagagactatggctgggggtggtggctcacacatgtaatcttggcactttgagaggcaaagctgggtggattacctgaggtcaagatttcattaccagcctggccaacatggtgaagccttgtctctagtagaaatacaaaaattagccaggcatggtggtgggaacctgtaatcccagctacttgggaggctgaggcaggagaatcacttgaaccaaggaagtggaggctgctatgagctaagatcgcaccattgcactccaacctgggcaacagagcaaaaattccatctcaaaaaaaaaaaaaaaaagagaatattccatgtcacataatgccacaaagagaagcaccagggtcagtcaggaggcagagggagcaagggaaaagcatggatgggagcatttattgtggtttcatgagaaaggcaagacagggtaaacagagtcggggttggtttgcttgaataatttcagttagctctgaggtatagggactgtctctagcagtctggtacctgaccctgacaggattaggacagaagaatattgcttgctggaagttaagagccagaaagaggaggtgtttcagaggaaaggctctggattggttagtttgcacatgaaggcatgttcctggactaacatttgctatctctaagaattgaagaattgactagccctagaagagacaatttcttcccagtcagtgaggcctcagatgccagagcatcaggaatacaaaaagaagaaaatattcagagtaacttcatatattgatatactgatatctactaatataaaccatatgttttacttcttttaatattgagtaaaacatacaatgaattattctattcataaatttgaaagttaatggcctttcacaaatatatatcctccaatcaagatatagattatttctaattactgtagagtgttctctgctgttcacttccactctatagttgtagtttgctaataaaagattaagaccagcacatattttgtttagtgtctgaatataacataacataatatataatggcatttcgttttactcctttctatcctatgcttgggcacagcacatgagccaaacaacccaagaatagcctttccgaatagttttcctaccattatctgttagaatggagggtgggcaaatatcaatcctttcttgaactaaagatatatttaagttacatctctcaacttttgcctctaattaaaagtgaccaaaaccttttttgagaagctccacagagaatcctgcaagcatccacctgccctgtgctggaactgccctggctgttctagccctgaatgaccctcactcagaacagatttatgacctcagcagtgctttaagacaaacaaattaataagaaacaaaacttcacagtgtggtcagcctacttcttcttctttttttttttttttttttttttttttgagacggagtctcactctgtagcccaggctggagtgcagtggcgcgatctcggctcactgcaagctccacctcccgggttcacgtcattctcctgcctcagcctcccgagtagctgggactacaggtgcccgccaccacgcccggctaattttttgtatttttagtagagatggggtttcactatgttagccaggattgtctcgatctcctgacctcgagatctgcccacctcggccccccaaagtgctgggattacaggcgtgagccaccgcacctagccagtcagccaatttctaatctgaaatttgttctgcattgatttcagcttgattttatagaatcattcaaaaccacatgttcatcagccatatactttcaatagttgtccctcctcgatctttggagccatctatactgagataaatgtgatttattgttcagactaaaaagttgtataagatactatctaatttttttctaaggtttcatatttagtccttccaattttgattatcaactgtagttttaaagtttctactttgtcgtcttaattttgtggaaaccagtgaattaagacaacaagcagaagatattgcctaaagcaatcctgcattggttggggactcgggctattaaaattccatcaaagttaatgttcttacccaagattaacaaagccagtagatagacatatttttcacttgcaaatctaagctatattttctggaaagtgaaagacagaaacttaactgaatttaggaattttgcaaaattgtttttcgctctctgggaataaagatttgatcttctccttgtggattgtttacattttctctgaaatgtatttttctaaaacgtttaggctctaacaaacagaagtgtgaagcatgtatttttcatacataaaattaagaatattgccttttaaaaattcacacaattaaatgcatatctgtctaagcattttgagggtatcttatgtttcaggtacaattgatgaaaaaaagaaagaatgtcatagatgcggttgaatttcagttgtctcatgttaaaagaccaccagatccgttagcagcttcatatgatatatgtaaagaataagcactaggctgaaagatgcacataaatacacacatacacaaatatttagatgaataaccatcattctcatcaccttgtataacaatgtatggatgtcccaggatagggatcactagatgcttaaactgcagatgtattatatgtactcacagccctctaaaggacctaaagagataaaaatattgtagaacatcccagaaaagagataagaatattgtagaacatcccagcaatccaaggatcatttttctaaaacatactgattttatacacacacatacataaatacaaatattatacatacatatctcctctaagagtcacagtattttatgataggtttgctaatatactgcattttctaaaaggatttcattatgaaaaaaaattatttgctctatatgtattatttcctaccaacataatttcttattttagagataatcaacttcagcttcaagtggacaataagagttttaaatatagctgtttatcaatattaacctcttatatggtttgactctgtgtcccacccaaatctcaactggaattatagttcccacaatccccacatgttatgggacggacccagtgggaggtaattgaatcatgggggctgttaccctcatgctgttctcatcatagtgagttctcgcaagatctgatagttttataaggatcttttctcccttttgcttggcacttctacttcctgctgccatgtgaaggacatgtttgcttcaacttctgccatgattgtaaatttcctgaggcctccctagtcctgaagaactgtgagttgattaacccactttcctttataaattacccagtgttgagtagttctttatagcagtgtgagagaagactaatatagtaaattggtaccacagagagtggggtgctgctataaggatacccaaaaatgtggaagcaacttaggaactgggaaacaggctaaggttagaacaatttggaaaactcagaagaagacaggaaaatatgggatagtttagaatttccaagagacttgggaggcttagaagacagaaagatgtgggaaagtgtggaacttcctagagacttgttaaatggctttgaccaaaatattgatagtgatataaacaatgatgaccaggctgaggtggtctcagatggagatgaggaacttgttggcagccggaataaagtgcttcttttaatagcttggcaaagagactggtggcattttgcccctgccctcgagatcagcagaactctaaacttgtgagagataatttaaggtatctggtggaacaatttttttagtagcacaacattcaagaggaagcagagcattaaagttaggaaaatttgcagcctgataatggagtagaaaagaaaaactcattttggtgggggagaaattcaagctggctgcataaatttgcataagtaataaggagccaaatattaattgccaagacaatcgggaaaacatctccagggcatgtcagatatctttttgacaggccaggaggtcaaggagggaaaaatggttttgagggccagtccaaggaccccctgctgtgtgcagcattgagacttgttgtcctgtgtcccagctgctccagctgtggctaaaagaggccaaggtatagcttgggccatggcttaagatggtgcaagacccaagccttggcagcttcttcctagtgttgagcctgcaggtgcactgaggtttgggaacctccacctatatttcagaggatatttggaaatgcctggatgtccagtcagaagtttgctgcaggggcagagccctcatagagacctctgcaagggcagtgcagtagggaaatgtggggtccccagtggggcactgcctagtgaagctgtgagaagaaggccactatcctctagaccccagaatggtggatccactgacagcttgcgttggatgcacctggaaaagccacaaacactcaacaccagcccatgaaagtaaatgggaggagtgctgtaccctggaaaacccaaggctgtgggagcccatctcttgcatcagcatgacttggatatgagacatggagtcaaaagagattatttcagagctttaagatttaattattgccttgtttgattttggacttgcatgggcctggagtccctttgttttggccaacttatttcatttggaataggtgtatttagccaatggccgtaccctcatcgtatctgggaagtaagtgacttgcttttgattttacaggctcataggcagaaaggacttgacttgtctcagatgagactttggatttgaatttttgggttaatgctggaatgagttaagactttggggaccattggaagggcatgattatgttttaaaatgtgaagacatgagatttgggaggtgtcaggggtggaatgacatggtttggctctgtgtccccacccaaatctcatcttgtattataattcccataatccccatgtgtcctaggagggaaccatgggtgggaggtaattaaatcatggggacagttacactcatgccattctcatgatagtgagtgagttctcatgctatctgatagttttgtaagggcttccctgccacttcactctgcacttctccttgctgcagccatgtgaagaaggaagtgtttgcttccccttctatcatgattgtaagtttcttgaggcctcctcacccctgagtaactatgtcaattaagcctctttcatttataaattacccagtcttgggcagtgctttatagcagcgtgagaatgaactgatataacctctttcacactgaagcattatatttagaaatctatgattatcccctagattttcagaaccatatcacatatatcatatgtatgaagattgctctaattctgtgaggatactgggagatattaaaaagaagaagacttttatatttttataacaaggaatatgttgattaattgttaaaatgaaatataagatttcattttggtgaatttatgcaataaatgactatgaaatgcatacttcatttgtcattacttttttaaaattttttatttctccacgctgagaaaaggataagattataaattataacaaaattctccagtctttaaaactactttagatctttaaaattcaatgattaaaattttggagttttagtctttagaaaagactaaatcttgtgtatactgttatcaaaaaatcgggggaggaaattctggtcaaaatttattttcagtgtattatgtcttagaatatttttctcccagcacaattaattctattgagaaaattacttttctttttactatagaaattgaataacataagtttatagagagtagtctctcttctaagcacattttcattgccattttgattttaatttttttattttaatatcacgggctaaatagaacttatttttcagaggaaccagccagaaaatatgctgtatactttattccaaggctaaccaaattccatggtagatttatgcaaagccggcactatgctaggcacctaagattctgagggacatacagtctagtgggaagacatactgtaagcaaatgatgtaattacaacacaatgcagtcagataaataatgggagaaggagcaactatactgtaagagggcagaggaaggacctgatcaactattgcctaagggactcaggagaaactttatgagggaattatattagcaaaggattttggagactaatgagtagtagaagcagttttccaggtggaaaagagagagatctagtgttgcagacagggagtacagcatacacaaacaactgaaaaaaagaattgtctttagaattttagctttgtatggagagcaataaatgacaaagctggtatgtatgttgcagtcttgtgaggagcactaaataataatgaaatgaatttcaaattttgtatcctactgtagtccaaagtttcccaactctttgtgatcctaagagttatctgctatcatcttcttaaaaatacagatctccagaccgttctgttggagcttattatttgcttaacattttagaaaacctagatttgaaattatgtgattttgaaagagaggggaatcaatgtttcatttgctttataaaatactaaatcatcaaaatgtatagaaagttgaaattctgaaaatattaagctgaaagtcatagaatccaatgcagttggtaaatggcaagggtttgaactaatccacggctggaaaagtagaaaagtgatcagttttcagaaagttgagctgattggcaagctgaattattggtgagaaaaaatataaactataactctgagattttgaactggatacactgcaaattgataaggttttgtagctaaaatagaaaatcagaacaccaggtttggggaaatcagtgtaggaatggtgagttgaagaacattaagcaatgaatgattatgctaaatcaaacccaagagagtttctagatttaacagaagtgttcacttctgaaaaaactgagaaggaaatgttcctcagtaggcattgtaatgaatggtaaagaaaaataagagactaatgcttttaaagtcatgtctgattcaaaagaaaaatctttcaaccattcactgcatatattttcccatggagacaatttttaaaagctttggctcacttagaaaagaaatcctgagccctttttgttattactttaacttgtccaatctctaaatcacagagatacctcagaggttcattagaaattcccaaatctagaaagaggaaggtcccaataaaaacaaataaaccaaaccagatcctttatgggttgaattttgaagttttcacttcctgattttaaggaagggtcatattttagaggcagaataatggcaaatatagattttaaaacaccatagttaaaacaaagaatcccttccatgtctgtcaccagatctggcagacacatgtatcaagtgtaattctaacacaaattgtgaatgacgcaagtctcatccctaaccagatcccttcacaaggagacactttctagccaacatttttgctttaccattgtaatttgtttttctattattttattgagtgtagtcaatgactcaggttacaatgtgcaaaaatcttccttctgtacttcaaatagatgaagaaacaatcttttagaaaaagttcttctctacttctcggctgaggttcaattattaactttttttaaatttttttgagactgagtctcactctgtcgccctgactgaagtgtggtggtgtcatcttggctcattgtaacctccacctccaggattcaagtgattctcctgcctcagcctcccaagtagctgggattacagtcacacaccaccacaaccagctaatttttgaattttagtagagatggggttttgccatattggtcaagctggtctcgacctcctgacctcatgatttgcccacctcagcctcccaaagtgctgggattacagatgtgagccaccatgcctggccaattattaactgttaagagtggtactttggccgggtgtggtggctcatgcctgtaatgctagcactttgggaggccaaggcaaacagatcacttgaggtcaggagttcaaaaccatcctggtcatcatgatgaaaccccatctctaccaaaaatacaaaaaattagctaggcatggtggccttcgcctgtaatcccagctactcgggaggttgaggcaggagaattgcttgaacccgggaggcaaaggttgcagtgagccaagatcgtgccaccgcactccagcctgggcaacagagcgagactccgtttccaaaaaaaaaaaaaaaaaaagtggtactttgcatctctccgttatatatgtcaactagtcattgcatgttgctgattcaagaggctgtcattgcagtggcctggacttagggaagaaaacactgtgagcaagtcaacccttggtttccagaaagttatgtcttcttggaagagaaattgaaaagcattttttttttttttttgagacagagttttactcttgttttccaggctggagtgcaatgacatgcaatctctgctcacttgcaacctccgcctcccgggttcatctgattctcctgcctcagcctcccgagtagctgggattatgggtgcccagcactacatctggctcgtttttttgtatttttagtagagccgggtttcatgttggccaggctggtctcgaactcctgactgcaggtgatccatctgcctcagccttccaaagtgctgggattagaggcacgagccactgcacctggcctgaaaagcacttttatatcagcttttataaaacacatattactagatatatagggtgaaaatatctgtctagtcctatgtcatgatcgaagaaacatttgaaagaagaatagattgaaagcatcatgcaattccactgacacacagttaagagtttctttagtactggcggtgtttggaagttttcagtaccgctgtgtaagtccggagaagcttcatggagaatggtcagctgtgtgatgcataagccacccctccctcttagtcttaactatttttttctcctttatttgtatttttttcttttcttttcttttcttttcttttctttcttttctttttttttttttttttgagatggagtctcgctctgtcacccaggctgggtgcagtggcgtgatctcgactcgatgcaagcctgcaagctctgcctcccaggttcacgccattctcctgcctcagcctcccgaatagctgggactataggtgcccgccaccatgcccagctaattttttgtatttttttttttagtagagatggggtttcaccgtgttagccaggatggtctccatctcctgacctcatgatccgcccgcctcggcctcccaaagtgctgggattacaggcgtgagccaccgcgcccggcctatttgtattctcttaagaaatatttcatttaaaatataatcaataccactttacaaagtatattatgtctcctttctttatagttttacaaagggcacatatatcagctgtatccagaatagcaaaaattaaagatcaaatattaatattatttctctctcttaaataccaatacaacaaaaatgtattttacataccagacattattttaaatttgctaaaaattattacctttatacggttttaaattttctttttaccagtttcttcatttgtttttctacaaaactatttgctaacttgcgtcaatgcctgcaccagtttctcagcatcctattctgtcatcaacttctttctcttaataggggaaccatttcagtaatctatcaattagtttgtgtaagaggcagaaaattaaaaatccggaggggcgcagtggctcactcctgtaatcccagaatttagggaggctgaggcagttggatcaactgagatcaggagttcgagaccagccttgccaacatgcgaaaccctgtctctactaaaaatacgaaaattagctgggtgtggtggcacgcatctgtaatcccagctacttgggaggctgaggcagtagagtctcttgaacccgagaagtggaggtgcagtgagccgagattgcaccactgcactccagcctggacaacaagagtgaaactccatcgaaaaaaaaaaaacctaggctatcaggtcatttactggcaattgcgattttagcatctataccagcatttttgccaaaaaatccctgagatttctcttccttcttaattttgcctgtagctctcagcatttttccagtcttaaggaagttgaaagttttttttttccattttgtttaaccattaacttccattctctcaaattgcaaatttaaaaaacagaagaatgaaaagaaaataaatctgtcatacagtgtacactgcaatatcatgaatttttgtacagaaaaacactgatttaaagaatttctatgaatttgcaaattagtaatttgaacaaatcactctttgatatctgaaaattaatgaaaagcataatttgtatcactttctcattaatattctaaattgtgtcacagcacataaaaaaatcgataaattatacctcaaaacatgaattaaaaagtattctagaaaactttttaaaagcattgatacaatggagtgcccagagaatttgtctctttctccattatgttttattatgtccacattatttatcaggggaaagaaaaacaattcctattaattatttattaatattaaaatattgatgagtattaaaaagtaccgggcttccagctggtgtactgagttgaacttttctgaaatgcagccagcacaaggggcgtgtattaaaagagcagaacaaatgacttattaggggtccaaaagcagcaatcagaaaaggttcatttaacatagcgatggcacaagcttcaagcaattgcctctacttaagtaagtgtggaattacaaaagcctatttattacagtccaacagggtcctgcagcttgctcaaagagctttgaagaaattcaacagttataaagtcctgctcagtgcagaagcagtaaaatttggacagacccccaaaacagcccacaaagctttcatgaaaaagttaatacaatcctcatcgcaattgttctttgaaatgaattgttttctcacttttctttttttaaaggagagatgctgtacctggttattttcaaaacttctttgaaaatgaattttaaccactaggaaaaaatgaaagtttcatggtggtatcaaattaaatgtaggacctcatgtgttccaacattaagcttcttgaaatgctcttgaaaccaacattaaatgtgactccgttaatggacttacttcagcagaaaaattagtagatttcctcattgtagaaaatgcaaaatttgagtccaaagacactggggctgaaatttttttattagtgattggataatgatttgatttttctaagtattaaagtaagcaaaaataaatttttttttaaaaaatccacatatccatttatttataattcagcaatacatttataaatatagaatatgtttatgaagcttcaactaaagtataagaaaaataacttatcttttgcttggaatcaattttagagagcaaattgcagggttgtgggggtgaagccaatttagggactaaaatagaggattattgaatagatgaagaattgataatgaaaggtaaatgatgttaatttgtatgaaaagatattaattcctaatgggagcaaaaagttggtaagaaaatgaatttactttttcatcagaaaagcaacacctacatttttccttggcaaaagattaagtcaggccaagtgtggtggttcatgcctgtaattctagcactttgggaggcctaccggggagaatcacttgagcccaggagttcaggatcagcctgggcaacatgacaaaactttgtctctacaaataataaaaaattagctgattgtggtggcacaagcctgtagtctcagccagtaggattgctttagcctgggaggtggaggctgcagtaagccgagatcacatcactacactctagcctggaaaacaagggcaaaaccctgtcttaaagaaagaaaaaaataataaaagattaagtcatcattcccaggccaatccatgcttcaattagaaggtgttcctatgagatctcacaaataataaaacccagttgatgggaaatattgcagtagattctattttttggtgtacagttttctctgaagtggcacaaggcaagcatcatgaaagtttctattataggtgaagaataaaaatgaaaagtgtttatagataggaaagtttgaatgagaggtcggatgcaaaaatcatcatgtgataatcatagaaacatcaacaaatacagaacttctgctaacttgtgggaaatacaaatacatgaggttcttatggtccttgatttgagaaaaatctatataaaaataagtgctttaacaatgaaaacaattcaacagttaatgtatctaaagattcctgagtttttgtttgttgtgtgtttgtagtttattttgctgcattccattaaggcagggtgccactgaactccagtgagacatttcgattggcgagtgaaccaagattgagatttgaaagcagaagtactttgatgatagtatgcatttttccttttaatggaagggtttgaagaaggaaatcacttaaaatatttttaatcttcagttagaaatgaatttgaccctatgatatctgatccaaacagatggggtttttattcatattccatactttcgataatgcttagcaaaacatagcaaatgtagaatcaccatcaaataagacatttcaaaacatgtctaggtaattgtaacacatatagcagtcatttccttggtacctctcattaagtatttttttaagaaataaaactgtacaaaagaagattgttgttccttttctttgtagtcaagagatgtttgtcagaagtcaaggcctactgtaatatgtcctaaatcatatctattttacaatatactaaatattattattacctatggataccatgggactccttgtgcataatggattccagtcctcttgcagagctgcatatgaaaatgttatcaatgagctgaagaatctggcattaataactttgcaacattataacaaataggtagtcctgatgttttgttctttttttaatacatcaaatatatttcattgcttacattatagtagcagattgaaaacatctgctcacttgccactagtccaccagcagcagagaatctcagcacattttccctaggcctgcatgtaccagggctataatccagctgttgagtctggatatggggccagattaatattcaagagccttggaaatggaaatagtgctttcttgccaaaaaactggaacaatgatagactccatttgcatgttcccttctccctctgttcttattcgccaccctttctaacccattaatttgcttccttccaccttcccctcccatcctctctttacagctccatcacctgtcctgacgattaagaaagatcggacctccagaaatagcatctctttgtcctggcaagaacctgaacatcctaatgggatcatattggactacgaggtcaaatactatgaaaaggtggggaaacaatgtttaagggttgggctgtgtaggcaagaagctgtttcctcatgagctgtgctcttgcaaagaaaccagtgacattcctggtaaatggtagagcactgtttagaactgtggccctgtgacccctttgatttattggtagaggaaggtttagaaagaatcttgttgaataccccctattctacagcaataaacaacatcaaagatgccactgccaacttaatccagttacttatggcaatagcatgacatttatctccctttacaccaagacccctactctaccaactattttattgtggtttcttagtctatttgtgaactgtttttttagttcattgcctcaagcatcatttcctgaccttcaaatttacatgcatttcattcaatacaaatagcaacattgtgctagtaagaaaaatattgtattatttaactgatgatgaaaagattttcttgaccctgtagaaggaaatttaaaaggttggggatagatggataaatttgcgtgacataaagttgtggcttggtaatgcaattattaaaaaaaataggcacatggttatttttaccccaaatttaaaaattattaaaaaatagttatgtggttattttgccctgagtggagtggcgagtattccatcattctaaataactcattttttttctggttgtaaatgatagtaaagtttaaagacaagatatgtttaaaccttagaatcacagctagttagtttcacaactactaacatgaacactacatatttgtgtatctacttcagtttataaagtgtgttaaaatgaattaaatgcaaattgtgcatttatatagcagtttatatttacagaacatttctgtggacattacttaagtctgagctgtataacaaccttatggaagtagcaaagtaagttgttttagaaataagaaaacagagagtgatgttatatgaatttcccacagcctcattgctaataaatattaggcatctgttttgaattgtggcagccgtgagtcctcctttagtaggtttttccctatatcaggtacctttttctacatgataatagatccttataagaattattggcataatcaactgtgcaaactgcgtaatgtaaaaacattgttttgcattatgtagttatttccttgcttgaagttaatatatttctctagtataatgtcatttttttcatagtctctcttacagaaagcctagagtatatcttttttattaaaagaaattgatgccaaataaacttcattgttcaaaaattgtagtagaaataaattttctcctagctttgagtcctctactgtggtaaagtcaaatactcataggattgtgatctattttcagaagtgtgacaagatagaatgggcaaatataataattcatgttcataaatgatgccacaaaattcttaaaaatcagtaatgtgcctcagttcaaactagatttcaggactgggagaagaacacctaacatttagatctatgaggttgatctcaaattttaattgtatacatctgcacctttcacaaacatgagaaatatgctgccttatttcaaactccctcaacaaatgcaacaagcatcattgccttttttttttttttttttttgagatggagtttcactcttgttgcccaggctggagtgcaatggcatgatctcggctcaccgccacctccgcctcccaggttcaagcgattctcctgcctcagcctcccaagtagctgggatgataggcatgcgccaccatgcccaactaattttgtatttttagtagagatgaggtttctccacgttggtcaggctggtcttaaacttgtgacctcaggtgatccacccgcctgggcctcccaaagtgctgggattacaggcgtgagccaccacccctggacattacttttaaacaatattagctattgcaggaaaaaatggtcaaatctattgattattccctaagtattttttgatacatacatacctgtaatattatttaaaatatattcctttaaatacatatttgcatcacatatacctaaatttaaaaattaattctaaatatttatagtatgcttggtaatatttagaaagattctctaggatttaaggtccacaaggtctagatttctggactggttatttcgctgatggtgattaacagtatatgtaatgtatggcatgttttctgtactattcaatctcgttttggttgaggatatacagcgtttcatattatccactctaggtcctactctaggtgcagggacattgtaccattgcttgaaatcaggttcctcataggagctctgtgtataataatatatgtgagagaaaaaacgtaattcttgataaattcaatttttgtaaacaaagcttgacacaaagagaccactaaaatgtgtcgtgtgaatctaatgtacaatgtgaatctcctagagatcctttttgggaagcatttctagcctttgatctggagatttttgtctctaccaaaccacagtgacttagattaaatacagcacaaatacagttaagctaaaaataatgtagagctacatataaaaccttgattttttatgtttaatattttaaggttgataaaaaaaagttctactccagaatcaatagagcattcctattaggtttaattcaaagggatattttcttctttgtaagtttgttattggaattagatttaagctttctctcagccttgactttgaagagaacatatcttctctcacatatttactggttagaataaagccaaatttttcctgctttacatgcaggacagaaatcataatattcaaattgggaaattctgtaaatatttttatttttagaaatgcccatgttgggacaggtgcggtggctcatgcctgtaatcccagcactttgggcggccgaggcaggtggatctcctgaggtcagcagttcaagaccagcctggccaacatggtgaaacctcgtctctactaaaaatacaaaaattacctgggagtgatggcgtgcacctgtagtcccagctactcaggaggctgaggcaggaaaatcgtttgaacccaggaggcagaggtttcagtgagctgagatcgcgccactgcactccagcctggtgacaaagcaagactttgtctaaaaaaaaaaaaaatgcctaagttgcgttcagagaataaaataattgaaataatcgatatgactttttaaatccatcctatgatttgtgttaaaatataaaagaatcaggtttgagtggttcactgtttatcattttatagcattatgaagatttgattttaacatgaatttttttttctgacctcaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactgtatgtattatttcaatgcagtctagaggagggggcagggatcttgcaaaagatgtctgatcgtttattctcactgtttctaagttttaaacaaatgtgatacatttaaggtatattgcttgggacattgcaatttgcagagccctgtgtctgtatacagtatttgtgtttgtgtgggtgtacattttgtgtttctttttttcttgtatgcaaatcaaacatattctaatgcctgaaatgcttctgttttttttttttagccataaattgcttttgaggaacattatttaatatagtaacacacttccagtgtctgtcatttcagatattccaggttcattgcgtgattcaatgaaccacaaaaaagaaacttgctgatccatgagaatcttaattttgttttaatccttaacacattcaatagcatatcacagagagaataaggattttctaaaatgtgttttatcacttcattcacattcagaagtaatttgaatagcctgttcctttaaccccaaatttggctaaaattggcctaaaactggcaaacatttttccagtaacttttctttttttcaaatgaattttcttcatacttaaaaaagccctttgctaaaatataattttcaaaaaggtaaaattatgtctatggcactaatataaaatgagtagaagttaatgattttacttaactcatttttttctttctttctttttttttttttttttttgagacggagtcttgctctgtcacccaggctggagtacagcagagcgatctcggctcactgcaagctcctgcaagctccgcctcctggcttcacgccattctccccctcagcctcccgagtagctgggactacaggcggccgctaccatgcccggctaattttttgtatttttggtagagtccagatttcaccgtgttagccaggatggtcttgatctcctgtcaccttgttagccaggatggtcttgatctcctgacctcgtgatccgcccgcgttggcctcccaaagtgctaggattataggcgtgagccacctcgcccggctgtttaactcattaattaataaacagattagcaagagattaaaacctgtgctaagaaaaacttgaagaacagatacataattatgtgtgtgtgtgtgtgagcgtgtgtgtgtgtgtgtgtgtgtgtttaggtaatcataatatgctaaaaatgtgctaatatatcccacactggttaatatccaatgagggtaataaatgtaatgattgaggtcatctttcttacagggcacaaaccagttgtctttctagtaaataagtgttatttcaattgttaaaggaaaaaggatatatatcactatcagttttctacaacttaaattcactgttgtaaggtagcctagaaagatgagcaaagatgcacaccctttagaaatagattacccaggaaaggtctgacaatgctcaacactctgctgaatggaatataataatcttctgaccattcccatttcccattcttccctgacacctgtacttcccattttctagatagttagttcctgacataaaatctcattgttactggtatatttttgtgtccaaatttgatacctgataaaaactttcaggattgacctaaaaatataagaatcattctagttatatagtatttattccatcaagtttactcatgttggagtacatattttatggcacactttctgtcggacaattagaaatgctgcttacaataaggagctataaatttcaccaggtattgaaatgttaatgtttttagaaatcatctgctcatagctgaaccatgacaattctactcaaaggagagctgccatcctcaaatacgtaaatctattcttaaagacttcttttaatcctcacaataaaatgtgtatggagaaatcaccctcagaagatattagaaacaaaacatgaagtatgatggaaataatgcaagtgccaacaaggtttaaaacaaattaaaaactttagatggctcaataataaaatataagtgtaacttaacattagtacttctaagactttttgcaaatgttaagtggtacgaagaaagtttctccttttgaaatgattacagattaacttttctcaaaatctctttctttttttgtgacaaaatcctgctctgttgcccaggatggagtgcaatggcatgatctcagctcactgcaacctctgcctccctgactcaagcaattcttctgtttcagcctcccgagtggctgggactacaggctcatgtgcccacgtctggctaattttttttgtatttttagtatagatggggtttcaccatattggtcaagctgatcttgaactcctgacctcagggtgatccacccacctcagcctcccaaagtactgggacttaaatgaatatttgaaataacagcaataacaaaatctatatttgatttatcaggagagatccgaaatcatagaattagcaaaagctaatatttattgtgtcctgtggtagaaatcaggcatattatgaggcaaaaagctcagatcactattagataaacatgttttatgcatatttgggaacatccctctaatattacatggtcttaacacttaaccctctctgataagtaaatttgcaaaaacaatatattttaaaattgtaatgtaattccagatttaccacagatattgctgtggtagcatttatgcataaccttctaatgaggcttcagtgtctgaggtttaggaaatatctcattcgaaaactgcagggccttaggatttttgccaagtaagttttgtattagcaatgcttccattgattgagagagagaagaggaaaaaaggatggaaaaatatgagcctttttctccctcctcatttatttaaaaactgtgagttacacattttaatctttttacaaaagttagtttacttttgcccttatttcaccataatatttccagattttaaatataaatgagaaaaaaatgccttttgtcttaggaggtaaaagacaaaattttttttgtctcactctccctattgtttttattaaatcaaaatgacatattcctaaatgctgtaagtatttaataagactcttatttgttatatattgatttttttaaaaaatagacataagacttctgtttgtatttaacagtttgctttttccctctcgttttaatattttattttatttatgtatttatttattcttttttgagaccaagtcttgctctgtcgcccaggtgggaatgcagtggtgagatctcagctccctacaaaatccgcctcctgggttcaagcgattctatagctgggattacaggcatgtgccacaatgcccagctaattttggcatttttagtagagacggggtttcaccatgttggccaggctggtcttgaactcctgacctcaagtaatccgactgccttggccttcaaaagtgctgggattacaggtgtgagccaccgtgcccagccggttttaattttgtaattacataagaatgtctcattcatgacatgtatgcatatttcttggtagaacacaatgtattttgagctggaatttagataacattttctgaactttatagggaagagatggaggcagagcagagcacatattgttttctaagtgctttaaaatatcttatttttgtatgttggtattttatatttattatcatcttcattttacagttgaggaaactgagacaaagggaggttaaggaagttttccaaagtcacacaattggcaagggatacatcaattccagaatccaggtttctacatgacagtatataaagcagtatgataaacatttcatttgattctgttctataagttattcagatactattgtatccttttatacatgatccaagatacagattttgtgtgttttttttctgagtttacatatgtagtcagatggggcaacaaacctagaatctccaggttttgaagtcttgaaccgtgcaattattgcacatgaaaaaaaaaatactaagctaagacccatagaaagcatggagtataaaagagtaaaaggattttcctagcatgaaggtagcttccaccaatacaagaagtacagacattagggcatgtttggaaaagcagatagtccaattgtttggaaaccctcagtggggaaaaactgaagccatggtgtgtgctttgtgcacaagaaaatcagggataaagtgaaagttaagatcaaatacattagagcagctgagcattattagggtgaacttgacaagtcatttcaagtctccgtgtctcagtttttctatctggaaattggggaacatcatgtgataactcatgagattttaatgtttattaaatatgttattacttgtaaagtgcttaaaatagtacctcatatagcctcatatagtaggtactcactgtgcatgtgtgttgtgtttaaacaaatagtccgtaatttgaacatctgaagaatttcaagaataacaatctgtggaataaagttgagttttaaaattagaggatttcattggatattattatgaagaagacaaccccagggataattaaattagcgctcccgaaagcctcacaccctcattatttgttgttttgaagagtaaaaatggtacaactttactttcttgggccctattactagggaacataaaggaagcctgacaaagggagaatggaatcattaaatggagaaatttctatataaaaattaggcattcatcatctatcattttgtaggaaatagagtacttttgcaaagttttaaccagggaaatgatataaacaattgtaacatttattgagcacttaatatatgcttggcactactgtaagtgttttactagtactaactcatttaattctcaaacaacaaaattatgtcacacagcaaacaaatataaatccaggagttctgactcaaaagaatgaactctgaatcactcttttgagagagaaagccagcactctgtgtaggatggagtaaaatggaaatgaatagaaacagagggagcagaaaacaaattcaagttgaattattaagaaatgtaatagctatcaattacattaaattattagacacctatgtaactcatcactattagtcattcacatatttgctaattttagcaatggaaatgatctgatttagttatgtgctttagatagcctctgtgagtcatatattttagagacagaaaaaactgtggagaaatcctagtttaattctgttttcaacagaaaaagaaatagataattattttttctcctatcatagttcccttcccagtttcactgagctttattttataagctggctaatcaaaataaccacagaattcaaaccttgctgctttctataaattattacagtatgcaaagtgaaaagcatgagttcaagtcaccactatatgtttatggagcatttttgaaatattggattaagctatttcacaaatcattcacagatctgtagccaatggatagggatgtaacagccagatgctctgggaggaagatacaaagatgaaactataagagctttataggagaaatatttgtgaaggataaaaggcagatggagctgagccaggcaagcagaacctcagactgagatgtaggtctgtcatttataaaggcaaggagggaaagaagaaagagttgaggaggggaagccccagacagcagtgcagctctgagggttttggccaagccgatggggagtttcagagcacagatcacccatttgaggagtgttgcattgggcagggatggccaggctccagtaaccctttgccagtactgttaagtcactaaggggtacataacctgtgcttgaaggctgtagctgaaggtgctgcagctggaggctgtctgctgactgtactctctgcagcaggaacatctgagcaagcactcctgtgactgccatagaggtataaacaatagtttgctggtagtaaagagtaaagggcttacaacagtttatattatgagtgtgccatcctgccacactctgagcacttttcttcagatgctgctcacaggaaactcctaacaacctatctgtcacgtttcttttcttgcattatttaactaaccctaaaaccacatattttagagaaaatcttccaaacttagatttgttcaggctgaagatgatatgttggctcctggggaggtgatagtattcagataactaaaatctgctcttcttttgagtcctgaggtattcatgtacttaatcagcatttaccgcaagaacaacatatgcaaataagagcataaaagaggctgttccaggaattgtgtgtattttaaaatatctagagattaggatgcttatggagtttgtaggagatgtggctggggatttaaacatgaaacagattctaaatggcttttacacgctctgctatgaaatttgcatcttatcctgaaagttataaagagccaaaattttcctatgcaaaacttttatgcataggaatgacatggtcaaattcatggtttagaaggaatattctgaaagataaaatgtgtggaaagcatacaaatagagaccaaattaggaatttctaattataattcagaagataaatgaagacttaaactaggatatttaagagtgtttggtgattaactggaggcagaatgattaggagatggagaggagaaggttattttatatttatggtctagattcttgctcctcaaaatgttgtggtctggaatcagcagaatcagcactgcctgtgtgttcataagaaatatacaatctcattccccactccggaatgactgaatctgaaactgcttttccagagattcttgagtggtttttgtgaacattaaagtttgagaagcattggtctgggtcaagagtcagtaaacttttttctgtaataggccagataataaatattttaggctttgtgcacatcattctctattgctgctactcaacttgcccattctagcataaaatcagtcatagacaatatacaaattaatgaatgattgtggctatattccaataaaattgtatttatagacagcaaaatttgaatttcctagatttagaattttcacatgtcatgaaatctcattcttttgactttttacaactgttaaaagaaatgtgaaaccattctaagctcgtgagctgtacaaaaacaggggacgggcaagatttggctcctgggcttttttgccaaccatttgtctaggtgaataaatgggccatttataaaggtaggaaatagagggacagtttgttggtggtatgtgttgaggtccatgtattatatcacttttcaaatgaatatggatattggagttaaaacaagcttaattagaaagctttttataattgtatgctgagaaatcttcctctcttctctaagatcctcccataacttctggttcattcaacgagttttttgccattgaggacagagaaacccagtacagcatattttggacaggagacatttaaataatgtttgattgatgtcattgaaacaaagtatgtacccatattaattaggtagaaatttcaagcaaaattatgggaaatgtctatttttttaaacattaagtaaagaatactttcaacattgtatcagacattaagccatacttcaggtaaaagtagaacacatattaattaattaatgaatcaatcaactgttccatgtagatgttagtcatgattataatacctgttcttattttttctcttcaacctcacagctttctccatctctggtgaaagtagccaagtggtcatgatcgccatttcagcggcagtagcaattattctcctcactgttgtcatctatgttttgattgggaggtgagttcacagtctgtttcactattcactttctttgttgctttgtttgctgccactgattgctgttaaaatgtgaagagtgtgctcaataaaatattttaacaaataagaatgtctccacttgtagtttaggtcctctctttctcctccttttctttgtttctccatccttagttttgattttctgctctacattaaattcctgtccccactcttttaacatacacccctcctcttctctcttctgacactactcctagtttttactttctttctctaattatctcctcactcttcaaataaccccagatttccttgacactttctcacccagaacaggggtaacactgcacagcactaatcattacccatagagactttacccttcattccttctaacagaagttgttaaaaaatactataaacacattctaaagccattataaaaactgaactggagggtctgcacagtgggaagcaactctgtgtatctcctcattaggcagctttccagggttcccagagagaggggctttcttcagaggattttgaaaatatgaagttattaaactttcactaaagcatttaattgtttgaggaaaatgttttatttttatgctttgcacattctgagcataggtaactattttaaatatattcctcttatgtgttcgctttccttgatttacctccaggttctgtggctataagtcaaaacatggggcagatgaaaaaagacttcattttggcaatgggcattgtaagtttctaaacttggctttttgttttgcttcaccgttttagctttagcagttattgatttacaattggttaacttcctcctgacaaagagacttcaaaagtagttttatggaaaaactgagtacattaaatttattttagaaaaagagggaaattcatggttctgcattaaataatttttacatgtgtacatttcagcatacttaagctaaaataaagggtaatctgtggtttacattcaaataacgcacatgctaggtagtagaaactagtctgctctgcatggctgaaatgcaaagcgtatcttcaatttccttattactagtcctttgctaaactctaaataggagacttttctctttcctaactgccaagtaaatataaacaacctctgtttatttgaagtgccttatcccattttatcaaccaacctagaaagagcctttaaaataaactgtttattttgcagttacatgatatccaactagtagtaaagccagaactttctctccacattttaatttacccttttaattttttttaaatacacatttcagaaacaaagtgtttacaactaacaaaaagactttttttctttttctggtgaaacgaatcattccaggtgttttgcgttccaaactatggctcagcttagtgtggcaattactaatcagtagcttaaatagcatgttctcatggaaattagtacaaagactgtactcatgcttatgtgctccaaaataatctcaatataactaatgtagtcttgtaagcattaatttttttagtattcactattgccttctaaaattatttgcaaattgacatgatactttgtatcagccgttggattatcatctaaaaatgatagctttagttgtaactcaagtaaaaaacttgactacctgttgctaacctgcaggaagcatacagtagcttgaaaataatgcctttcaaaatataaattgatatgagaagaaagcagtataggagtttgaagaagcattattttgttcatccaattgcagcgtctataaaataattcacacaaaaaagccaaagtactacattcctaaaatcaacatcacatcagtccagattaattaggtgaccaactcaaaagtctaaaaagaatgcctgaacaagttacaggatccttgtctttctttttctcaatgggcccacaaaacactagtgttacaatttttatgcataaattagagcagtggcattcttgtggattaagtcaccctcaatttgacttggacaattgtaaatatcatctttagagcaagaccatgctgatttgattttttttttatgggaagcctacatcttacgaattttgagctttggtaaatttctgtgtgccaattattaaacaggttcctctatcgtcccagtctgttttgctattgtttttatggtggatttttgttgaaactttaatttttttcaaatgcacaatatccttatgacaaacaaaagagaaatgcatttcatcctggctgcaaaggcataaagtaacttatatgcatgtcataaactttctgcatcttaatactacagctggtttatttcagaccttttatttggtattactttaaaaagctctagctacgaactgttccctacagccttgttacaaatcctataatattgcttcaaaaggaaagaaatgtgtttcacctcctaagatcctgtccccttgccctttctggctgggcctttttacttctttgctatccttagggcaactcatgctggtaaaatggaaatgtaaattattgtgtttgcacagaatgagctgtaaagtagtgcagcttaacacgtgtgcatgtgtttattacctggttttcatgacagagcccagttactctgtatgttgcccttaattattggtgtgaagggattatgtgcctcgcagcctgaatcacctgattcctggaatctctggggtcagcagttaaagatcagcagccagtgcttctacagcgaacagaccattttacttgggggtgtatatgtttatgtttgtttttttcccccaaatgtcttatggatggaaaagaaattcaccttattttaattaatagaaattaataggattcattttatttgggaatggttatttaattttcaaattatttagtaatagtagtattgcatataggtatccatcatacatatattctctacaagctgactggtacttaagggtaaatctaaatcacacaatttcaagtctgtttaaggccaatgcttatttaaaatatgtgagacattgttcctaacaactcattttataatctttgtaaattctgatggcaggaaatctcccccacgttaatttccttaacttcagcaaagtaaaggagttataattatgtacaaaacagttccattttaccttatgcttaaagtatcattttatttccttgaaaaagattgctagatttctttaccttactgttactaagtaaaggcaaataaaaactggaagatcacacattatagggttgatctgatatgagttttcatccttaaaatgtaactaaattgactaaatgaaaagactccaacaagattttatttcctaacatattttagtaatggttacttacttttacaatttttcttactccacatctagaaaagtatgatagcttttccttaatcttaaagaagtttcttcttttaaaggtaaagggttttagtactggtaatgttagaagttattttaatgtaacaataaagcacaacagattactgtattaaagggtgactctcccatctgtatttataggaaggattcatgcttatatggaagaagcatataagctgatctgtgagctcaaaagtaatggacatttctaagtctaaattctaccattaggaaacatcaattatattaataattgtaaataaatgttcttaacaataaaaacgctcattagggcaatgagctctatcaatacattgagtgagaactatgcaacagtttctcatgctaggcatttgaatagtatagctttttttttttctcagagccctagcttgtcttttttgccaagatattcaagatgaaaaactctaaaagtgaagttctcacttcaacagctactccactcagagtttgtccaaagcaagggacagaacttgtatttccccatttctgtggatattgacttctagatagtggtgtcctttcaaattatccacacctcgcctcaagctggatagcagctgctcttttgttgtagctgtatcagcaccaggcagaagtaggagtcgtgttagcttttcttctgcattccctatttgccctctcaccaccatccctgctttctattatgctgtgtcaaagtcatgcaaataatagctgaggaaaatagagtttttacccaacctctctctcagccaccatttcttttacaacagtttattctcacacttacgtttttttactcaaaatctctatgaaagcttcacaagaacataaatcgtaatgcattataaccatgggtttcatgaagttgtcttgtagttcaaagaattgatcatttgttaacacatactgtgaaatcctagacttgttggcctaatgttcattgtactgaggcttcccagaaaaactgcgggcatctgcagtctccacaactatttaatacaaactacaaaactaactcaaagaaacgattggttcacgcagggtgttcaattgcaactttcccataattctcccattatgaagtaatattggaaacagtaatatctgatttcatttgttataatttaatgtaatgaatgaaaatatatttcactattaagtatccatattctgtgctaaaacacactattaagtatccatattctgtgctatgaatgttatcaaaattaaaagcaaaatcagtagtcttagcagatataccataggagttacattgcaatttcctttaattttagatcatatttatatagtttagtagatcttagaatcacttttttaaaactcagggtttttgtttagagaaagttaatttattgaaaattgcaaattgtctccactgttatttttccaaattataggaatcttattaatattaaatcaaattaaaatgattatcctgtatcagttgtctgtaatattttaactacaggatatgaacatttttaccttcagaataatttaatgaataaatataatatgaaggagatttttatttaataaattacatatatgacttacgtttggaacttagctccttagcgccattattcaactcatagacaatatttattttacttctaattatgttataaagctatacaatatgattatatttaactgatactatattggtgtgtatacatgtatgtattatatatacacaccaatataatatataatacatacatgtatacacatactaacagcttaaagtagatttgtaattacagtgggacattttgattgtgaatgttaatataagcagtacagtgtcagaaggtatgccattatatatcatttaatttatctataattgcagccattatctcaccttataattgtattgaattattttccaatcttgcattgtaatacatatctggttattataacatttgtgtaatcataaatatgcaatagcataatggtgttcactcactgttgctcctggtagtaatgactaggtctaatcagttctgaattatctttcttcttaagatccccttttttgagtatgcattttccttctgatgtttttgcaaagaaagctcctcattgtggttcctttatataattcatcatagagaacatgttttcttaaatttttcaacacagtccaatgtcactgccagtttctgtgatactacagaataaactgaaggttgtgcaccttatggggtagggatttttttaaaccaataatgccataaaatttgatctataattgtttgtacaaatctagctacaattgcgcctttctttctttcctcaaacagtaaaacttccaggtctcaggacttatgttgacccacatacatatgaagaccctacccaagctgttcatgagtttgccaaggaattggatgccaccaacatatccattgataaagttgttggagcaggtaaccacaatgaccctactgccaacttagtactgtatgtgaatcacgattgctcagtctctgaaacctaagtatattgctaaagaaatgggaattttctgatttcatgatcaaaggcaagtaataaataagtgcaatatttaatggaatgtaatgagttcaaaggtgccagacttaccggctcacagaccatggctgcttttgatttattaaatttctgatgtgacagcagcaacaactcaatcttcccatagctgtgctgatcgtgtgtcacaaaacctatttggctaaataaggataactggataaaagtctatttcaatttagacaacccaggtaatttgaagttttcattttcaattttagaatcatgtttggaattaaaagaacaaacaacacaaagtaatatcatgactcatcttacataaattttatcacaactatcttgggtggatattttaaataatataaggtgctccattttaatgcttgcttgactttgaatagtcttatgtgttaaagctttttttaataaatatacctttgttctaattattaatttaaacaatgataaatttgttaacaatcacctattaagtggttaataacagttgcatatttataagaaaaatttcatatatttgtaaaataacagtattttatatatttacacataaacacatgatatgtgcagtatgcatggaagtaaaactactattcaaaagtaaaaatgaaccatgctcaacaataaaaaattttgtaccatcatctaatccttcaatgtcactccccaaagcaaacataaactagttatgttgatacaggaattctctgtgtaacatcagatcacattttctgcaagtaccgtatttacatatttatgagtgatgtgtctttacaaaaatgtacatgtaatgctttgtttctttttctatacaccaaagtagtactgaaaaatcaagcagtagttagtatgcgaacaggacaatcttgtaaatataatgttaatttactagagcttctcttctaattatcttaatttcttatcctaaaatttacatgtgcaggtaatattaaaatatgaaacttgtgttcatagaaagaaaatggagtagtaacttcttttttacaatctaagacttgagagtaaacatattcgctgtacatctgtgctgatccagtgccaaaacagatatatattgtttactctgtttcatttcttcagtcctgacttctgaacagctccatgatgcagaagggtttagtctggctggttttaatgtttcctcacaagagtgcacttttctccagcacggagcctgcggtagcaaatgcagcacgaggactttgaacactcaactggagaatatgttgagaggaggaaaaggttacttatgctaagccactgtccaaaagccaggcagacattattatgatgttgaaatttaggtacctctccactgataaaatatctttatatagttattattgacagactcagatatacagaacatagtgatttgggaaaaagcacaccactgaaaatagcagctgataaatgagataaggggaggtctatttatactgaatcacttaatccctgatgctcattaaagattagaatagagcctccttcctatttctgtcttcaagtatatatgttaatgattagatatatgcccatgttcagggttttgcagccaatattcacatttgccatgttaagaacaacaaaactgtacttatttgcaaataggtataccttcaaggttagttatacttttcctgaaataattcaatacaatatacacacccaattctagactgccttgatgacctttcagagggtttgtatttaccaagttagaaaatgaaattattattcctaaaagctaacaatttgttaaacattttgttttgtaaaatgtaaaatatgtacacaaataaattaaatagtgtaataataaataaacctgtatgttactcatttctaaaatagcttttataacaatgaacaaatggcaaccttggttggtatatacatttacctacttcctacattcttaatcttaaaaaaaatatgttatttataaaaatttaataattattctaaattgattaccaactggcttccattgttagaaaggcaaacctttcagccaactacataactttcagagtcaattaaatttacagaaagaatatatatatatatatatatatataagctaattctcttaaatttctgtcagaaattttacataaatgaattgatgttatggaaactctcttgtatacattggactatagaaagaattatacttatactataaatgataaaattaagacatatgaattagcttcccacagtagtagattactagaagtgaggaattcatgactacaattcctaattttactcctcaatccaaccattctttcaacgattgaatactaaaaatttctgaagaaagtaaatacttagtaagtccttaatttatcctgtgcattcccatgatatttaattttattatcctttttagataggtattattatctccatttcagcacgtgaataaacaaaagctgagaatttgaatagacttgtttggatcaaatgaaaaaccaaaatttgaatcttatactttccaaatttaaagcccatgctggacactggagatcatagtagtgtcttcttcatagtatttttttttgaggattaaacaagataagttgtgcaggggacttagctgacacagaagcattgttcaatatgtgtttttattatgcttactttatgaaaacagtagaaggagggtaggctttaaagctagtgttggagggagtcattctatttaaatgtcggctttttttaattgtttaaatgaaattagcataagaaattttattttgagcagcttttacattgtgcattttaatcagaatacagtccccattcttataaatatacctatttcaaagagcaaataaaattgccgcacttattagaattaaaaaatcaagatctggcagccatgcttttatctagaaatgacaagatctgaatttttgtttcatatgggtgcaaagttaattgaataagacaatataaaacttggccagatgaaactattgcaaattgcatttgcccagtctttgttaacttttacaatacagttcttttattttttatttttaatctttttctatttttagcagctttattgagatacaatttaccaaccataaagttcagctatttaagtatacaattcagtgatttttagtatattttcagagttgtaataaccataattgctatcccaatgcagttattttaaattattaaaaatataattgaattaatattaagcatttctatgtcttttataatatattggcggctatttctagtgtttatctgatgaaataatcacattactaaatgtggggaattttaaaaactagcattgctgaaacacaattttcatgaatttcgaaggtaaatatatacatgtacatgtttatgtgtccaggtgtcccacttacaacaaagaacactcttaattggctcatttaaaatttgaactcctacttttcatatctctagtatgctatcctttacaaatatatgtccagtaagacatgagccttgttatcgccatcattaccataaccatctcttacattaacatagaatttggcattttataaagcactttcatattcatttgtcagtttgatttaaacagaaactcttaaagggtagttaggcaatttatcctttaggtgggtctgaactcagagagataaatagtgaccaacacttagatgtcacctactgtgtgtctggcactgtttcaagtacttaacatacattagttcctttaatcccacaacagctttatgaggtagatacaataagtgtcccccatagagataggaaaagataggtacagagaggttaagttacttaaaatcacacagctaatatgtggcagagtcagaattggacccgaagcaattcggctgcaggatccatgctcttaaccagagttctgtactatcactcctgtaaactgacaagtgacatgtcacttagaatatgtgatgatgacatctacatttaaaacatgctctattataccatgttgatgtatgataatggcagaactttctggttttcccaagcttagtgtttacacaaagtgaaacaaagtaaatgggagcgctctgataatgttcggataaccctatatgaggaaagaaactcttactcttgtttacaattctgagaataattttatcacaccataacttctctttctcctaatattctcatatctaaatggcatattcttccttcgaattagcaagatcaatgaactttctcaagttctactccctgattctttctgtatcctaaggaacactatagctgtagatatcattatcttctctacacttcctcaaagggaataaactagtcctgtcttgtttaccattatatctatctctgtgtgttttatactgtatgcaatacagttgctattatgaatatttattaaataaatgcatgaatatctgcttttggattttaagtgactttgccaaattaaagcataagtcattgctttgaaaacagggcaagagtggatttctggggatgagtcaagcctggggaaggttaaagcttcccagggagagagacaccatttgtagtaatgtagctggcaaatcaataggacaacctgctacttttgtggttcaaaccacttgcttgaaaacaaaaatagagaagaatcatatcacttcaatctgactgacacgtagggcatgaagctcatagaaaattcacagagagaaaattggaccaagattatgattccactccatcaagagccaaaaattaatcatataattaattctaaaatatttcaagaaaagctcatttgacattaaaaactatttttaatgtgatgcaaaacatatctgataatccacactatgttagaagttcttctgtgaacaaaggacattctatagaactcccatgtggcaatcatcatggcagcatgggtacagataaataaatgtaaagggtatctgctctaagtgagctccaaatgtaatgaattgatgattagtaaatctctcagtaaaaatgtattttgaaggtagtgtccatactagttctaggcagttttatatcaactggactataatatttaaaagtcagtaacactctatatgggacaaattctggattaattgcacattgaagacttttttttttaaattgaagaagatgaatctaaaatatttctacagtatttagataaggcatgttgtttttatttgatactgttatattgttgttgtcctccagaagcccagagacttttatagctggtatgtcagtaaagcaacacaccaatactccaataaaataaattgatagcagatgctttccttctcatttttagagtctgaatatatagccatattggccctcggtaaaaacagaattgttaaaatatctgaaatttaatccaatgctcacatttaatcactgttggtgctgtcctgttaatttctctgaggtaatggtagctatgacaacaaggggtaaaaaatctaacatatgcagctttcaacttatctctccttttacattacattatttatagtgtcgtactttaaagtatatggaattttcacaaggttcattttccaacagggggtgactatcctgaggttttctaggcagtttcatatgattatctttcaaaataatttggagtactagagtgtacatcttgcaggtcaaaggcacaaatattttaaatggaaattttgaaataaaacagttgctctctactgatgaatttttattatagaattccttacattttgttgctgttctgctttataacaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagtaaagtagtcataagacctgtgtttccgtatgttgagcaaaggttgtttaaacccaaccccaaccatttaagaattttggctttttttcataagtatctcagttttaccaaaaagaaaagtttaggaatagcatgcctttctttgacagtagagcagacctttaaataatattctattgacagtactgttttagacctcaaaaaattttaaaaaaatactagaagccacatattagaccatttaaaggtacgctgattagcagacagttaagagaagaattgtggggaattctcggctatgtaagtagcaaagaaaaacaatgactcaagcttgacaggaactcccagctagctgccttttcttttattgttcatcagttttatttaaaagttacaaatctttaacctcctcccaccccctgcatccctgcctttaggaaaattttgggagtctaggaaatgcttctgagctgtacagattggaatcacaatagacccaaggccgtttcttggttctctgtggattttaaatagttctgatctagaaacccaggtggattcttactgctctgtggaagctctggctcacagcccatgatagagatgtgaacttatttccatgatggtttctccagcaggtctcaaaagggatcctgtgaggcggatctgtgatttttggctccaatccctatataagtctcttgagaatactctgggacatttttcctcaagattttggagctcaggatgaagaataagtgaaattggcagcaaactttttagagtgaaagacaacatatggcagggaatttggcatcctttaggggataattcattggcaccacatttacatactctatcgttaccaacagacatatttttcataattatatttctctttaccattttatagagcattttccaaatggcactaatacttattctcactttagcatgactaaaaaggcatttccttcctcatgagagcatggtttaattgaaatagactttgatttccttttgagttttcatatataaaaagtggaattaagaatttaacaatgtggaatagttcaacatacattgtaagtccatattaattcttataaggctttttatttgtttgcctatgtactctacaaaaccaggccttattaatagaaatattttctgataaaaaacatttttaaattttaagttaataattaataaaaatgggcataattagtaaggattgggaaagtgtatgaatcctttgttctttctgagcaaggctatactgttttatgtctgtacagttacagtatcatgtctcattgggattttagtgtcatttagccatttaatgttctccattacatctgcatcaagtggtggttgccttttagctcttgagcctcctgggaagagaaaactcccttgtacttatgaagccattcttctaactctcaatttttacaagtttttcattatgaagtatctgttatgtgcccacattatactatgacattatttcattcttaccactaccctgtgaattagacatgataatttctctcttacatttgaacaaacaataactgtaaagggtaattagcttgtataactagaaaatgctagaggtagcactgggaacttgttctgttcatttcaccccatccccaactctgaacccaaacaggtttctacttgtcttttcctgtattctacttattcttttatatcgttactttaaaaatcttctctaacatagtgagacattcctcaatcttcaaaaatttctggaactattaataatccttaatatctaaaacaaaatataaactctcaaagagggcaaaaacccatgttatttgatgacaagtgactaaaataaatcctggatcataatagatacttaatttaccaatgttgaaaaattaaaaaaaatattgatgaaggaaggaaggaagaaagaaaagaaggaaggaagggaggacacaacaatatcttttaacaataggtctttctttagtatttgattcattaaattgaatacacttttcaaaggagtgcatttaaataactacttctatcacccagagagtgatgaaaaaaaatgattactttttagcttgaatagaatcataatctaacttcttcaacatgtgtaattaagaaaaaaatgagctaagagtcactatcacacaaatattaggttctaatttaagcttactaataaactcactctattattttgtcagtcatgagttgatttttttgtttcagtgttatgaattatgaaagctactccttatattttcctgtttcctataaatgcatttactggatgataagcaacattaaactataaatgttgtggcaaatttcctttagatataaaactgaaacaattaaatatagattatggtagactgacaaatctatgaaacaatctctaagacaaaaaatgtagaaaaatgcactaaaatgacttttaaaaattgcaggtattatatattaaacatcttactcaaaccgactctgtaacattctaatatggattacaactgccttattcttagggtgagagttctaaatttgatatatctccctggtcaaataagcatgtaagaagctgccaaatctgactatataaatcccagtcatctcatatattgtaaatataatagagtagtagccctagaattagattttgaactccttggtggcatatttataagctcttagtctggcacccggtaacatctgagaggaaatagaaactccttacaataaagttgatatgttgtatttaacacacacacacacacacacacacacacacacacacacacagagcgattgtgtttccaaaagaagctatttattctactgctattattgtctttgtttcctgagatttctaaaacaatccacctgcagagatcagaaagcacatctatacatgcacacatgcacacacacacacacaactagagtgatgcagagcttataatttaatgaacaaaataatattttcaaaagcaggcatatcagtatctagattaataatcaatgatctgagttcaagttctgaaacaaccttactcctctgagaactcctacaaatcagacaattcacacataattcatttcttcgcttgtaacaaaattaaacagtactactttactatttttagatactaaagatcaaatgagattacataagaatatattaagtggcaaagaactgtgcaaatctaaattactcctctggttgtttgagattttaccaatcaatttgggtgtatagaaaaaaattcttgaaaataattctttttttgctcaaagataaatctgtttattattgttattcgattgtgtgctttgaaacactaggtcaaatacaatgtatcattttcaaatcatttgaagaaaacttttcttaaagctttttattcagtcattgtattttcatttagccacaaacaattttaatgtttttgagcctgatggtcttaaacaggagaaggtgagagagtctctgatcttcaaagtagcagaaagcggggggcacaggctctgctcacaacaaggtactaacatgtgttatcaattttagctgaagttcaaaaggatagaacttgttcttagcaaatgtttgatatttctgccatcacaccattagtcaaataatgttcagactccaagaacaccttccattggccacttttcacctagcgaaatagaaggaattatattggatgagattaatgtattttgtcttgcattattttcaggaaattttaaaaaattaccatgtaacttaagtgtaactttgcattattgaggaatgtcatgggcagaacgttaagatgattttcataattaaaacttatctgtagtggcatgagtatccactttcactaaaagcttagccattggcttccagttgcctgtttccctgcatgtacggtaaggacacatttctggaataagaggtcatcatttagtaacaatgccaaattctagttattttctgtttgtttctctctaaaaatattctaaatttgtcttaagtgtactacacttcatgtcatcttaaaagacaatacatacgttgtacttactatactagtaatttacagagatagtttgttaggataacaaattttggaaactctaatgacccaagttttatcatggattcatggctgcaaattgttaaaatgagttcagaacatgtctgtctaagtaaccacatcaacaaaattaaaaaatcactgctcgatatattagaaaaatataagacagggaatgttatttttacatatttaaacagcttttgttacttcttcatcactgtccacttatgtcccttggatgaataggccattttgacttatagaaaagtgtggtattgtgtatttttctcatttatatgtataggatggttttctgatatttttgaaaaattaagatcaacttacaaaatttgttagagcacgatttgtgtgtgcccaaagacaccatttctagagcactggtttacatatacagtaaatctcctagagaaagaagaaatatgatgaagcactagtttagtagctgtctgaataactgtggtcttacacaacctttgcagaaagggaaaaaaagtatcacctctaaatgccgaggctagtaatatcttgataccaaactatacagctattatcagaaagtataataacattattgtaatgcataaacaaaaatttaataacactagaataattgtgaagccatatctgaaagtgtatcaaaaaagatactacaccatttcccaagtgtagtttattccaagtatgaaaagttggttttgtatttaacaattctaaaaactcataacattaataggtaataagaaagttctatcttaataaatgcaaaaaataaactattttaattttaattttttattagcacatcatacatagaaaatatgtattcctgataaaggtatgtaaacagcccccaaacaaacacaaacaaacccacaaatgtcacatttaatagtaaaactttaaaagcatttcttttcgagagaaaacaaaaagcctgttgttattattatttcaattcaatattgtacaggaaatcttaaacctttttttttgacttttacaaataaatcagctcctttatttgcattattttgagcactctgataatgacagtcttcactgatatttttgaaatcctgttttttgttaaataagcttttccaattaggcaagcaaataaataaaagaaagcttggaaaggagaaaaaaacaaaactttttatgaaatcaaacaacatattaagagtattatatacattcattccacttactgtatgccttacattattgtgcttactgcatgactcagctctaactagcataatggacagtaaattagttgttatctttgaagatgttaaatttcgtttcaagttaagcataaataaatataaatatttttcaagcagctgaaagtaaagcattctatgtgttaggattgatagagtagggttggttaaggaagtcttggagaaagtgtttctcatcctgattttgaagaaagaaattatctctagccagtctgaaattatagacctaatttgatcaattgtaactggcacagtggtaggtgttggatttagaactacagacaaatgggcttggtctttgctctcattaactcatagacgtaataggggtcatttccacacaataatgtcttgattaaaatggaatttggaagacgttgccctgtaattttataatgatttaataagaaacccacaaaaaaaaataccctaactcagctcaatatttcatttcaatatttcagttcaatattcattacaatatttttatcagttaggtatgatatgtgaaaatctatgatacattttttattctcatcaaagatgattcaaatcttctttcctggaaataggcaaattttgtcaatttttttcaactttccatctcccgttttttttttttttccttccatcctgacactgattatatagattgctagcggctaaggtcaaaggttttgattttataatataccctcattagagtgtgtttaatccttttgaaaataagacatagagtgttagacccaatgactgttgttaatagggagttaatagcatttccatttgaaattattaaatgtaaatatttaataatgtttcaatatctgataaacagtttgtttgaatgaaaatattttaatctgaaaaacaaagtttgttagaaaatttcaaagaaaatatctttatgactgactatatatgtatatatatatgcgtatgtatgtgtatatatttcacattattctactctataagaaatgtgattgagaaggttgtgttaaaatagctggtgctgaatctggaattcttagacattttgaatcatatttcttctgtcatcaagcggcgattcaatgactagtaatagctccgagccactggggatagttgggaaaaggaactgattataacagactgatttgcttccctttactttacaattgtgaaagatcatcattttatctaaactcataaatcaacttgagaacaaaagcaaaactccactgcaaattttgttttgctcatttttgatggtttcatttcagcaagtcatagaacagtactttcattgagtttagtatgtatacccagatgtgttttggggtttctgagagccgcaaatgatacaagctttgtctggaggaagacgatcatgtcatttgtaaatcaaaatacacctggaagagcatgcaaacttgagtacaaatacatggcataatgcgcagatgagctggcattttataaataatttcccaccacatttaatgcatgttggaactagttctcgccactacagaagtctctttttctttaaccctatttaccataatcaaaatcacaagggaaaccctaagtcaagatactgtttcccaaggtagaatatttgtaattctgtttactctttgtatatttgatttgcagaatctttgaacgtaatgcaaagcacattttcagacttgcccatcttaactgatgtgtttacaaatacctgaattctagagttaaatgcacgctgatgtgatttctgaatggtcatggggctttgacttaattgactggtttgatttttcagctacttttatttcccttcccaaacatcccactagacatgctaatgagaaatggtcataaggctgggagccagaaggaaaggagtgataagtaaaggtctgagtagtataaaaatgcagtaactggccaatgatattgagagttggtggtgtgaggcaaaatatctgtgactgcatttgaagtgtgcattgaattttggtaacatatcattcctcccagcactgtatgaaggaggaaagacagaaactgatggtgatttatagaaagtacacatatgcaggattttattcattcattcatttattcattcatttcatttcaggccaggcatctagaatcaaacagtctctagggaactgatactaattcaggagagatctaagtttccaaggaaatggtgaatcttccctttctttttgaatattgtttaatcaaagtttagttggaattttgataaagcaaattctgggggctcaaggttttgactgaagcaatttttcagatattactacattaactagatagatgttacatggtgccttaaagacataaatcagtgtcttaacggaaaatagatcaatgtatcaagtggttgtaacatgtataaaagttatctcaaaaactatagaatttaaatagatttttccttaataaataagacataattcctggaatatattcaaattactgaatgtaaaagtataaccttcatgatgctaactcataatttacattttgtacaaatcaaagagttttttacacatgaaaggaaaaaatcaagaaaaggaagttattttctagcatcagaatggcaaactaacctcatgataaataagacacataggaggaaaagttgtgttatacagttatgtgtacattaatgtttgtttaacatctgttatttgcttatgagttttcagcagtactcggttaatactcaactcacgtcttctggacttggaaaaggagtgattttccttcctgtaaaatgctggacttataactaaaatagtataagaataataaagtaagggaattacagtgtggtaatatgtataggttttgaaattagagacagtcgtgtttaaaattttcttgactgctatctaattgtattacctcaacaagttgcttaaacccacaatgttttctgggtaggaatcagtaaaatgggaataatgcatattgctaaagcataagtaagctgtgaggattaagtgatataacaaatgtcaagtacctaatgcaatgttacataattctaatcatgaaaaaaaaattaccagtatttcttttatatcaaagcatcctttttttggtatttttctttttaaaatgttagttttacataatcttcttaattgttaccataatgtatatagaattatattttcagctttgtataatattacgctgtaacaattgtctaaagtgcttaagtcttaaggtcatcattttaatttaaaatcatccatagctttaacatgcaataactgactaaatcattatctgtagtggaacatttgttatattcatagctctgtgtatccactatacttagcacctttgtgtctgatgctttttcatatgttacatttttccctcattatcagtttccgaaagtgacagcatagtgtgtacaggttgcaacttttagctttataacttgttagatgtatgatgaccagcaagttaattagcctctgtgtctcagttttctcatgtgtaaaatggaaataataatacttaatatgttaatatataaattaattacaccagcatcatgctcacaataagtactatttaaatacattaaaatgctgggttaaaggtttcatggtattttaggctacatatttgcaaactggttattacaagttactgccaatagcaattttaatttcagttttattttccatttaaacatagcattcatttcataatttttaagtgttaaacaaattttgtaaataattataactattattctgaattgttttgtagaactcgtgtagaatccataaaggcagaaattttgatctacttgctccccactaagcggcacaaaagagaacacctagcacagtgccctacacgtatatatgtgtgtgtgcacatatagcacatataaatacccatagaaagaataaataaatgttaaattcctaacattatcttgggcttggaggcagaaatatttggtgttgaagataagtgagaatttaattaaagagaggaaaggggcatattttttgtttacttgaaaggcctgtcaaaccaatttagatgctattggtcatgggcctttgttctggaaaccaatcttctccaatttttgtggtttttaaagttttattttctaatgaaacctagggctttttaaaatttttaaaaattagaagacaggcaaagttcttacatctctataatcctcaggtaaatccaactatattatatatgttcattgtataatacttgaactgtactgattattatttattatttactgtatatctaggtaagccagttatgattgtcacagaatacatggagaatggttccttggatagtttcctacgtgtaagtaagatgcacacacatacatatatatgaataaattgctgaaaacattagagacaccctccaatattgtgccaagcaattcagtaatctaagtttaaagtaaaactgaaatcttctgaggctaaatagacagagaagggctgtaaaattgcatctttttttgcagcattcaaatgttaatggtttatatttttaaaacaaatttgtgagttcttcttcaaaagactctttttatactgccaagattcacactcgttaaataaaaataaaaaagaatcctaaagcaagtaataaaacccactgatgtaagacagaaagtctcttttttaagtaatctcagtctgatataattatttaatcacagtctgatataagacagcccatctactttccaaacagtgctgtcagaaaataagcatgtgctataatgctaaagtatatatagttttaatttagatatatcattttgctgttagatatgtacattaattttttagattgagaagctttatacgtttatctatcatctatctatctatctatctatctatctatctatctatctatctatattttttgagatggagttttactcttgttgcccaggcaatggtgcaatggtgcaatggtgcaatggtgcaatggtgcaatggtgcaatcttggctcactgcaatccccgcctgctgggttcaagtgattttcctgcctcagccttccaaatagcagggattacaggcgcccaccatcatgcctggctagtttttgtatttttagtagaggtggtgtttcaccatgttggccaggctggtttagaacccctgacctcagatgatccgccctcctcagcctcccaaattgctaggattacaggcatgagccaccgcacctggccatattttgacatactatatttcaccataagaaagtgaatatattaaatttacatctatttcaacaaatgttatgttcaacaatttcatgaagttcaagacaataccaattaccagtcattgcaggcgataagaaaagacataggccctgtcctcaaggtgcttttgttgctatataaattgagatgggcagatgacagaaagatagatagataaatagataaagaaaatatgtagtatcattcataatcatggaggaaaattttaaattttctaagactgagaaaggatatgctttatattaaaatccattagccaaataaaaattttaatagcaattattttcataatcgttatttcaaaaataaacatttccaaaatcaggtgagttaaaatattatgataaatattctttcaaaattatcgtttgtaattaaacatggaattttatataaatacattatctatacattttaaaccttatgtttctattttaatccaagattaaattagattggaagctggattatgtgatttagtttcttattgctttctattttgtgactacaattcagaagtgggtagaaaaacaaatatccaataaatatttttgactaattatgaactaattatttatgataatgtttaaaaatgtagcatccaccttatttgaaacaattcataaaatatcaggaaacaaagaaggggaaatgaaaattcaatcaaacaaataaatatcaacctaaactagccacaagattcatttcacttttttgttcttaaccttaatgagtctgagcaggagttagtttttttgtcacataaggaccaggaaagtccttgcttttaaactgaagtcaaagaacgttaagatacttcctgttacaaagtatttgataacatagccagtgtgttattttgtttcagccttgtatccatttgccacatatctttgtcttgagtgcttaggactaaagtgtgtatagtcagtcttgttacaaaattcaatatgtgagattttaaccaataaagatatatctttaagaaataggaacgtatcttaattgtacatttgaaatgcttcccagaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagagtgagtaacttagattttctccttttttatcattgttttccatcttgtatcatgttgatttgtaaataagtagaaatcatgacccaaaacgtgttgtcaattatgctttccacaatagaaaacatatcttaaaattaaaatattattatttattctgggtaaatagatggtcactgtttaacatttaatgattttaactctgaaattctatacctcagtttaatgttccccaccaaaagcagcaagattctcacattcctcaaatcttgatatttttaaatgtacccatcttttcaccatggttgagtcaccctgagctagcagattggataaattctaaggaccttatcccagtacatatcattttaaagcactttcaaatcaattttttaataagtaatacctatttatactgtaaaaatgtcaaaacagacctataaagaaaagttgtccataattgtgccatccacagacaacatttataagattgtgagtcaattcttacaaatttttcttcatactcatatgtacaaacttgttcatgaatatattatttaaatacaattattcataatacaattgtatgccatttctctccttaccaatacacttcttgaatatatttcattgtcaataaataatctttaaatttttacatgtagtaggttgctgtattctatattgttgtatcttttttaaagcaaaccctaattagtgagcaaattattattatatttaatttttccatattttataccaatgtatgtgatctgcctgcattcataattgttatgagcctcatgattttctaatgatacattcctaaaaatgaatgttttgtgtcaaagattacgtgaatattttaaaagcacactttactacactcttgataaaactaggtattttcattaattttactattatcagttaggataaattgaatgtatatgttttaatttgcatccatttaattcaaaatgcatttgaattttttgtgagcttttctgttgttgttttgttttgtgtttgttttttgttttttaggcagggtctcactctgtcacccaggctggagtgcagtggcacaattacgactcattgtagcagcctcaaactcctggcctcaagtgattctcccgggctcaagtgatcctccctcctcagcctgctgagtagctgggattacaggcatggaccaccagccccagctaatttttaagtttttctttaaagaaaattatttccatggtagaaatttagaaaatatagataaaaaacaagtaaatgtctaataatcattactattaatactacacaaacataattattagcattttaaatttagcctttcgatttttttaaataaattttcacaaataaataactcctcttttggcataaagttacaaaaatgggattatactttatatactgatatataaaatgatttcaacataccgataatttaggcactttacttatatataaatcaatgccattttgttttctgccctgttttaacttaaaaatataaaatacataagtttccagatgattaaatatttttacaatattcaataatgtctaatactctattcatatacataatttaattaaataaagcactattaattgggcagaattacaatattttcatattatgagtgatactttgatgtcatgatatctattttgtgtctgtccatgattacctccttgggatatttctatagaattaacattacaggatcaaaacgtatacaagtatgtgagaatttttggcgtatatattgcccaattgtctttgctgtagtttgttatcaattttctctcctaatggcagtatctttctccatattctcatcagctaagagaataggtggttccaaagatggtagtcttctgctgtttcttattatctaattttaaaagtttattcccgattaaaaaaaaaagctcatcctatttgcaaatcactcgagaactccaataatcaaaattgtcacatggcatgcatatcatgctataataaagaacctaatatgccagatagcatttcatccacaagtaaagccgcaataatagaaccactgaataataatgacacaatgctgttgggatatttctagatgcattgatataggaggtaggactctcccaatggcttttaataataaacccttttgtttttccaattttcaaatatactctgtagtgcatttactttgttcatgaatctaaatttttttttaatctgagtattttttaaaaagtccttagacacttaaaatgtgtcctacataaaaatgttgttcttaacaaacacaattcaaatggataagagcatgacaaattaagacaaatttcttatcttgtagctagttgaattaaatttacaagtgactacaattatatagctctgaacatgatgaaattgccaaacatgggatcaatacctcaacagtgctttttagttctccttctctgatcaccagaaaaattagtcagccaatgtatctgcaacaaagcatcattttaataactgagctaccaattcagtagacactatatgcagcaagtgatacttaacagtcttagggaatgtatttcattctactcacttctactctttttctaaggctatccctcttaacctgtcatgacataagtacttctaagagtccatgaaaagtatcatgcttacttatattgtccgtgttacaacaatcatattatgccagaaaaatacttttaggttaaataaaaactatttgataaaaaaattatttgaaatgttaaatttctggttattcagtcaggttctaatttctatgccatattaaattatttatttatttatttatttattaatttttgagacagagcctcacgttgtctcccatgctggagtgcagtggcgcagtgtcggttcactgcaacctctgcctcccagattcaagcaactctcatgcctcagcctcacaagtagtttggataacagtggcttgccaccacgcctggctaatttttgtatttttagtacagacggggttactccatgttggccagtctagtctcaaactgctgatctcaggtgatccacctgcctcagcctctgaaagtgctgggattacaggcgtgagccactgttaccagccccatattaaattattatgtgagagcatctctgtccccataagtaggcttgattgccaggatactcaaaagaatagtttctctggcaggaattggaaacatttgtccaactttagatgattcatactctggagaacacagggggttaactctaaatgtttcctttacactgattgttgttttgtcagggcctctttagtgttagaagaaaagtgtcgtatggaaattgctctttaacatttctgaaataaaagtgaaacaggctctttgcatttctgttccagtcactgaagattcttaaaaacacactgaacaaataggctcattcaccaccaataaatagctgtttcgagttcttcagggttcatctttgtatttccttggaactccctcaaaatatccatgggagtcctggctttcttccgagaagctgtaatttgcatgtgcgtttctagagtaatttaaacatcattgatttaatctctcataataggccttattgagtacaataagtttatagtttactctaaatatgaggtatggttatgaagtaataagaagacttcaattttttaaaaaaacaaatataccaaacagctaaatgaggcagcattctaagttttccttttggaaataaatatatacttactccaggaatgctgatattgcacaaaatgttttgggaatttctcttttggaattatatttaaagctaaattataactgatgcattaatcaaacatttttaagcaggtagtattttgggatataggcttgactaagataaaatctggtctcgataagcagagtggggtggctcacgcctataatcttgacacttcgagaggccaaggcaggaggacctcttaagctcaggagtttgagaccagcctgggcaacatagcaagacttcatctctgttaaaaaatatatatatatataaatatatatttatatatataaataatatataatatatatacacttttatatataaatgctatatctatataaatactatatctatataaagtatatatatactatatagtatatataattttatatataaatacatctatatatatataaataaattatatatgttatatataaatactatatatatgtgtgtatatgtattaaaataatataggacaggtgcggtggctcatgcctgtaatcccagcactttgagaggctaaagcaggcagatcacctgaggtcagaagctcaagaccagcctggccaacatggtgaaaccccgtgtctactaaaaatacaaaaattagctgggtgtggtggtgtgcgcctgtaatcccagctacttgggaggctgaggcataagaactgcttgaacctgggaggcagaggttgcagcgaacggagattgtgccattgcactctagcctgggggacagagtgagaatccatctcaataataataataataattaattaataaaaataaaaacatatattaggcatggagacgctcacctgtggtcccaactactcaggaggctgaggtggaaagatcacttgagtccaggaggttgaagctgcagtgagctaaagcctggggatggagcaggaccctttttcaaaaaataaataaataataataaatttaaaaggaagaagaaaagaaaaagaaaaaatactattacatttttgtgtatatattgtctgtttgtcaacccaaagcaatatacccagcttagacatctgtcttgtttatttgatttagtgtgctctgattattgttatttcagaaaaacaagttcatcattcaaaacaatttgctgaggcattccttttggataagagatcctggttaatctgcattaaaaagtcagtcacattaataaagtttaacgcagttcatctagtgtctgaagtttctacaatttggagattaacatttggtgcctcaatgcaatgaccctttcctggttgctcctctgaaagttactgcctgtaggtagagcgtagttgcactgaagagtcatgaaggacatttgaatcaatgtcagtggaaaagaatactgaacatagaatgtctgtcgctcttgttttaaaacatctctgtgagtgacaggcagaatagaggaatgtatagaaattatataatctaattatgtatttaaaacttcttaaactttgaagagtatttgaggagttgaggaaacacctaagctcaaaacttaatttatcagacagtcaaagatattttctcacactgtgttctatactgtcttaggtgtatcacaagctttccttccttatgttctcgacagcatgccggatatgaaagggtcagctaagatagtactatacatttttatgtttattttctcttttacataaggatattgtgtaaggaatcagatttttttccccaatactcacttgttgttatttcttctcatttcttactgctgtgttacgcagaaattgcaaatgttgatattttccattatacaatgttattatgcatcctgtaaaactccactgtactctcatgggatgttcagaatgaataaggctatgaagtttcagtattattatgaaaatagtttctatcttgtggacccctaaaatgctcttggggacccacatacatgctcggatgacagattgaaagccactgttatagatactttactaggaaaaaagtcccttaataactaaatgaatatttttgccgttattcactgatataaatctaaattatggcatagttttatgtgatataatatattttaaagaagtagctttgaaagcagaactgcagctgcataccaaagtttgcaaatcatcttgaaagtccctggatttcgtttgggatggatatgattagaccatttagctccacaaatttaaatcatcaaagaagttttgtgtctgaaaaaaaaaacagaaaaattaattcctttcctctggtttctcatcatgtgactttgaaagtataattataacatgtttgttatatttttgccctggtctactaatttacttcattctaacagaatcatgacactattgtagaacagtttgccactgaatgatttttcaatttttgcttctatgaaattttatctttaactggttagtatttttgtatatatgcattcatgcatctatatagatgaatatttctatattcatatgttgaaatacatggaatccaaaattccaaaatggtagtgtttaattttctgttttatacaggatcaagttactgaaagcacagacttttatcttatttagatgctgggtaagccatcacttcaattcttcctatgtccttaagttcattttgggagcataattaccacataaactgagttggaaagtttgagaaaacaaattgaattgtccttggctatattctccattattcgatttttttcttttcatttctattctgaagttgcctacttagtaagtactaactagattttgttacaacattttattttacataataatttatttggctttttagatctgtgactctgccatattgatgccagatatattctatacaactttgttttgtttgatttcatttttgtttttttgttttgttttgttttgttttttttgagatggagtctcactctgtcgcccaggctggagtgcagtggtgggatctcggctcactgcaagctctgcctcccgggttcacgccattctcctgcctcagcctccggagtagctgggaccacaggggcccatcactacacccggctaatttttttttgtatttttagtagagacggggtttcaccatgttagccaggatggtctcgatctcctgacctcgtgatccgccagcctcggcctcccaaagtgctgggattacaggtgtgagccaccgtgcctggcctgtttgatttcattttaaggataaggcaaaaaaagaaaagtggctaagcaagtggttaaaagctaagaggttaaatatttcctttcaggtaactccaatctaagaacataaataacagaaaacaggagcctttgttctgtaacattttcaagaaccaaaaaaaccatgcttatcaaaattggtataatacaaaagacacatattaatttgataagtaatatatgtcgcatgtcatttatacctaaatgaaaaaggtaataacaaaatatctaatttgtgtccttcatatagtaacagtattttaaactgtgaaccaaaaaaagtcaactacgaatttattgcctccccttatgatcaatatgaatatgcctgcatgtagcatcagaaaatacagccacttattcaataactagaaaactctcaaaggttcagtgattttaataattaatgttgaatcgacacttaatgaaaagtctagtactttctacccatctatttcagagagatgagtagcatgaacatttaaacatgtaaaaaacaactatccaggtttatgtggtgaaaaattacaactataattgtgaagtggaacacaggagcacacaagtaaaggcagaaaagtaaaatgaggaatgcaggcagtctgtagagaatgcaattttatataggatcgtcagagaaattggtaaaatgacactagagcagaaaatgggtttgaatgaaggagcaaatactgaggctaaagaaacattaattttgctttcactaattttcaattgaatagaataattttaataattgcactgattccaagaggcccaccttgcaggaagacaatgtaagtcattagattaattatttagctcagactaaatgtcaagctaatagtaactagtcctctttttctattggtgatgcatgcctttagtcccagctactcaggaggctgacgtgggagggtcgcttgagcccaggaggtcagggctgcagtgagccttgattatgccattgcactttaggctggggcaacagagtgagattttatctcaaaacaattattagaatgaatttagtattatttctatcatttcaattgcaaattgtcagtatcccctgctacgtttctactaatttaccatcgcttcttcaaaaaattgtgttcagagtgctacaatttcagactttgaaatgaatcactataacttttaaaaattagagattttaaaaactggagattgaatatatataaaaaatacaaaatttgacatttaaaacctcattgaacttttaaaaaagccagactcatattaaggcacacacacacacacacacacacacacacacatatatatatgtatgtatgtatatagacttactccccgatgtttgcattatttttgtagaagatagatatcatacatcagattacttagtttttacactgtttcatgagagtccgaaagtaacataagcattatgagtttgttttttatttcctggttagccattataataatttggaatatggagattttcctgtatttcaagtaatgcttaatcatttcacatgatgttgaaagatctcaaaagttcgaagaatgaggttttgctacctaaaggatcatttatctctgatctcttgtggcaatcaacatttgctgaaactattctctcagtggcgctgagatttgaactgctggggataagactagatgcttcctttgggagccttcttggatcacccttcaccttgttgtctgcagtgaatgaattttagtccttgacaatacatagatgctaaatcttttagccaaataatttatctctatagttccacttttaacctgagaagctaatatttccctccaggttaaatactcaattacttgggtttactcagataaactctccaaagtcctttgtcactctaaatatgacctgacaaagctcaaaaacaggaaatgtgaattataaccagcaaacctttcctaaattggcaggcagagatttgtacatataattacagaaacatttggcagctatgtgatattatgcctcaatacccagaaatttcagcaattacactccttctctttagaaatcagaacttgaagccccgtaacccataccgcatgagctgacttcagttaagctcctgaaaaattcaggcttttagccacatgtctcattgaactgtctaaattcatcgagcttagggaactgaattgcagaatctttcaagaacagggttaccgtgtgattcctcatctaactgctgtatctaggcaaagtggacaaggttttagactctcaactaatcctggagtggagtttagcagttatgtagtgcctttttccagagaatcactagcatctttacctgtagcactttattcatctcctttaccttttctgtaaaactctatagacgtaaatcgaggtgacacccatgtggatatgcaatttattccaaagttagtctttctttaagagtccaaaataattaacattgaaaatgtcagcatccttgatactcatgtaggtttaagatagaaagttcaaagagctatggtcataagtcagcaaagctgttaagctgttagataaaactgaatgtaaagtcaaattttatatagtccatgaccctgtttttgaatgacaagacagctgtgcagagaggttaagacacctggctaaaattaaacaggaaggtcaaaactgaggccagaaaccaagactcctgattcttattaaacttcagaatccaaatggagcaaatgactaaacttaccctgtacctccagttatttagctatacatagatgagaagtcagcacttggaggaactggctgaaggtttggcactggagatgtaaggagcaaacattagcttctgattctgttaagtttgaattggaagtctttctgaaattgaggttttagatacactccatatgctatgattctgggcttgctccaagcaactggaagcttttctgaaatacataaatatatcttgggagcttacattaggatatagagaccagtaaaagtaaatgcttcattttaaatgtttaaatatggttaaaaaacacatcttcataaataattgttatagtgactagctgagcttttataatattctaaatgcctagtgtggcacatccctctaaagcatctacattttaaaaatgtccttcacatatataagctaggaaagcaatttctaaaccagaaaaaaataacactcatgcaatatgagcttgaatttgttaaggtgggaggtgagaagggaagaggaatttttgtggtcacaatcaagaacagaaatatgcatacgctctgtgatgaattacttgtaggaaacttagactcctatatattcaatttattttagtttgatagtctcagaactacagatcctcagcttaaatgcagcaagtcttattgtaaagtgtgactcagttaaaatttattgccccagcttcttcttttaaccatatttcagaaccaaattgggccctcaaggactcttattcgtgtctctctatgccaataatgtttacgtttttgtagctgtagacagtgtttgctgttggagcaagcacttgtatcttactaaaatgcttggttacttatacctccatttaataaaaaaattgatgcttaatttataaagttaatttaagttttactagcaaacttaaattaacaggaagttatcctaaaaaagaaaaagaaaaggaaggaagataggaaaaaagaagaaaggagaaaataaaataaaacataaaaaaattccagaagggatattattacatcatcaaaacccaagtattaggagattggctctggtgaacttgacccctgtttttctattagtaaaggtatagcctgtgacaggggtataaaatatccctagaaagttgatttcacttagtcaatataaaatcccacataatttgtagacctcatgtggattactttcccttgatgattgtacaacatttaaagcagtagttcgcaaatggggatgattttgttccccagaagatacttggtattgtctagaggcatttttggctgtcacaactggggagatgctaatgtaatctagatgacagcggcagaagtgctgctagatatcctacaacgcacaggacagccgtcacagcaaagaatgatctcgggtgaaaggtcaacagtgcccttctagagaaaccttgcctacaaggttcccatcatgtgcaaagaatgggagtggggatcaaatgtttctctcaggtactttctattttttcctgtccatattggactgcaagatgcatgggacaatatagactacaccatttgtgaaaaaatgtgcaacagactagccatctgttatcaggcctcctagaatgtgaaacttcaagctatcacaaacataatgcaacaaatcataagtcttgtgtgcctgttaaaatttcattttcatttggtttcaattaaacacttaaattacttaccaccctccaccccaggctctaaatttcaaacatagccactttagttgtgatgttctattttcattttattaagacatcatggagtaaaatcatacatagatgtatatctctagaagataaatatatcagatattttagtcagtatataagtcttacccttgtgtaatttttttaatgttttaacattttacttagcctcattctacaaaggggtaacgtccatgtgtgtagactaaaattattttttaattaattgtatttttaggttggtgaagtagctacaacattaatattgaagcagttgatgtagaatgtgtattgtttatggagtcaaatgaaaatctttatagcattctacgaactctaaaacacataatccatacaacatcctgtgacatatttttgtaattctacagatactctaaaaaagttgatgctcagtgaatcttatactaactatcgttgtggagttcttaaaatgtattaatgtaacaacactattaaatagtagcataagaaaaaagaggacattagaaagcagtatgatttaagaaaataaactattatgtttatattggctcattcacattcacatatattatgaaaaactagatttaactcattatcaactgaaaatgaactgcacctttaaaatgcacaaaattatcagaaatctttagaaaaatctactttcccaggtccacaaaataaatcattattctcacttgacagaacaacgtgcttttttgcaagcaacaaagttttgtaaacagcagaggtagaaaataagacatactttaaactgggggaatacagtggtgaagggggccaggtggttattcctctggacatcccagattaggcaggataataaagcagtagaaagatcacagaggatggaatgaccaactcttgctggaagactcctaaatgttcacccaaagagtttacatttgaccaagatgttcagataagaactttacccagttacagaaaaaaggaaaaaaagcctcccaaaaagaaagaccatgtatttgggaagatagcatgctcacagggggaattcaattaagatcagtgagcatctgttgaatgcctgcactgcacatttgccaagataataccaagataatactacagagagcaagaaaactgctctctgtagtgaatgtgtattgtttatggagaacatagtttcatgtgagttaatactccttatcttcagctttataatctattcagtttttcataagcttatgatttgaaataatggttcgggtttactatttttatttgttgcaattgatatgacaggcactactgctactacttttactagtgtagaacataaagagtttgaaactacaatgaagaatttaaagagtttatgagaatgtatgtatctatcttttcttaaattccataataattttgctcgtttgaaatttcacctgtagtttgatttttttttttacttcaaattaaatgtgtacaatgttggtttattattcttttatttttaaagccagagcaatttgatattatttgcttgccatagaataagataatttttaaaaatttctttttatctgatttagtattaattgctaaatttgaattgtactttgtagttaacagtgagctttcccttgtagcatcttttaataaatttgttatattgacagtaaatgtaacaattaaagggaattgaaaggaaggaacaggcataacatttattgaatgctctattaaggagcagacactttttaaatggctttatatatattataaattcatgacaaatgacaaaattttctaaataataatatataattctcaatcatctttattctcttcctgtttccctcaatgatggatggcatcatttacaatatggttagatagaaaagagataagagtcttgaatctgtgattatttcattattggagctaaactaatccgtctaataagctacctattagcagataatggaaattctctaatgaaaaggctaaatgtttcatgaatattgaatacattctgggctaaacagctaactcttggccaggtgcgatggctcacacctgtgtaacaccagcactttggtaggtggaggtgggaaaatgacttgaggccaagagttagagactagcctgaccaacatggcaaaaccttgtctctatcaaaaatccaaatattagccaggcttggtggcgcacacctctaatcccagctactaaggaggctgaggcacaagaattgcttgagcctgagagggggaggttgcagtgagccgagaacgcactgcaccaccgcattccagacctaactgtctatggacttcaacactaaaattgggcaaagcaaatcacttattcacatcttcttctaaagaaagagtttaaattagccccagctcttcttttagactgagttgtttggatatcatatataaaaatataaattaagagtttttcattaaaaataaaaataaatatgtttacttctaagtatataagctcaattaactgtgacctgggacagaatctggccagcgaggaaaagaactggtacaccaaaagttgatcaatagtagtatctggataaattacggaaacatttaaagcactgcaccctggtttcattgttgaactgattgaatgccacttaatttttgagtgtttgtaataacatgtccaaaataaaatgaaaataaatgagattgccccacttccttatgctttcccacaagggcagcaactgaacccttgatatagttaagagacaaaaaggaaaagtgtaaatcaaaaacctgaatgacacaagtgaaaagaccatacctacatttccaaagctagcaaaacttgtagcaagaggcctttgccatttcacaggtatctactgcacaatgtggccaagatacttttccaaggtaccacagtgagctaagagccagaatattttgttaaaaattagtacgaaggtaaagatagtataaaggtcacctgatcagcaagtatgttacattgaaaggtttaaagttgtcattctaacaataatatgtgtgtgtgtgtgtgcaggctacaacaattacaaaacacaaccagaagagcagaattgaaaatttaagtttttcttattaaaataaattactatacatttttccaaacatgcatcccatttgtttaaattttaagcattttaataagatttacacaggttacacaaatagaccacatgtaattgggaaatattctggaaataatttgcttgaatctgtaaccatgtatttcattagagaacatactgtataagtcccaggcaagttaagagattcaggtgagtgaagctttccttgaagatatgatcatgcgaccacagcagatacctctccaacattattatgtctgtatttacaacagagcaaaagaggattctccttccaagcttaagcagaaatatggctctgttcttcctaaaaatgatcacctttcagtatatcattattttaagaaattctattaatctcaatgctcttctctctggaaaatggtgaagaaacacttaaaatgaaacaactcttctgtgtttctttttaaccctgattgaattaaccaaataaatacacttctctttcatggctgtcatcaacctattgtttttttcttatgactctattttaatttcaactagagaccatggtaaggcaacaaatatctgggcctaatattttctaaataggtacaaagttttcagcatagaaagggcttttttttttcttttttcttttttttagtgccatttaagtacacttcacaatttcagtattactgaaagtatactgacatgatcctttcagtataagtatacttatataccttcagtaatactgaaagtatacttatacgctttcagtaatttggttctggaaaaagagaagtagcaaaggcagttagaaaaatgacaagtgtctataacagacctaagatatttaattgagatttttaagatactgtacctcccttgtcctatgaatacagctctgtttgacttttgttaattctctgagttcttaagaaggagaaagtaggcccaatgattccatttggcatcctgagtagattctgttcaatgccacatgtctaagtccacttttgtcgatgtcaaggggtagtatttgaaattttgaattataaaaacataaacttgatctaggcatatgtagatgagtgctttgggagttttagtgcacgttgcacactgtagtttatctccctaacttccgaggctatcttttctctggctccggtctctccaatttcatttgttttacttcatcagtagaaactgtcaactattcttcacctggtagcttcttaggaaggttgcgctcactgtgtgtctttgcaggcttattcttcctgctgatggtgtttttccatttcctcaattctctgcactgtttcttgcattcttcatgactgtgtaagctctaccttttcaaagagcttctggcagtactctccctgaacagctcatttgtgccaaaacaccaaggagaagtgctcagttttactgagttagttccaatcttatcactctcctagccaggataaagtttcccaagtgcatctgtgattaaataaaaatttgacattttagcttcctcttccattatatttcttcacacaggaaactgttcttctagaacatacagttttctcctctgtgctttgatttatgccatttgctcagaatatgagagtattgagctaacatttattgagtccttactatgtcctaggaagaagactaaatattttactgaaatttgtcgtttagtcccacataaatactctgaaccaggactattacattctcaataacagatgaggacagtcctgcacaacaaggcttagaaacttgtcccctaaattgctaatccatttgtgtaaagcactatattgcccccttgagcatcacttcaaatccagtggcatgctatgaggtccgatagaaatcggtcacattttgacgaacacggcttaagattttgaggatgtgagttctttctttgaaatatccatcccttttttcttatatcaaatattgtacttatctttcaagtgacttcacttgaaattgaggtcacttaattcataagtgccctcctcagtctctctagtgagaatcttggctccacgttccacattacggtggctttcactactgtctttctactcagggtaagttccatggaccagcatcacatggagattgttggaaatgcagacactggctacacactcaacctcctgaatcaaaattttcattttactgggagtaagctgtatatgatttatatgcattataaagtttgaaaagcaatgtgctagatacctatttcgttctgtatctagtttttcagagtaactcattattactcctgtttgcctgacacttacgaaacaaaagagccagtatgttatttatcagtttcacccaaattaactagcataatacttcctatatggttgacaatcagtacatctttattaaatgtatttattgaactaagagcaaattccatagacattacacttttatatctcccataacttataaaagcaatattattttcctctaaattataagttctgggaatgtaattattatgtctatctaatttatatggtgcttgcctactatccagaagacacttcaatgactaatgatgaagcacacagtaaattaatcaagatgattattgtgttgaagagagttttttaaaatataattttattttgagtttatttaggtaacaaacacctgtaagtacttatgtgccagggagtggtctaagttctttacaaatactgacttattcacattctgaacttcgattgcttggtcaagcataaatctaggttaaatcaataaaagttgatttgtgatacctcttttaattctaatacatgtcatgtcacatctgcttcaggttgttttgttgcagatgattaattaacctgccatagttgatataaaatgtcaatatttaagcaattttcttttttatatataatttcaaaatccttccaaattatttggaagtaaaatttgctgtaaatggtatgctacttctgcttggtattgaaatagaataacatcaaaatgtttcacagaaatgcatattccatttcagaacagaaatactatgagaaattctgtccggtttcagattatgttatgtatattatatgttctatgcattgctgatttatgtagacatgattttatattcaaagggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaagtatttgtggtctatgagttatgagttcagatgaaaagatcaagctgtgcaaggaagtggaacataatgtaactgggtggctcctggtttataacactgaaataaaatatttagcagcaatgaaactgtttccaagtcttgcaaggatattatattaattgaattgttcttacagatttacatatttccctcaagcaagggtttagaaataagacaaaagaaacatttgtagtgaaaacgtaatgaaaaaagtgaccaataagataacctctagattctaatgcacattgaagtttgaaagtcactgctttacaccattgaaaagtactaatgaactaatagttacttaattttacagcacttaggattttacaaaaaaaattactataatttggaaggcaccatttgaactgcagtataactaaaacctgtatagtaattttgtccatattcattcatatatgttttccatagagaactatataaccaaataataatttctttataacaccaaatttgctctatcatttaacatttctttttattttaacccaaaaaggatctttacatactctttcctaaatttatgttatttcaatcttcctttatataatattttaggcatacataacgtcttatttatttgatcagttgttatccttttaggcaactaaaaatgagaagttttcccacttacctttaaaataagcatatttgtgagccccgcccatgaaaacgtaaactaagtgacacttcctgaaaacttcctggttcctgaaaactttgcttctcacacaggtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggtgacacattcaatttgttatctggcattcactctgaaatttgtgtttgctatctccaagatgttaatttttttagcccacccccaaaatgcattatttgaagcttgtattccaccatattagagagatgtatttcccctttcttttttaatctttagaactaattctcgtcctccttaatagtaatgatgaaattctgagatattttttaacatctatcttgactctacattcaggcttgtttaagtctttgggaaataggaatactggaggggtgcggtggctcgtgcctgtaatccaagcactttggtggatcacttgaggtcaggagttcgagaccagcctggccaacatagtgaaatgccgtttctactaaaaatacaaaaattagcctggtgtggtggcaggcacctgtaatcctagctactcgggaggctgaggcaggagaatctgtgaacctgggaggcagaggttgcaacgagctgatatcatgccactgcactccagcctggtcaacagagcgagactctctctctaaataaataaatatactgaacacatacttcttttcacccttcatgaataaagaagtcctgattcatctttcattcaaaataaagaaaaagaaattatccaaaatattgcactggctagcaaaatgcaaattttccccagttaattaaacaaatatttgtctagtctatattgcgtatcaattactttgctagacaccattgaagataaaactaagagtaagataaagccagtgtccctggacaacaacacaaatgttaatactctgcagctgtaatgcaatcctggatgcacaaagtctatttaattttatgcatattcttttaggttaagaatcactgagttctctcagtggttagaacaatgtaaattaaagtgtatctacaaagtacagtggaaaaaagaaggaagaagagatgaattttgtcaggggccatataagaagaaaataaatattaatatatttggtgcctctcagagtaattaaaggcaaagatatcttgtttaataattttgattctcattgtaagcataagaaaaaaaggttcttttacattttgataatgcattctcttacaggcttttaatttttctctctgatttatcacatgagttagtacatgttttatacttttgaaacattcctcttgacaactatagagagaagcatttcagacctatttgggacctctagctatgtgcctactcaatggcttggacttgtgagttcaatagtatcttgattggtacaatggagttttatcagtaacgatgacttgtgggtcattctgccttctttgcataaccagttgcttctcaatatcgcttctcaactgtgttagttttgggtctcaataatagtatcccgccctgttgtttccattgctacaaagcttagtgactaaagctggcgttcaatgcatgggaaattccttgcattttgtcttaagttatctgtttgaagatcaagcagggcgtgtgtgtgtgtgtgtgtgtgtgtgtttgtgtgtgtgtgtgttggtgagtgaatatgtaggtacattacaagtttgattaaccatgccttagtatcatatttttgtgaaaaaaatcaatcatatttaaaacaatattttaagatgtctaaaatcaatgcccctgaaatccacagggaataaaatagcaaaattttaacatataaacgttttttatccattcttctgtcagtggatacctatgttgatttcatatcttggctattgtgaataatgctgcaatgaacatgggaatatagatatctctttgaaatactgacttcatttcctttggctatatacccagagtgggattgctggatcatatggtgattctatttttagttttttgtggaacctccatacatttttccatatggctgttccaatttacattcccttacatgccaatgttccctttctccacatcttcactaacagttgttatcttttgactttttgataatagccatcctaacaagtgtgaggttctagctcattgtggttttgattttcatttctctaatgactagcgatgttgagtacctttacataaacctgttggccatttgtcttcctcagaaaaaaatgtctattcaggtcctttgcccatttttaataggggtattattatttttgctatcaaattctatgagttccttatatattttggatattagccacctatgagatatattgactgtaaatattttctcttcttctgtggattgcctttcattttcttgttttctttactgtgcagaaaatttttaatttgatataatccctcctgtttaatttggcttttgttcctatgattttggtgtcatctctacaaaattgttaccaagaccagtgtcatagagctttcttcctgtatttcctgctagaagctttacagtattaggtcttcagtttatccattttgtgttgattatattaaatgcacattacctgttttttacataatagtttaataagttaagtaggagaatcataaacaagatcttaatatcagtatataagaatcatagattatttattgataataacacttagtaggaatcactatgattgaatttagtaataagtccttaaataaaactacccataacttattccataaggataaatatctatcccaaacttcacagagactgtatagactcttagaaattcacctgacagtttaacaactaacaggataacaaacctgtcctttcctgggccatatggtcctcattctgtaccctgaaggcatttattttgatctttacagcatagatagtaatcacagaaaaaaaaagactttacctatcataaaaacattcaaaccattttcaaagctaactcatgtaatgtaatgtaatgtaggggtatctaataccagtttcacagagaaaagtagtcttactatcagatcataatatgtgaggctatgtcctagcatccaaattttaacatactttcataattcacttttccactcttattgaaatatatcaaatactttttcttatatatttttctttaatacatgaactaatttgatgtattttgtcataaaacataattttagaaaaaaatcaatattttctatgaaaagacaaccatctcaatgtacagaatataaacatttgggcaattatatttatatttttacttattaccattaaaatgcacgatgggttagattttgtcataatacatttatttttaacaacctcacattactatatgcaactatgtcaagaagtttttttctctttagaaaatttgctttcctacttttgacaatgattatttcatccttttcataactgattaaaatgacctccttctttaatttttagtgatgtccttgccaaatgctttattgagaaaataagccattagatgggaacttcccacagcaaaacagaaatgtagtggcacctgcacctacccatatcgtccttctttcctctaattataaaaggcagtgtccctctatttgtcagaggctaatcctctactcttcctctctccctgtctccctctctctcttctgcatatccaggctctttttttctgtaggatcattgccacaaacagatgttctattatattctttctcattatcttattcttatcaccaggggaacctattacacatacaaatatccaggtctatcccaagaatctccaggaaaagagaatggagtttggatgttttataaaaatgccaggtgatttttttctcctctggaaaatttaggtgatattgcttgtcaatattacccctgctggccccacatctctgccaactacttccctacttctctaacactcttcacagccaaacttctcaaataatggactcacagacataaagtcaatattctgaaaatttatcaattttctccccctagcctgatccttccactgcctaattaattgcatacaccagcagctacccattcacctaaccaggaattagagcaactcttggtacctctttcttcccctctacactgtgatcatctggatcaatgagatctatctctatcccttttcactgaaaacactctcctcatggctgtttcgtcttctgacctggaccactgcaataggctcctaacttgtcccctgctttgattgctttcaaactccaaacattttttttgcacagcctccagaatcttcttatcaaaacatatatgatatagtttcagtcacctgtttataatcaatattgaattcacgttacacttataaaaaaatctccttttggttgtttaaaaagccctgctgactgggtggagtgactcaaaactgcaataccagctattcaggagactggggctggaggataacttgtggccaggagttggagaccagtttgggtgttatagcaagacccccatccctacaaatttttttttaaatgggccaggcatggtggtgtttgccagtggtcctagctactcaggaggctgtagcagaaggattgcttaagtccaggagtttgaggttacagtgagcaatggtaacaacactgcactcagcctgggtgacagagcaagacactgtctcttgaaaaaaattataaattaattaaaaaagaaaattttgaaaagtcttgcttctccaatgttattatcttattcaaataaattttattcgaaaactatttttatataatacaatgagatgactatagtcaataataccttaattgtgtattttaaaataaatggtgttttctgccactcttgtaaacaacagacaagtacagaccagaggaaggaaataagtaaatggccgtgatgggcgataaaggaatagctgcgaaagagtctgaggagctgatgtttgagacctgcaggaagggaatgagccagctgtgtaacctcctcctcaccaaaaagaatattcttggcacaggattaaaaaatgcaaaagtcttgagatgagaaagggtttggagagttctaggaagtggcagagaataatatgactgaagggagtctgtcatgaacctaaggaggtaaacagaagccagagcacttgaggctacacaggccatggtgaggactttgaaatatttttcaaatgcatgaggaattcattaggcatctgaaccagagaagtaagatgatttgatttatatgactgctttgtagagggaggagcaaaagtatgaggaggtgggggtcattttaacctttcgacttgtgccaccttcatctaaacaatactctaacctcagtggctacttctagttccttcagaaaacaaaagcatttcagaagattgtagcacatgctgtttgccttgtctcagattctcctttgcacctttcttccttaaggaagcaacttacacatcatgtatgtgttgactcattctgtggcagcaccagtgaaataaagtttaacatcattattcttttacagagcaccatattctcgttcttcatcactattttaattctgttttctgtgattgtgtctgtgtattctttttaactatccattttctcaataaactctaagccctgtgagagcacacaccatgcttctctcgtattaccagtgcagattgataatgggtgctctgtaaatgtctcctaaatacctaataaatatgtgctgacatcattagtaaatttacatttcaaaagatgcaatttatagaaaaaattccagtgtttttctgctctctgaacagatttttttaatagacattgatcatatggtaaaagcctagacctgttctcctaagcaaaattctgcatgtgtacctttctgtcaactcaactccagaaatacactcctaaaaatttaataggagacttcaaaactgaattcgtggctggtacaaagcattcaagtttctgaatggtgtagttattcagatcagtgcatagaactgtgtttatacacgtaccctgtagtgtcttttaagaaaaacaacatcattctgatagaaatgatgtttcttcagtctttctggatttagtacattttatggtcaaattttatttttttcttggtggctaagtaccttttgaaactaattgtttgaatttaaaaacgttgttgcatataccgcaatagaagtctttttataatgcatcatttcacttttcagccttcattagagttgatgatttatagcagtaccattctcaaagaatcttccgcttagagtgtctccatgaatatcgtcactggaagtggggaaggtggaaaagctgatggtcagggtgggccagatcaaacaattacttagatgctgcaaagaatcataataagggaaggacagttacattaaactttgtgttatgcttgttccctagtaattgattgctttttctaaaagtagagtaaatcagaggagatgtgagggttttaagttttgatagtacatcagtacaaggctacagatgtttattcaacaataaccgtgtgtgagacattatgttaggtcctgtgatgattatataggtaccagatgtagcttccatcctcaacagcttacgtttaaatgtggaagaaaaaagaatatttagaacactataatacccctcagaacatgtaattattagagcaaaaataaaaggagttcgggaatcccgaggggaggtgagtttacttttatatttggagttttctggtatttgtatgcaaaagggacttttggatagtggatgaaattgaaatttctacaggtaggtaacaggaaaacaggctgggggaacactacagaaaagggaagacatgcaaataggtaggatacttccaaatcacatcgcataatacggttttgctagactataggataaaaaaaggaaattatggggaaaaagcctgatagatcagggatcctcagcccccgtgccatggactgcttccaggccatggcctgttacgaaccaggtggcaaagcagaaggcaaacggcgggctggtgagcattaccgcctgagctctacttactgcagatcagcaggggcattagattatcataggagagcaaaccctgttgtgaaccgcacacacgaggagtctaggttatgcgctcctcatgataatctaatgcctgatgatctgaggcagaacagtttcatactgaaaccatcccccaccacacccccattcgtggaaaaattgtcttccatgaaactggcccctggtgccaaacaggttggggaccgctgcgatagatgattcgtcaggtgatggaagactaaatgtcatttctagacatttgggcttttatccataaggaaaggggagacactgaagttactgaagtgatatgttgcactgtgtttagggaatagttctttggcagctacttctaaaaagggctggagatgaagggattcatacgagagaattaagctttcaatagtctaagaaaaggatctgctatgctagagcagggaaagtagacagtgtgtgaattcaatatgttttattaaagtgagttctataggacatagtgactgagatgtgcagagtgacagagaaagtatcagagaatacttccaggttctgaatgtggagcctttgagatcagccttctcattgacagtggtaggaagaacagaaggaagaacaggtctgccatgcagataagcattcttggcaacagtcaagaaactaatttaaatgtttgaatgcctcctgtttccattgtatgtaacaaggtgtagtggcagccaatccagattttaggcaccttgtaagggggctgtggagccaatcagtgacaggaaatggcaatacaagaaggaaaacaaatacgaaacattcactaatatctcagaatattaactcactacgttgactgccaccaagagagaaagaaaattccctttattttgagctttggagagcagtgccagttatatcacagaagaatgtgaaatggtaggtagaaacgaggaacaatcagggtgataggatgaggtttagactactgcagaaaaccacagtgcaaggcatttccaaaaagtagattcaaacggtattaacaaaagctgaaaaagggaaagaaaaacaaaaactgagggaatagacttccagttaaataatagaaggatttataatccattgggtatatacccagtaatgggattgctgggtcaaatggtatttctggttctatgtctttgtggaatcgccacactctcttctataatggttgaactaatttacacgcccaccaacagtgtaaaagcattcctatttctctgcatcttcgctggcatctgttgtttctagactttttaatgatcgccattctaactggcgtgcacacgtatgtttgttgcaggactatttacaatagcaaaaacttggaaccaacccaaatgcccatcaatgatagactgaataaagaaaacgtagcacatatacaccatggaatactatgcagccataaaaagaatgagttcatgtcctttgcagggacgtggatgaagctggagaccatcattctcagcaaactaacacaggaacagaaaaccaaacactgcatgttctcactcataagtgggagttgaacaatgagaacgcatggactcagggagaggaacatcacacaccagggcctattggagggtgaagggaaagggaaaggatagcattctgacaaatacctaatgcatgtggagcttaaaacctagatgatgtgttgataggtgcagcaaaccaccaagtcacatgtatacctatgtaacaaacctgcaggttcaacacatgtaccccagaacttaaggtaaaattttaaaaaagatagaaggaacattgaggtattaagaaaactattctgaattttggaataatatatattacattgtgagagacctaattataaaattggataatgaaaaggcaaggcaaaacaagaagatgtgcataaaagaatgaaaacaaaagaagctctcctctctttttttataagaatcaaagaaatgtttcttctttcttctctttctcttcctctttttcttactctttctttctttctttctctttctttcttcccttctttctctccttccttctctccttccttctctccttccttccttccttccttccttccttccttcgttccttcctttcttcctttctttctttcttgacagtgtttcactcttgtcgcccgggctggcatgcaatggtgccatcctccgcctcctgggttcaggcgattctcctgcctcagcctcctgagtatctggaattataggcactccccaccatgcctgactaatgtttgtattcttagtggagatggggtttcaccgtgttgaccaggctggtctcgaactcctgacctcaggtgatccacttgccttggcctttcaaattgctgagaattcaggcttaagccaccacatccagcccaaagggatgttttttaaagattgttcttgatagaaaatgccaccatgaaaataaatagaaaatagtcttaaaataaaaatattctttaacttcccaacacattgttttgtacatataagagaaatacacatttattttttaaaaacatattttgaaagattataatataacttctagatttaaataaatttattcacttattttataactgaagctaaattaaaaattgactaataacagaaaaatgagaatgtgtttctattcaagtagtaagataccctttttatttttgaagatatgagatttttattattgacaatattaattttgaagagatgtatgtgtgtgcatatgtgtgtaaaatgaaatagagaaataatttcttcttaagttcacagaatttccactagccaggtattgaattcttctatactgttgtaaattgataaaattcaaattcttgacacaaaaaaattagataatacattcaaaatatttagaacgaggttttaaatggaaggcaacacaattcatgacacagacttaagcaatatatttaataatatttagaacaaggttctgcagacccaattatatttagttaatttaattgaaatgtttttaaatatattgtttcattgcattgatcactaactttgaagggatttatttttattaacttgcagcatagaaaggagtaaaaataaacaatactcatattttccccagttaatgaaaataaacaagtattagtaaaaagcttctgatctctaagagtacataatagaattctttttgagaataactgctgttttgacaaataccatatccttcaagacaaatcgaacaaccaaaagacaatctgcctttatttctcaaaatgactttgacctcaaattctgaaactgacagggtgactttgctcagtgaataaatatgatacagaaccttttagagggaatcgaatatgccgaatacccaagtgatctctctgtctctctttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttattcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgagaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttggagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcctgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgttgccgccttgcagtttgatctcagactgctgtgctagcaatcagcgagactccgtgggcgtaggaccctccgagccaggtgtgggatatagtcttgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttatgcgtcgctcacgctgggagctgtagaccggagctgttcctattcggccatcttggctcctccctcctgtctctcttttttaatcttaaaatcaaaacagctaattttaccacacggaggaattaaaccaggtgtaacggctataacttcaaagatttttgtccttaaggcctagagataattaaaataaacacaatgactttatttctccttaatgtgtcatttatgtactaggttcctgttgggaactgtatatattcaaaattatttttagttactgatgaaaaattaaattcattttatcgtatctggatttttaattttagtgataaagatcaaggtcatcggcaatcaacattaaaataaattggcaaatataagattttccccctgaaatacattggggaaacatttgaaattttaaaaaacagttataaaatgtacggaaaaaatatattactattctcaaacaataataaattcagatacaattattagtattttggctttaaaaagttgctttttagatttaatgtatttcctgaaactattcacaacaaataaaaaataattataatgttacagtatgcatctccaatgttattacctccttgtagacataataggcatatacttattcattcaagaaatgtgtattagttattatttttgatatttgaggagtaaatctctttgtaatcaaaaggagtctattaagtgagaaatggataactagagattcagaattctaaggtagcattgaaataagattattacccgaagatattcctgggattggcagttgtttattgagctttttccccagtatctggtgctaatttttatgcacctatttacagctaaaataggaattgatgggaagaaaatatatatgtacctctctaatgcaacagtataaaacccatgaaagaataattcacaaatcttaatagaaagagagagaaagaaagggaagaaagttatttttcacttcccctgagcaaatatgtaatttccatgatttctttttaatgactgcggtctgtagccagtaggtactgatttatgaaaagctgtaaaagatcaggtggagctctgtaggacatcgtttacagctgcatggattgaaacctatctaatttgtctagtaaaagtgtgagctcacggtgcacatcacccagcctataaatttccccttcagaccaatgtctggggctgggtctgaaaaaacgccaatgcctgcagctgctcaaaggcccagattcccttggtgcgcatgaagagacatcacaggctcttcacagtgagagacaaattcctatccattgataaactctccagatgtcctctctgaggaggaaaggaaccaatttttatttgaaatccccagagaaatcctggaagtggaaaaatgatactttgcagggctagttattctgaggtcattggcattaaaattaggtcatttttttttgtcttggatgcactttgatccaagtcataaacagacaaactcagttggggtcactaatccttaatccacacgtcctgttctatttcaatttgtttatactaattttctctaaactcttgttgagtctggctaaagtgttgagtgtaaaagtacaaactattctgaactgagaagaaagaattctgcattttgctattaggcacacttcataaatattctgaataaatgtcctggggtttgattcttcatacccacaaacccataaataaaaaagtattactattcatgggactaaaacttgacataagattctgtgctccagctactgtagacagagaaactgtggcgtgtgcgcgcgcatgcctgtagatagtttaatgtcttgtctcattctaggtttcacatgatttttcttctaaaatcttctcacacctgatttaatgctattcttatcaattttttagtggttcaatgacttatccaatgagtctaatgtaatgtctaatgcttgctagtgacaaagactatttcactcatgataactatgctgaaacaacccatgaatattgtgtacattttggtgtatatctgtaattactcaagttcttaggaaaagaataaaaatacaaaattttcaattataaaaataagctgtttttcttcctaagatgagtaatttaaaaaatcataaagtcgtttgcatatatgtttcagaagaagataacttatgaaatgttatattgatattttatagttttcctgatattgctaaaggaaaaaattaatatttatataatatggcccaatccttttttagataatctctgagagttagtaaaactaaactatatcagagaaatagaaattataaactccataattaagattttcaatttataatttgaacttgtgaagtaaaaaggattgaggtaattgagtttagtctagtggacagaagtttgaagaatccttccctttcaacttccctccactacacaaatgaccatcacagagaggggactattaatctatattttccacagagtatgtaaatagagtcagaaccaatgttgcaatttttttttcctgaaactcagggttaaaactgcactaaaatgtgaccatttttatcaaatacgtttcatgcatcgctgtaaaaatccagatagtgaattcacaaacttctcatatgttccaagtaatagcatgtaggtgtagggcacgatctaaaattatcctggctcacgaatcaactttacacttgagcaggtcttttgtacataagagagtaagttgaagaatatcaccagaagtggtataaacctctcaattaaaagacctatttaagtgtgcgcagagctggcacagatttgcttcatagattttctcatttagaacaggagcttttaccacatatcctagatggtaatcaatgattgctactcatatgtaaaacattatacagttttatttcatgtatattgttcattttgctatttcatgctatttctaaagatattgaaattagccccttagagacctaaatttatgtctaaaataaggataaatgcatgtcgatatattatttgttttggtgtcttctcaccacaaattctaaactttgaatttaaacacttcaaatgacagacttcacttagactaatctttcatttcaagtatataagaaaaatatgaagttctagttttaatactcctaattttggagatttttattgaaagattctgaagaactaaaacggcaaaaaatcaaaatataccctcttaattattaaataaagattaaattatatataaagttttaacattaatactatattttattacaataatgaaaaaaatcacagacagcagaatagcacttctgttttcaagcatttgcagtggaatgattgtgaagttgtaaaagttactgactattctaatgaagcccctaataatggctacttttcagggttgttatactattatgtacataatattatatatgactaaatttctagttacttaaaatggtggttaacaagatcattgcattcccagcattatatataaactgatatttactctgctattttctttttgaagttttcagaagtttaaccatttcaccatttacataagaataatgaacagctaacacatagtgcttattatgagccagcactgttctaagtgcttcccacatatgctcatttaatcttcatttgtgtgaaattgatatcctcaccatcatccccattttacagatgaggaaacagacaagaaattcaccaaggtcacacaaatagtatgtggtatacctgggattcaacccaggccttacggttccagtatctgtgcactaaacttcagggcatataaacatcgaatatgccacatgatggaatcataaatcatttaagaaaaaacaggggaaatgcaatatgaacaaagttttacctaaatggcacagtgtaccagtcaagaatgtggactgtggtatagaataatgtgggtctaaaggccagctctgcctcttttgcctgaggaaacttagcttcgtaacttaatgtgatttagtttcagcttctttatctatctcagaggatagcatcagtgcctaacaggtactgtaaggattaaggtccttcatgtctgtgtaatattcttagcatgatgcctgccacattgagtgcacatgaacgtttgatataatatgaaaacaagggccttaaaaacttatttctgtcattgttattattcatccaaaactaaaggcttttataactaccttgtgcccaagctcccttccttaggagaaaagaagagagaagtcaatatattgttcacctagtgactggctccagtcttataagtcaaaggacaattaaagaggccactaagagctgaagaaaaaaaaaaacacaccaaagacatttcaccaacagtctgcttcttttgcctcttcagggaggcaaacattgtctcattcatttcctttatgcctcttctgttccattgatttaccaggtcttgcaggtggttatagatagatgtttaggcctgtatttatataaaaaaatcctagaaggaagtcctttttctttctctctttctttttgagacggagtttcgctcctgttgcccaggctggagtgcaatggcatgaactcggctcaccgcaaccttcgcctcccaggttcaagcgattctcctgcttcagcgtcccgagtagctgggattacaggcatgtgccaccatggctaatttggtatttttagtagagatggagtttctccatgttggtgaggttggtctcgaactcctgacctcaggtgacccgccggcctcaacctcccaaagtgctgggattacaggagtgagccactgcgcccggccctttttcttaaagctgattgtattgtgcaatataaatcacaattacaatccctctctgagtctctgtgtgtgtgtgtgtatgtgtgtgtgtatatatataaaatattatgtatatatcatgtgtatataaacacattacatatataatgtatatatcatgaataatgtgttgcatatatatatcatgaacttcatttggtgtcaagtatgcaagaatgttttttcttatcagtcatctacttttttctattattttttatttttaatgacatgcagcattatttaactctgtattgagtttatgtcctgctgtgagtgtagcctagattgttcaagccattctttagacagcaacctgtgcaatgtcaaacaaacaaacaaacatccagtgggaaatacttaaaatattgaaactgaatccatcatcaaagcagacagcaaagaattcagtgtgtcctgcctactgtaaccgtatcctaaattactaccatttttgctagtgattaaattcaatgataataaaatatgtatggatatatttatgtctttcactggaaaattttcagtgatttaaaagcatttgtggatggagaaggggagaacttagacaagatgattacacggcgttcctccaagctgccagcttgaacagatgaagctttcatggcagataaattccacaaatgaaaggaacaccatatgaagtctggaagttcctgccgatgttagtgtcaaattttgacacacagcaactctgctgactcctgatctgtctccctttggtgttttttttcttgcaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagagtaagaaaaaaaaattcattaagaagaatgaaggattcttttgaactttcttggcttgacatgaaagatttgtaacatcttggcttgacatgttacaaatattagtggtagatctgaggtactgactaccgcctggaactgctaatcagggccctgggtctccttgtggcccacagcttctggattgatacatattgatgtgtcttcctctctcaagatagggcccaggatcggtgtctttagatatgaccttcagatcaaccaacagattcacacccataaccacactgcagactcaagcccctaatttaaaacataagcagacatagattgatgattattatatttctgcattttgtgatttttctgttatttttactaaagcttaacatctgtgaatcaggaaaattgagagccaagtagataatgtggtatacaaggaaacatattaaagtctaaaactggttttcatagttgctaaataaacataacaacatgtattcatcattgtctaccctgtaaaggatatcatgctagaaaatgaagttataattaggtttaagatagaatttttgggttttcctcaaaaggcttattgccagatgagaaagaaaaaatatgcgtcataatattaatattaattgatagctttatgtgttaaaaaccaataataatcaagtataatatgctgtattttgtggacaatcatctttgggtaacaggaatcttttgatatgagaaacacatggactcaaggaaaggtggtatataaagaatcaagtgaatccagtgaatagtcaaaaatttggttcttattcacaaagtagagtgtttgggaattgataaattaagagttggaagtcacattcttcatctcactgtgattgagaaccaatttacttcacttcctaatgtgactacataattttttctttttctgcacagtgacattttctggattcccatgcgcatagctaaaaactggctttctaaactcttggtcatatagccttatagtgccattcaactgaccagggtccaactcccttaatctaagttaccaggagagaaagtaggactggctcagtcccacttgtacattggcacctccaaagtcatatgtttactagtatctagtcatttatcttcaaaagaagtagaatgaggtagtatgaacttggctctaggggccttttcctgaagataagatggagaactgtcccaaagaaagaagtgtatactggatagatacaccaaaagttgtccagcatgttgtcgcttgcatggtctattgggaaactgttcatctttgtgtcagtctttctttgatctttgttaaattaaataaaccctttagtcccccaagtttaagtattatcatctcccactaatatttaaatatttaaatattgttgaatatataaagactttcattgccaccctgtcaatcattcaacatcactgtgaaaaataacagattagatgccagaaaagaacatgccatgtaattaatagatataagtgcccaacaaacaaataaataagtttataatttatggtgtaacattacaatcagaaagacataaagccaaagaaggacttacaggaacagtttacgattattgaagaagaggacttgttctaaaaaaataaacttaccctagtcaatttaacatgcaccagcattcttgttcaaagtggaatgtggtgtttattgaatagacttctgacccaatcgacagtacacttgggtttctgtggtacttattttgatcagatacagtctcaggatatagtcatgtgtttaaatatttttataaattcttattttagtaatataaacagttagggttatgatacacaaaacacctgctgtagagcacagaagcatagcgaaaagcaaacacaaagttgaacatgtccacatcactgccagattttcaaaggcaaagttatgcaaatgtttactctcaataaaatatcaacactcaaaacttttagatattgaaacactatattgaaatgtatgaggcagaacactgttgataagattaactgctagtttgcaattcaaatattgtcagccattataagctatgaatgtgataagaaagctatttgctttaaaaaagtgaatgacagcatttgtcatactttccaagttagcgacattacttatgtcagcaataccatgttggacgtcaaactctttttggctgattggaatatttttacttaattgttattattatttgaacaacctgtgaatatacattcaagatgaaaactgacttttcctgaaagacagctttttcaggtttgtcctgcacactgagtcaggtggtatggatatgtccatattgcactccccacaatattccttcttctgtcctttctcctcaattcagggacaatataggattaacacctttgccctaacactccttcttgaaaggagctgcttttttccttgagtcttcatagtgtcatgcacctcatgctcctaatttatattacaaaaagagaatttattaaaagtctttaacatactaataatttgggtaaatataatgaggcaacattttcagcataaatgctgtaaaatattgagctagatattttagctttctttcgggttcctggcttattgtttgaatttgattgctttcagtctgtattttctttgtgccatccagactcaattcagaaatgatttgctcgaccaaataactgtggagatcctcctagaatagaaaaagatacctttattcctattcaggctgtcaaagtataggaaaagatcaataaaatttcacattcaaatgcatattaatttattttcgttagtttagagatttcattgacatgcaagctactcaagttatctcatttttgaacaaagcccagaacacatgcaattttgtttaataaatacatatttcaagacattatttcataacctaagatggatttaggaaggttaaagtgagaaaggaagagagaaagggaaaggttagagtggctgtgactgtggaactagaaagagaattaagtgtgtggaatgaatattaagcagattcattgccacatgtcattatcctgcacccttggatgccattttcaaagtgtcatcacctatccctttgcctttgaagtaccagataacactttaacctctggtctcagtctggagctgctctttagtcttgaacttttccgccactcttctgaacaggacagtcaaaatgaaatgagcacacagagtgttatggagacagcagcaactgggggttccaaattattttggacatgcagagtagtggacagaagatattcgggcaagaatagagagactagagggtgtttaaaagccctagctaaggaataacccaaatggataattactttaattctcttttcaaaagtccaatataatcatttgcattaagtaaaaaaattgtatataaaacatttatatgtagtatatttatataaatatataaaaatatatattatatattatatataatatataatgtttatatattgtagataacatatataaacatgtatatatatataaacatgtatatatataagcatattatatatatatatgtttgcttatattgggttcacagatacagaatgtaaaacagttttttgcagaacatttcttgaggaatacactcaggaggtgcagctatgaagaagtgatgaggaatgtctcaaatcagtctgtgaactcagcatcacatttttttttccagccacttggggatgagtgcttcagttcagaaggaagatcagggccaaacatcatagcaagcagcactcagtaactatgcttaaatttctcaaagagctcaggcaattactgcattggaatatataaatattatatatatatatttactcatataatataaatattatatatatttactttccatgactattattatttttatttatttatttatttatttatttatttaatttttttgaggcggattctcgctctgtcgcccaggctggagtgcagtggcgcgatctcggctcactgcaagctccgcctcctgggttcacgccattctcctgcctcagcctccggagtagctgggagtacaggcgcccgccaccacgccccgctaatttttttgtatttttaatagagacggggtatcaccgcgttagtcaggatggtcttgctctcctgacctcgtgattcacccgcctcggcctcccaaagtgctgggattacattccatgactattattttaggaaggggaaagggaagagacaaaggacaaaaaatcatctagtcataaaacataggatatggtattggaagaagatgaaagaaaaaagaaagagtgagaatctattgatttgcatacccatacttgtatctgtcctgttttctggctctagactcaaaaactgactttgctgtcgtttggggataagtggagaaatgtttattctttgttttaaaggtagattcatggtatgtttatcaaaatcctgtaacgcacattctcaaaggcagggatcaacagaagtagcatacattactccaagtgaaggcttccatcatccgcagtacactaagcgtggcaagcctcacattcccatacatccccactagccttcctgagaaagagtatgatcagatagggcctaaggcaaggcacaagctctccagagaggatttatcagccctttgacagtcagcagggagggaacctgaaggtcatcaggaaccttctcagcccagatggtaggaattcagtagagtctcggttaatttaatgccctaatgcttaaataacaactacatttcttctcaaatggttacctattgttttcttgaacacctttattgcctaggaacccatttcttaagaaatcgattaatccatttctgtgtagttgaattcccaattttttctttctttatgctcagtataaaggaatcccctctgtgtgtgtgtgtgtgtctgtgtctgtgtgtggtgtgttcacacgtgttcttttttccttgccattctcaattttcctggctctccttgacaaatgatactttacgccctggtcatctttacccagaaaaatatattttgtatgtttctttctttagcaaatttgtattgagcccactaactggcagccattgtttaggttgctgttggtaaacagagtacgagaaaaaaaaaagaatcccagttcacatggaatttaccttcttgtggagtaagatagggaataaagaaaataaatcagaaagaaagtcaatatgtcagatggtaataaatgctttggaagaaaatgaaacaagaaaagaaaacagaaagtgcagatacaagtacagaaaagttttaaaatattaaataggagggttggggaagatttcattagagggggatgtttgagcatctctcaatcctgaaagacaggaatatatgaactaattacttgaaacaagaatatataattaaccatttgcacattagctgtcttttttacctaaatgaaattccttatgtttttataatctttattttaatgcctactttctgactttaaattattatatatttaataaaagagataggtctttgtcattgtttttctactttgaaagaactgtgtactttaatgagattattccagttatctatggctgcacagcagcctccccgaaaacttaaaggctaaaacagcaagaggtttattatacatcatagtgttgtgggttataaatgagggcagagctcaggtgggtgattctttgtgctctgaggttgatgttgacagaagcttacagctgccaaatggactgatctggtgtggagggctggagatgctttcatttcgacgtctgccttggtacagttagctgtacagctggtctcacctgggattgtaggccaaggtgcttacatatggcctctcctgtgaaatagtatcaggtagtcagactttttatatggcagctctagagcccccagagaggatatctcaagcaataagtagaggctggcagtttcctaagacctgaatgaagaaagtgatacaatgtcaattctggcgtactctgttagctgaagcagtccccagattcaagggaaagagataaaaccccacaaagaatgtgtgatcattgatattagtttcctaaggctgccacaagaagttaccacaaatttattggcttaaacaacagaagttttttcttagaattctggtggcagaagtctgaaatcaagatgttggcagtaccataattgctccagtctctaggggtgaattcttcctcgtctcttctagtttctggtggatcctggtattctctggattgtggcaacataactccaatctctgactccatttgtacatcgccttcttctctgtgtatcctattctcttataaggaaactgtcactggatttatgtaccaccctaatccagtaagatattttcccaatcggtgtattaattacatctgcagtgaccctctatccaaataaaatcgcattttgaggtttgggattgacagagattttggggaaactctattcaacccactacaccatctatatagccttctacaagatggtggaacggtccggacataacacagatgatgcaaatatcagacaattaggtccacagtactagaatataacatcgtgcaaattgtgctaattgaaaatctcctgcttatacactatcgaggaaaccgattcttatattgttttctttttttacagtgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactattttcttttttaggtactattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgtgtttactttaaacttgtcttttcaaaatattactcagtttatgttgtacaatgtagatggcctcttactaatgtaaaatgatttgtagtggaaacatttatatttttataataaacataatgaaaatattttttacagattggaa

SEQ ID NO: 2439 - DNA, 292823 bp, Homo sapiens
tcccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaaggtaagccaggtaccgcgacgcacggagctctgccccgcggggctcacgctcttcaaagcacgttctcaccgaagccttgcacgtcgggaaggtgcctccgaatagagcagtttgctctgagagtgaaggaaagatgtgccttttttttttccaactgtcttctaaaacacttcaggagataattttagatggtctaaactttgaaaatgtgtttttaatctgacaccatttcgagcaattaccttgtttgccaatttgagcagaaagaaagaaagaaaatcctccagcgttgcaacccagttatgttaattgccaaatagccaaggcagtattttattttctaattatgaccatgtggtactccgagaagtttgaaagaaaattcagccttcctctctagactctttagtatgtttaaaggtaatgacaggttgttcctacttgggatcatggcatttatgaatggactaaagggaaatcagagtttgtcgaagcggaggtgcgtgtttatggtgcaagggctgtgttgaagttgtgtgtatcccgccaggcaatggtttgctctatggtacaggttctaaagagcagcatatgccacattaacgtaagtaatatttgcaagaattacaataagcttaggttggattctctttgtttaaaggcttatatacaaataggagaatgtatttaatgaatagtggatagctcctgggaagatatagtaaataactgaatagtagattaagagagaatgttcatatgcagcaaatggcatttccttgatgttgtgttatttattatccttgtaatgagcattaattccttttcagtgggttaaagtgcaaacctaatgttaaggacaccaatgtgttctataagattgtgtacttaatacatacattttctttctcctgtattccttttgtgatctattcttgtgaatacagtcactaactcgtaaaacaaacttctctaaataattgattagtgtaaagccacacttacaacattaatttcctcttagtgattttgaacttataacagtaacatttagcaatttattttgcaagttaacaataccgagcaactgatgtgcaaacatcatgttatatacatcactccttagaaaatatattgtcaagccaatactgttgtatatgtaccttaattttaaaaacacgagtaaaaacaaaatacttagaaagttttttattaaatgtaataactgcctgatactcggtgacctactttcactgctaatagagcagtaatttatctccttccttactgactgcctttatcaatttggcagttttcattaaatgttctgaatcttttttctaaataagaaaatgaaaattctaaaatataaggatcaagaaaattatcttacccacaaatgactttttattttacaaaccaaattaaaatgtttatttgaaagtaagagtcaatcattcttcctgaatgaaaggtaagagtattcatttgtataacgggtaacatgtataataggtaacatatcaataaattaaacttaatgttttaaaaatttttgttctttgcagatattaaaatattgacaataactagaaaaatagtattaaaattcccacattgtcatgataaattatattttccagatagaatggttatgaactatgtagatatggatattactgaattaattatgcacaagaatgtagctgttagtcagtatttttgtggaaaacaacctttaagtaaactgcaagagaaaaaaaaagacaccaaactatttcacacctatgtaaaattaatcagtattaatttaatgaaacagagttaatcaaatacaaattgcttttaagcctcacctcatgtatgtttggggatataatgtatataattatacagacaggtacacattaaccatatggatatagaaaggtaaatatattcagaaagctgacataattgcatttaatttgcttggatgaaagtttatccatcattcatgggattattccttccagattgtgtcctatgggtagtgtctcttttccttcctgtgattgtgaagggaagctttaaaacaaatttaagatgatttaacttaggtaatacttgagtgagattttaaatattatccatagctgggctctcagttgagttgaataacatgaaaagtgaaaatgccaagtatgtgccaagatttccgtgcaatttttctaacaatgtaatttaaatagaaagcaattcttttgaaaatgtatatatgagaggagtggtgatttaaaaatggtattaatgtagttttctgatataattttttaattttgaaatatgaaatactagactgtatttaaaatattatgattgaaatatttcaacactgtaaaaaatttatgagaaatttactgaaacatatttactagaatatattcttcaatctgttatgaagttaggcatttgagaaccaaagagaacaaaaccaggccattgacttaattgctaggacatttgcagttgtgtgatgtgttttttaatttaagatttaatcattaaacatcaatattgaaatgccatgggtccctgataagaaaaataacttagaaaatgtttaatctgaattttccttctattaatgtatttacaaatatctctcttatatgctttcaagaaaatgactccaggtgataatagggactcatcaacgataacagatattcataattccaatgatcacttgactcagcaattggcctatatacttaaacagaactttataaaaactttattaaattcttatcaggtctctctgtttacatggcttaagaaaagacttttaatgggagatcagctgtttttcatggcaaaatatgattgctacactacgtattattttaaaagttcatatacttactcctagtttccataccacagggatgattaatggtaaacagaaataacattggaacaaagttaaaactggatataaaataaaattatcaactgtggttacttcaaccctttcagaattggtaaaaatactttctttaaacacttttatacatttatggcagtctggggtacaatgcactattaattcatcagcacataatacactaaatcattttttctatccaaaagagttcataaattggattaacatttacctagaaagctctttatattgaaaatagagtatccaaaataaaactgaataaaattaaatattcatatttatatactacttttttaaagactttttttagtagctaagacactatttctatgaaatgcatttccctaaatataaatattctaaatactagaggaaactatgcaattgtttaaaacttaaaagtaaaacttgcatatgaatattataagcttccctttgagtagtaggcaaatgttggagaaaataaataatcaattttttcatttttaaaaattacaataaattggcatcacttttcatatataaacacttttcctcaaataagaacacactgtgattaaaacattaatagagaactaagctatcatatcatctttataagtttttttggtttggaagagggtttacatttgcttttcatagcatttcatcatgctagactaaataattgaatgcattatacatttttgtaatttaatagctctcctaatagctcacccctacatcccccccccaccccgcctccatggttaactgtgctatttgcctgaaggtaggagaaaccttattttcactattttataacccacaacagttaacacttgacctaggtcattaacaggattatcagcaaatttgtttaagcttttactgacaatctgaattgctacgataatattttgaatgtcccgtaaagaaactttttgtaacctctcaaaatctatcacaaaattaattcattctgaatctatatctttgtaaagactagtatctataataataatttgagtggtgaaaaggttcactcggatacctcaatctctttatttttatgtttcataatcatactattccagtccttgtcataaatgagcaattataaactcttttagatattacatcttctagtaataacaatagatttatcaatacaaaacagtttcactgtaactatcaatatttttaattttatatttttaaattattgttactgtagttgatagggttttctttgcctattttaaggttaaaagttagttggatatacttctaattcagaagtgactggacttataaaaggggaactacatgtaataaaacaccattgccacgtgttagatcatggttgtattttatataaagttgtctttccatgaaacactagaaattgggagctataatgaaaaacactttaatacaaaaatttaaaacaaaatattgtacagaatcagatcttagagagttatttttaacattttttagtaggtttaggaagtttttggtaaagtttttcatttcttgaattgaattatggttggctcgttggtcatattaacaacttagtaatctcacgttgctcttaataagtttattattaaataaatgatttagtaacattctttatgtattgcctacatttaacattcaaactttggtgtgttccttaagggtccgaccatttttaatacttttccacaataaatttctttctaatgttaaaatcctttcagaaatttaaatttttttcggaaataaaatatatgcaatttttaaatatcaaatagttacttttgcaaatgatttttaaaggcaaaatatatttccaaaatatatttgatttactaatttcaacacaaatgaaaaaaaaaagaagtgttcttgaaagttacattttccaagtcataagatcttcaggaaaatattaataaaactttcctcaaatcatcaaactcgataaggttttatagacatttactaaaaaaaatctgtgatctgggctactttttatttgaatcattctttcaatgattcggtttggcataaatactagatataaggggaaacgtgtatttcttggaagaacattaagttttacaagttattttctgtcaagatcctcaactttattttttagcctgcacattttttctttaaaatatttaataaaccttgttcctttaattcctgtttgagagaagatttagaagaacagatgcaggtgtctccttttgggttctgttttcagagatctggattttatcatcacggaaggtcaataaagggcttttaccaagtacacaagtagctttccacagattttttaaataaagggttgaccagtagtgtgaaacattcattatattattcatccagttatacagaaaaccaggattagaaatttacttctcagaaatgtggaaaccttagctaactcttctgtaacaactttagaaatattagtaaaagcaatattgtgacatttataaaatgcaaagtcttccaagtcacaaatcaatccacctaggaagacatccctcagtgtgttcggggtgtggatacatgtgcgccacttgcttgatttcattaagtctgttcccagctgcttggtatcaggtagttcttggaacctggcaggaggttttctccaggaaaatctgaaagtcagcaagttttagtttgcctcctaccagcttcctttgtacaaaaaaaaaaaaaaaaaaaaaaaaaaaagaggggagggtggtcgattacaaagaaaaaagtttttgcaggagaaaagaaaataaaaaaagttgattagaaaactggagaagtagagaaaagcaaaggttttaaagccaatgttaatatataaatcatttgcttaaaagaaaggcatttatcacgtaaaacatctggctaatcaatttttattaaatccctaaaaaccccgcacacttaaaatggggttgaggtgggggggggctgcatttctttgtttctcctcaagtttacacacttttgattttttcccagaagaaaatatttcatccaggaaagttttaagagtgacagccaaaaaatgctaaaatgcttccccctttgaatgtctggacgaatgcatgtggaggggtggacagaatcaaaatcaattcagcaaataaagcctcaaatttgaagtgatgttattaaactagaagccctgagtgtgaacatcccccaacccttcattttctaaatcatgtcccgctgttccagtcaaagcaaagggtgaaaatccacataatccaaaccaacatggtgaagtgagaataataggtgaggaaggaggaggaaagcaagtggcagcactgtacaaacaaactgttgtgaatattcctcgccatggacaggagtagccacaggaggggataactgcctttcttcttcttcgccttacactttccacatttgataatgcaaattcattaaattacaaaagtgtgtcatgcgaaattttagcacaaagcagagccgtacgggtagagacagtaatgtggcaacagggagatgagcaagtgttccttgctgccaccacacccaccatcagggtgtcttaaccacaaactattctccgctaggtccaggctcgttggtgcaaagggaaaacaacggtgtctctcaacagttcactgcttgctcactctgcatcaaattaaagatgagatcataaaaaaacatctccgggtgcgcgtaacgcagtctcagccctctggaggccagtgggttctttgtgcacaagtctctccgcgcctggctgcccaagtcagttcccggagcgcgaccagggtgccacggcctccgtcccgaggtagggtgggtgggcgagcgcagcctgatgctcttttgctccgggtttctgcccccgggcggacggtgtagactctgtagcgagcggagagcgaaggtgcaaagttaagcgaacacgagcgccaggaggagactggagcgcgcgagaggcaaacgtgcgccctctgcctgctgccgcggatctgctggcactgggagagcacggcgtactccttgccacctggaccctccttacctgggcgtcagtaagacgccagagagtccatgcgccttggacgggcctggcaggtcctgacctgaggaatagactttaattcaggatctacgatcgccctgccgcctttcgcattgctgtcagctaggcttttcagtttgatgtctggaagtggcgtgtctcttttccatccattttcatgggttcaccaggtgacagccaggggaaggagatattctgcaaggttcgctgccggattgagaaagcatctcttactgggtgcgcttggttgagactcacaggagttgcctcatacgccctgttgtgcagcttgctgatttctaaccctatccctttactatttcttcatcttttgggcattcaactcttttggtgtcgctagactaaaatgaagaatatctttttttttttttagaaaaattttctttaaaactacctgctagtgccacctttaggcccctagtaattgctgaggggatgtcagtaaacttttcccctgtgcatattcaaaagttgtctgtgttctcccaaagcccgtgtttgactgacaccattttattaaaacaggatttttcctcttccaatattgggagtaaacatggaatgggcaagagagggtttttgggagctgtgctatcgagatagcttggtgggtggatgatcctgatgtttctgtggctgtgttagaacttcagtctttttcataaaagatgattttgttaaatcctgtagacttcaagactaatatatcctcagtgccgtgttcaacactgagaaaataattgctcagtgctctgctggcaaatagatttttcccttacattatcattcacgacttactgaacctcatttaatcgttaaagcagccctaaaataggtaacataatgtttcccattgttacaactgaggaaactgagaaaatggatcataataaagcggtaactaagccaagccctctctcgtctttgtcttttgattttaacctcatatgttttctcctagacacaaatgactatgaactagggaggcatcattgtcaggaaaagcactagcttctcaaccttaatcccagtgactgtactaatttgtcttctgactttgcaaggataatttagaaacattcagaaatttgtagtgaaaaattgaagaaaaccatataaatgagggtactttggaactgtagttacactcataagttatgattatctgcgtgtgggggggacccactaagaaactaagttaaaggaatttgttgtggacagaagagtagatgaaaatatctgtgatgacttttcttcacacgttcttacctctgtgttcctttcctgacactcaaacactcctttcatcaccctggaaagaagattttgtcaggaattccatacatacagatagtgaggaaattgtacaatataaccagagtgtgattatttagggttatgtgtaataaaaatgaagtgtgaattaacaattggaattatcttaaaggtcagtaataggagaaaatagaacatggtccaaaaagtagactttagtctctgtggaaatttccccccgtttaaaatataatttttaaattgcttaagatgagaaaataaattttagtgatttagctcttctttcataaaagcacttgtattctatttaactcctgccattgagaaaaggtagctaaaacaggcttttgaaaggtagcaaattaagttgggggcaattatatttttcatgtgggtattttagcacatatgttttgcattaattgctgcaataaattctgttaacctggcaaagagcaaaaatagcatattgatgacatcaggcttccaaagcagaaagcagcttttagtatcttgctgtcttcactgtaacattaaaaaaaaaaaaaaaaaaaaaactaatgtggtggttaaccaaagagttagccattctttcaagctattggcatattttccatgaacaaagtgaagaattagcaacaaactttttcccccttacttccagagaattcatgtcaattactcattttcctgttatttgattttttatattcatatttgttactcattttcctattatttgatttttttatatttatatttgggttttcagaactctctcaaatcaaggcaaatgtaaactgactttaaaggctccaaactgagctgtcttcccttttaagacaaacatcttgactgattacatagcagggcctcaaaagggacttaagcaaatagagaattgtgggttaattttattactgagaagtttagttggtcaatatcaaaactgtttcttctcgatttttaatacattcattttgagaaggttaatataggttttttcaattaatagttaagaaaaatagatgaataagatctaaaggtccagtaagtgtaaactgcctcatgtaagactttaaaattttactttttgcctatgataaagttgattgatttccaatcaacaggaaattgtaacatttcctatctacctcagactgactaaggggaacacagagcagcttgttagcagttaacatgtatttatttcctgattttcaaacgcaatttagcaattaataaaactgtatagcttttaaagggatatattctttcattgcatctgatggcagtcttcacactgagggaaagtctgggaagctaatttgcaatgtcttccatgtggattatctaactaatcctctgggtaagcaaaacaccactcacaggaaaagtctatttgcagcactgtgtggtgtgttatatcaccaacagtattgtcctcttacaaaactgagctattcccaaactgtaagcaaaatttaatgaataaatatataccttttgacctcattatggcataatttttttttgaattacaaacaggtgatgtgaaaaaaacaaaaacaaccattgatttatttgtcactatctaatcttgttcattttccccaattgtcctctaatcatctataatattcaaaggtggcaaaaaggctagagttatatacaaactgagatttctttcccccttgaataagtcacagctgatcatggtagattttgctttttttacagaataaaagaactgacagcatcatagaaaactagaactagaattaagtcagattgttactcttttatgaaatctataaacaccaccaaatctagtaactgccaaatattggaaatattttcaaagatgcagtataaaaggacatagtatttttctcttggtttacttttactatctggtttactatagataatttaatactcatttacattcgataactcaaaaagataaacttagaggttttattatagtgttcttgacacttctgatctaaattatgatttgattgtccttgttctctgaaaaagaaatttccatgtgtaattatatgtatttcatctggctaaactagttaatccatgcttaacaatggtttttttctatattttcagatacaagtgattttctttgacatttgtacattgcataaagaaaatttttcttatctttcaaagtgatgttccaaatcatactaaatgttttaatattcccacaagaaaaataaaatgagaggaagaaaactaaaaagatataaaattagtaatattcctttaaatttttctttccaaaggtgatcctttggaaattaactaagcatgttttattttatgtttggccaggtgtgtagtaggtttactaccctaaccctattagtgaaaactttggaactctaaatgtaatgacaaaggcacaactttaagaatcattaaaatgagtcaagaaaagggttgatatataactaattgcctgttacataatgactcatctttcatattataataatttattgtctgtttatttaccaaacagtacttatctgaggattagttacccactagattttgaaaaaaaatatctgctagggagtggaatgctctgtgctcttgaagatgtcaaattcaatgggataaatgaatctaaaataaatacttatataaaaattgttataacatagatatgaaaattatgaaaatatgatatgaatctttagtggagggtgcaatttaagtcccagaacagagtccctgagagacagggagaatttttttaaggtaaaagataataataaattcataaaaacaaggactaggagattagaagctttgcttaagttcatgtggtggggataattttaacccagatttatttttaactgcatgtaactttaaaaataatttaaatgaatatataacaaagacacacttttaagcatgtccaaaataactaaatattcagaaatagttcttgttaagcacataccgaagctaacataaattctttacattacatgtgagtgcatgtgaatatattggaaacacatgtgactgaatatcaaaatagaaccatctccatataaaaacttctgtaggtgctattcctattatgactacactacccaaaaatatctcattggtctttatttgcattctgccatctctttcatcaataaattaaaagttttctgactattccagtgcggagtttgatgctttccattgacaccatgctcctaagatgcaaaggaaaagactagtgttttgaaataaactgctaagaatgtggtaccatatttgatcctttggggaccattataaaaacccaaaaacaagtcttgaagagtttgttcgtgtgtgtgtgcctgtgtttgtagatgtccatcaaatttgtattgtcatgatcaaaataaatgatacacctgagattttagacaatccagatattctgcagaatatgatgaagtcagaactttattctgattttagttttccagaaatttgtttaataaggaaaccaatttattctacagtggggttctttcaaaacaaatatgtgtgtatgtatgtgcacatgtgtgtttggggatgccaaaatgtccagaggatgtttttaaatttaaacttacttttgtttcaccactacattctttgtttcctatgctagaattttgaatctttatatccaacggacttctaggaactatgtttatttctaaaggaaatactacattagagttattctgtaggccagttttcttcttgtattctattttcccagccaacagtcaaactctggctgaacagatagcctgtgctatctggatgtcgatattctacattttatgataatatgattttttaaataccaagatagactgattttatggggtgaaggcaaaatgcatatgctgtagtttaaactgctatttcccttaatgactatttgtatttcataattgagtaatatgttttcatttttcactttttaatctttcaaaaaggtctctctgaattggatgtaaacaatcattctattacttctggaacactttaaaaagcaaaactgtgaaaaataaaatgctgtttacataataatgtcctggttttagaaacttacattttgggagacacattttactcgtctgaatgattcataatatcagttaacaatggagagaaacaaagagctgttatttaagtcaggctgttagtgcactaaaaattcactggcagtagagcatcacaactcatttatgtgaaaggattattttgttataagaacacatttttctactgatatcttgatacctgtttgttccataatagttttgatatcagtatgacctttatatttctctgattaaaagagaaagaaagaaaattttaacacttgataaacagcataggattgacatttactaaagtaagtttctagcagaattttgttctatgttatttcctgaatcactctagttataaaaacacagactcatcttattgtgagactctgttttgattccaaggagttccccctactgttggcaaagattgagatgagacagctaattgcaatttcttctataagatctttatagaaataaatccaaaattattgcccaggagaaaaagctaatgagaaagaataagttaagtgcagaaatcttcttatatcacataaataggctgttaaaataccacctgaccaaaggtttttcatagcaatgtttaacatggcagcatttaaaaaattactacatcagcctggcacggtggctcacacctgtaatcccagcactttgggaggccgaggccggcggttcacgaggtcaggagatcaagaccatcctgactaacgcggtgaaaccccgtctctacacaaaaacaaaattagccaggcgtggtggcaggtgcctctagtcccagctactcgggaggctgaggcaggagaatggcgtgaacctgttaggcggagctggcagtgggaggagatcgtgccactgcactccagcctgggcgacagagcgagactccgtctcaaaaaaataaataaataaataaataaaataaattattacatcataattttagctgttcatttgataaaaattgtataaattaacatttctgtgatataaaatgctgctaaatttaacacagtttacaggaacttttatctgcacacaattgacacataatagttgacttcgtttatagtacaacatttttataatttttatctgtgaaataaaatactaattaaagctattaaagtattttggctgggcacggtggctcacgcctgtaatctcagcactttgggaggccaaggcgtgcggatcatgaggtcaagagatcgagacaatcctggccaacatagtgaaaccccgtctctactaaaagtacaaaaattagctgggtgtggtggcacacgcctgtagtcccagttactcaggaggccgaggcaggagaattgcttgaatccaggaggcagaggttgcagtgagccaagtttgtgccactgcactccagcctggcgacacagggagaccccgtctcaaaaaaaaaaaaaaaattatgcttgggtagaaagaaaataaatacaaacaggaagtccacaggaacaattaaattaagaatatacaagcatggtagataaaagttatgttgcaatatataagtacatcaaaaatctatcttctctaaacttctcaatatcataccctgctgcttacagtaaaacagaaaagctgagctttgctgaattcctatcagaaaatataggtcgatttcttaattctgtattatgtttgaccggagaactacacagagaatgataacactgagtacaaagtttatttctttctgtatcattttcttcaatttgtgacatttaaatatacttagaagcagattgaagagctctgtgtagtcctgtaacctagagcaaagttattctgcttattataacagaaagtggtgaaaatcataaagataagtatttgtgaaatgaggctgggacaattacagtgatggtgtgcatagaaagaaactgtcattactctttagtgaaaacaagatgtaatcaaaggatgggcttatttttgttgtagtggttttatagttatttgtacttggctataaaagtcccttataactgaaggttttactagagaacatgtgcattattatatgagtttgaaattctttagccattaaagcctactgttaaccttgaaatgattgtttaataattatttataactcagtttcataaaatgcaactatagccttaccacaaagcctatgggtgtattattaggtaattggaaagatctgcttcagtaaaaaactgtggcatttaattttaaaaaccttttagaactctctgcatgtttgtggcacttaaaaatctttcaaggtgtgaatattagtttcactctcagtctttctaagtggacaagtagccactatgaatcagaatttagaaatgtcctttaaaaatctttatgtgttaataattctctaaaaatcaaaactccagaaacttgtacatttttaatccgccctcactaactgggaacatttgtttcaagcccttcttttagtaactgagaatttgaaataaaaagtcttagtttgttccttttactaagaagaaaagactatgtaaattatttgaataggcaattatttgtgacactaccaatactaatgagcaattttactaggagtggacttttgattgagtctctccattgtgacagaggataggaaaggaagagagaggatgactctgggaatcttaatcccacaatccaaaagagggggaaacataacagtagaaatcagtggcagaaatgacatctaggtttcctcctttccataagtacttattaccaatttgagccaatttgctctatactttcctcctttttttgtttgtttgctttgttttgtttgtttttgagatagtttcgctctgtttcccaggctgcattgcggtggcgcaatctcggctcactgcaacctgcgcctccgggttgaagcgattctcctgcctcagcctcccaagtagctgggattacaggtgtgtgctgccatgccagctaatttttgtatttttagtagagatgagttttcgccatgttggccaggctggtcttgaactcctgacctctggtgatccacttgccttggcctcccaaagtgctgggattacaggcatgagccaccgcgcccgccactatactttgtttttactcctttactccattctacaccttcttatttacgtcagaaaccaccattccttctttccagatcttagtaacttagtgcccatctgaaagtcaaatcaacagtccaagtaaggattgccttccccttcttatgaatataagccccttctagtcatacatctctatttaaaagcaattagaggcagtaaaacatgtgaaagaaaaacctagaaccatatccatctatacttaagatggtgttttccaaattcatttttgcccagaaaaactccagttatttatttaccaacttaaatagaatcatgacatttaaaaacatttccaatttaaatcactttcattaaaaaagtttatatattccacatagttttttgaatataaaatattctaaaattaacaaaataatgtgttttctgttacacaccaaaaatatttggcaatcacatcattagaatatgaaatctgggaaggggtaacttacagctttgataaataactggcatgagacagccattaaagaatgaagtcatgcatatgttcctatctagccttaagaaagttttctttttgtcagattttatcattgcgaactcgtattgtccagcaattgaaataaactatccaactactagtgcaattaaaattcagtccacagtagtatatttgtatgtcacaactcattagcctatcctgtctgtcctagagtttgaaaggaaatgatcaggtctagatatgtttagagaggggacagcattatagtaaccaaagttcttgcctgtatcagtgtgagatttaagatatgtattgcaatgttacattgagtcaatgtatgcagagaaatcgctcacagatttactttgaaattccattcattgtcttttcttacctcaattatgctgtatactcaaacagttctacaatggatcacaggagatttgaggtttgtatcctgggagtcccaattaagtaacaattcactttaaagtatttagaattcttagacggtgttatttttatttgggtacaaacaaaaggcactttataaatccaaagtatgtgcttttaaagtgtgttttgaagttaactattctactctactagatcatgtatttaggtcatgtaattgaattataaatacaatttagaagccacaatggaactgttgttaaataatattaatgtattaaatttacgagaaggaagtctgtacagcatgttataaactcatggtggatttaaagatatttatggtatttgaacattacagcaacattgcaagatactcagggtagatataattgatagacaatagaatcagtcagaagtaatgctgctaattgtgtttttctcatttatgctgaatagagtgcactaaaaatttaatttctgagtaaatgcaataaatttaattaatcttctacacttactttaattgactgtatggtctaacctattttggtttatttgttctcctttgagtagaaaccaaatgctgatgtgattagtccagttcttttccattgttcttattatcagaagaaacgtaaggatatggtagttcattagttgacaacctacattccaataagtaatttactaaatggagtctatgtaataaccatatcttcttcttctcactctggttactaatactgagattaaactagtgattgatcttaacatgtggagtaacatataattatcatttagtaatgtgcaattactacctgaacacaatgatacattaagccatttaaacccctaaggacattgcaaatataatctaataatttatgtatactggcaagctgatttctactatgcaaatcccatataaagctcagagaaattaaatgattggtatcacacaactaacaactgaactaggtatatcttttatcagaataaatgttagtaatatcctttaatttaaaggtgaggaagtattttcatattttcaaaaattttctaacagttatctgaaatataatctataacattgattaattggttgagggtatttaattatttttcagagataattgcaatataattaagcatactgttaatttccaaactgatatcctgggaaataattcaattatggaaattatactatgtaatccatgcagcggctatctatcttctgttttaatttaaatacaattacttctaattaggattaatttattgggaaaaaattctttaatcattaaggaattataatataaaaggtaaagtttatgtttgtctttcactagcaaaacgtaaagaatctaactttgagaattgtatttcttttaaattgtagtgatcaagagccttacttttacccatttaatttatttatcaactaaccagataatcaaaattttagtactgcttgaaaatttagaaacctaatgtctatcaaatatgtaatttatttttcttaacattttataagattaatatttccttcacaaaaaaatagttgagatgattttttaaagtctatcaaatacacaatttatttttcttaacatttaaaagattaatgtttgctttgcaaaaaaaaatacttgagatgacttttaaaaggatggtgcttttcatgtatcaggaaacactttataaacaacatgagaacatgttgtgcggtgtatgtatttacattatgttttggtttgtgtatatatgtaacccctgaaaatgattcccttctattgtatttattgattttcatggtctggttcatgttaataatgcatgcttagtttatgtaaccttccttcacatcctccattagtcaatcatgggattgttttctaatttaggagaaagatgaggtaaaaccatagtttccattatttaataggtcagatagacaattaaagtgaaccttttgttattgattgtatttgaaatgctgttgtatattttattttctaacctattacaaatgaatattcagtatggaaaataaacagtgttccatcttcttttaataatatattaaaaatgcaaccatatgcatgctatattttactttttgtatacaaatatcgattaaaagtcattagaactagcacaaagttctgagtaaaaccactaaagcctttgagtaaaaataattactttaaataagtaaagctttacacaggtgttattataaaacatagttttactttgatttctcctcaaattggtagttaagctttttgtgtgttacatataagtaaataatgaatacatttttaaaaaatacacattgcagaataatatgttgagtattagccagggatgatatgaaggtgtcatattagatataaataaacagataaattgactcattctgtcaacatatttaagaaatgaattaattgtggaatcatatgtaaatttatcaaatttaatatttttgaagttattttgatatgctagcattaatgttgttttctattatgcatttttattgtttcctctttaaacccataattattatgccagaaattgccagtatattgaacattaacctatccttgtaaacaaatgcaaacagtttaaaaggacacagaaacttttgatctcttaactttccctgtgtattttttgtaatttccttctttttatcctaattatagacttataatgagaaggaagagttatgttttttgagcaacatcaacaacagacaatgtgaactcaacagaagcaaatagaaataattcactgttattaactgtgtttgtgtattatgttttattttagtcaatctactggattcaaaaacaattcaaggggagctgggctggatctcttatccatcacatggggtgagttcaataaactatcacaaggaaacattttctctattacctgtcttagggagcagatgaatttattgtattctctaaagagaactcttgtacttctggtgacaaattatacttataggagtattcaatatatggagtaccacagcttgacatttgtgtccaatggagctagtgagaattttgaagattttttttctccttaatttatcaattgcttgaatggactgattaaatagtttaattattattggcatcatgtcaatgatctaagagtgactttttttgatgtgatcagaataagtgaattaattagactgtctaaatttcaggtaatgtagaaagtgtgtatttggagacggtaatctccaaagtcatagccttaaaatcaacctcagtaactgctcttccaagtagttagaatttattggtcaacagtataaacctatgttgtcttaatttacttgtttcaaatgtctacagtttgcctagatcagctcaaaaatgggaatattacttagaaaaaatctgctgctgcctttaagttttaaactttttacatagctttggtattttatcaatccagatacaaattacagagtgtgtagcatattggtgttctgaatgactataatgaggcttttatgggagaacatttttcttttattttttctgaaaaatgaggggagtgttatttacatttctcaaactcttttccctacacaattgtgtaataaattcctgagcatacctttttgtttctaagtatagtttgtgaaatatgtgaagtactattttgaaatatttgtcataggaacaaatttatgtattcctgtccttctatgatagtcgtcttttcaagagattgtaattacttccacttcgtgttggcgttcagtctttagatttttgtgcctaaatatacacaattttttgatagcaccagcttcttcaccagcggatgttttccatcagagatacttcatctatctgtcatctttgtatctgcttctcttcctgacacaccttgactttgacaatatgccaaaacctaaaatcaagccttcattagttactttagaggagagagtatgaagtaagccaggatttggttttcccagaggtgtaaaaggaatcaaatgattaagataaaagcacagcctaggttgtcataaagagtgaattgaaactcaagtttgagctggaaaactcatttgaaactaatcatctaaaagtcaaacctcaccttaatttgattttagaaatttaaatttttcatgactccttcagataatataccagagaatctgctgcttcaggatataagaaaagcaaaagctatggtaacatttagtaactatatattagtatatggtatactgtataccatatatagacatactatatactatatatactatatactcaataatatagtatatatattactatattagtatctataactaatagatatgtatatgtttctttttaaaacaagaaatcatcttatatttcacagcaacagtctggcttatgttttcctttaaagaaggtataatggtaacacattttttatattgggaattgggggaaatgaattcccccattgttattctcatagataatgtgatgggatagagttggcacatctacttccagagctatgttggaggtagacagtggggtattcttagcaccttgctgggtaaagtgtggcacagggacaaaccagcaacatcaacatgtgggagattgttagaaatgcagactaccagaccctgctccagacattgtgaatcagaatgtgtatctcaataggtgactctttagcacattgaatttgagaaacactcctctgcataaattacctcttcacatttcccatctctggcccaatttactgtctctttgttccccagaaatctcttataacttccacagtcaaaagttttcagtttcttctttggtttactgttgcctcagagatccccacttggacccattagctcctcttcattgctgtcctctgttgatcttgcaactgtgattttcctatttctgatgcataaaatagcctaaaacagttggtcattctcttcaagcttatcattattatttgcagggagaaaagagacactccccaatagttcatgaaacttacaatacctgagaactccgaagctaaaaaaaagaataaaatcaaatgatgtgaattattgttctgtggtgatatatagtgtatatttcctttaaatttcccacatataaagttaaccataatatatataaggaaatatatagtgcagatttagaaaacattagattgttttttttttttttttgagaaactgaccaaattactgggtgaaaataatgtatggtaagtttaggttttggatttaatagcctggcatatacaaatatttgtgcctctagattcaattaattattgttattgctctcatttttaatatgacaaggatagattagttttgtggttgtattgtttttaaaggaaatagatacttataacaattgtgatatccttgctgaaacgtttttcataaaaaaaagacaagtaatagctggaaataactttgagtttgttatttttcaaattaattaactctaataactggcagtacatctgactggaggataactaaaatatgactgtaaacttaagaggaaaaaatcataataacaatattataccatattaaatcactgcaaattctcactcttgatttagggtagtggttcttaacaggttgagcgagtaagggaagagggaatttttattttgcctcggtgggatatttggcaatgtttgaagacttttgtaacaactggagaaagcaggcacttttacatttagtaggggagacaagaggtactgctaaatatcttccaatgaacatggcagcccctaaaaagaagaatgacctggtctaaaatgacagtggctaaattgagaaactcttacttaggggattaataatagcattccatcaggaaatgtccataactaaggagatttgggagactgccagctccctctctaacttccaatcatattctcatcagaagctctaaattccaaatctgttgaaatataaattttaaaaaataaataagtgattcatttcaaacttgaatctttcatggaatgcttgtatcatctgagctataaaaaattaacatatttggagaaaaatggtgaagagtagttcattcctacatataatttcttttctatttctattcttccttttcctccaaagacgtattcatacatgaaactttacaattcacctaggtaattttcttgggagtagtatttctatctcctttttttttttttttttctttttttgaaatggagtctcgctctgtcacccaggctggagcgctgtggcgcgatctcggctcactgcaagctccgcctcccgggttcacgcaattctcctgcctcagcctcccgagtagttgggactacaggcgcccgccaccacgctcagctaatttttttgtgttttttagtagagacggggtttcaccgtgtaagccaagatggactcgatctcctgacctcgtgatccgcccgccttggcctcccaaaatgttgggattacaggcgtgagacaccgcgcccggtccctatctccatttttaaatggtgcttcatatcttagagaaaaccttgtagggagatatgatactacatatattattaggccttggactaattctccaaataaatatctgggagtaaatttaatgaaactttaattttctctaaatgaaggtcatgaaaataatactcaaatttgtaaactgaaattatttgtggaggtcgtgaatagcaattcatttttcaatgaaagagttttatttgacactcatataatctggcattatatttggtgactttagcaaagcagactgaagcagttaccttctctggccctataaactatgaatgatatgatatttcaatccagggcttaattttattcagaaatttgggtaaataattcaatcgttctaatattaatatttgatttggagaacaatcaacacatatcaaagcctctatatattgttaggttattgtttttttctaaaaacagccttttgcttacacatgacttaaattgattgtacttaaattgattgattgattgactgattgatagtgtctatctaccacgtaaactttcttagactacatatcactacataaatgcattggaggagagatccaaggaaggttgagctacacagttttcacttagtatagtattgatattgtgattaactagtacaaagaaatcatgagctatgactcacttaattaaagaaactccaataagaagagagtgaggactggcagggttcagggagtgtagaaaaagcactgtctgaaatgagtaatatatgtttgtggaaaacagaaagaggtatccgaattagtaattgtggaattaaagtttctttagatatttattgatgtcttagcggtgaacatgcacttaaaggaaaacactcttttggcaaatagggagcttgttgattgcccacccaatatctgttcgctggattctccttgctgatgaaagaaacatcgatattgttcaagttttcaccctcccaggtgttcctggaaaatggcccctctgcgactccatgggttgaatgctgattcatcttggaactaatcatgaccatgatagttattgttgcagggattggttgaagcaagtgtaagtaaagccaatgagactggtgcagaattccagtgatttctaggaaaggttttcctcctgatggagagatagggagagacccatcatttcctccgtttgggcttgttctgtaaaggctctgggtctgcagcagctgcatttctctcgggactagaaaggcagagcccagtgagcataagagaagccagcatggaaccttgatatcactgaaccactgaattacgtgaaagaatgcctcttctttgttatttaagccactcttagtgtttttcatgctttcaaataaaaggcatccttacaggatagaatgttttatctttgctcaaatattctaatttctaaatggaggctatggctatggcataattgtatattatagtgttatttatattttccagattgtcttttttggtactttagtatgatgtcaaaaataatagagtagtaaaacaggttaagaacattggttagaattgaggcatctgcatttccattctatctctaccacttattatataatcagatgtaagccaattaatcaaaaactgaccaggtggctcatacctgtaatcccagcgctttgagagaccaaggcaggagaatcacttgaggccagggcttcaggatcagcctgggaaaacacagtgataacaccccatctccaatcaatcaatcaatcaatcgatcaatagaaattagcctggagtggtggccttcacctgtagttctagctactcagggggctgaggtgggaagattgcttgagcccaagagttccaggctgcagtggggtacgactgagccgctgcactctagcctgaatgacggagccagactctgtctctcaaaaagaatttttttaaatcttgaaaaacatttgtcttcacctctaaaaaaaggaattagagtaattcctatgtcatatcactttagagcaaatgagatttgagcaactgaaatatttctatgcatctaagaatacaaatacatataatacatgtgaaagagctatataaatatcatttcttattctaagacaagctttgaggttctcccattttaattcaaactcttgctaaattcatttacatgtctccttaaatctcagtctacacttgaggtcttgaatttgtatttaggagaaggaaagttgacagtgttgtgtgaagtctcagcaggcacctcttctaaattcagagcccaatacattgcctctgatgtcacttcatttttatttcatataatctgcacagacaaaagttcgcatacaatcttgctgcaaaaggaattgcggttttggaccacgaattttaaatcattattactaggctcaaacacatctttattagtcaaagtaggaaccattacaatcatcacatttttgtcaacgagaaataagtttgtttattcctgtagaataaaaatctgtgcttcgggattcgacgaactcttggaaagcattttctgcatcctgctagttgtggaagcgatttccctgcaaaaggttctggagatgcttgaagaagtggtagtcggttggcgagaggtcaggtgaatatggcagatgaggcaaaactatgtagcccaatttgttcaacttttgaagcattgtttgtgcaacgtgtcattgggcattgtcgtggacaagaattggaccctttctgttgaccaatgccggctgcaggaattgcagttttcgatgcctctcatcaatttgctgagcataatctttgaagtaatggcttcaccgggcttcagaaaactgcagtggatcagaccagcagcagaccaccaaacagtgaccacggcttttttaatgcaagtttggctttgggaagtgctttggagcttcttcttggtcgagccactgagatgcttgtcaccagttgtataaaatccacttttcgtcgcacgttacaatctgatcgagaaatggttcactgttgtgtagaatcagaaaatgacacttcaaaacaacatttttttttttttttactttcgctcagctcatgaggcacccacttatcaagttttttcacctttccaatttgcttcaaatgccgaacaaccgcagaatggtcaactttgagttcttcggcaacctcttgtgcagttgtaagagaatcagcttctatgatcactctcagctggtccttgtcaactttctttttttttttttaaaaaaattatactttaagttctagggtacatgagcacaacgtgcaggtttgttacacatgtatacacgtgccatgttggtgtgctgcacccattaactcgtcatttacattaggtatatctcctaatgctatccctccccactccccgcatcccacaacaggccctggtgtgtgatgtcccccttcctgtgtccaagtgttctcattgttcagttcccacctatgagtgagaacgtgcgatgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttcgacatttgggttggttccaagtctttgctattgtgaatagtgccgcagctttcaatggccggtcactatgctcctcatcttcaaggcccttgtctcctgtgcaaaatttcttgaaccaccactgcactggaccttcattagcagttcctgagccaaatgggttgttggtgttgtgagttgtctccactgctttacaatccattttcaacatcagtaagaaaattgctccaatttgctttttgtctaacatcatttccatcgtctgaaatacatataaaacaaacagcaaataataagtcattaccaaaaacaaaacgagaaatgcacattaaaatgatgtataacatatttcacacttaattcagaatgtattccaatatcaaatggcaaatttcaacaatgcaaacactgcaattacttttgcaccaacttaataattgaggcagtttaaacatagtaatttggtatgcagtttatttataatttttagtgatgagaatgttctcaaatattgatatttcagatttcaggtcaaatgttactttttcatggagacctcctgacttttcacaagccaccctcctgccccaccacctcctaaatgactgtcacccctattcctagcatacaacacctgataagttcctctacctccttatgcatgttctttgttgtatatccacagcttacaattatacattaatgcaatcatttgattgatctttatttcagccaggaaactgcaagctgtgtgaggccaatccccatttcatgaaattctcccttaactctcagcatttacagttcctgtattaattgcccattaattaaaattatctaaaaaatgaataataagagctttcccaaataagagagctaacaacgatttttgttttgttttgttttttgaaaataatttgatgatttacactatattacttgaaataatgtcttttagggatttcattgtctcttttaatggcataaaattaagtacaattcttatatataaacgcatatatcttgaataatctataatatatctatattaaatatattacattgtcttttttactagcagacatatttagttaaatgtagctagaaaatacaactggcttgtgaactgaagtttaactgaaaaaaaaaactatgtaaagatagcttcatattgaaaattatattgattgttatcaaggggaaaaaagtgagaatcctgtaaataaatccagttgagcaaatcatagaactgtttaaaatgaataaatcatagacaggaatgaaaataataaaaatactttctaaaataagtaattacttttctactttacagtatgatgttatttgcctgtagtattagaattattgctatttgggaagtttgggttctaaaaatcttaccaactggatttctagctttcgctttgtgaatggggttttatatgcagaaataatattttgacaactgtgtgtcagcaataatcacctgggattctgcctttatgaatcacagtccaaattctacttcataggctgaatagtcaatccaggaacatcaaatttttgacatatgtgatatgtgattcttggtcacttgaaatttttctgactaaactctattttaagtatgtcactttcacctattatgctgacctttcaaggaaggatgtctgattaaattagaaaaacatggcaaaatcttacaggcttttttttttttttttttttttttgaccctttccttgaaacaaaatgcactctgaaaaaaaaaagggaaaacgtggacaggtgctagaaatcagataagatagaatttattctagcgacttttaatttataaaaagtaaaatgttttcttggtgctttaaaaaaatagaagtgatttttctgttgctaacactatgtctctttatgaattgtgttctcttcatcaaaacagtgtttatgttttaggagattggattagaattttaaaaatatggcatgtactatatttcatttcttttactttgatgtaagcttagtgggatttaaaataaaggagacttgaaacataagtgcatgggttttatttcctccagctttactcatgaattcatttgtgctttataatccttacctaacatatattaactataaagttaaataaaaagctaagatgtagtcaaataattttcatttctattttgacagtttaaatatttcatatatttgctataatcattctttatttttttaaagtagatttaaaaatttcaaatagaagacaaaattctgcttctgctagtttctcatattgataacattttttctctaaaacaaataactttggcactaagctctgttttgttgtgcaacttcaaattagcatattttctggtcaaaaatgcacagttattaaaataaaagtgaccaaaaatatacatattataattttaaaagaatggctttcatattcaattcattatacattaaatgtgttgaaacatgcaaaatagtgtatggcagactgaataggtttgtgcattattaagaaatggcctattcctttaatattttataaagagtatattcagactaaacattatgttttcaagcttccaaatgttcttttgtatgaaggatataagaacaagatacataccctgatggaaaggagtttcaactgtttcattccattacgtgtaaaacaagaatttataaaaataattcacacaaaagctttgcttatttaaaatattgcctcctttatgaaaatttttaattatttggacccttaggcttattacactctggtgcttagtttcttttgaaagattaaaaaaagaaattaaatttagtctataaaaactatggtatagtatactttttacgtaagtcccatgtcccaaatgatagtcattgaacctaagaatgcttaatggctatgatgtatacaacataaaccaccttaagtatttctgcaaccttaatagctgtagattaccattactttttttcctacatatgatgctcactttattgagaaataattatgtgaataaaaatattaccaaagtaatgtatgagattccttgggagttgctaaaatcattcatctccattgcatgtgacataagaagaaaaatgtcaaaggggctgatacacttggatttttctgatatacttaaaatcatattattacacattatttttattaattttgttaataaggcagtttgatatacataaactaacagatcaaaattgttacctttaaacttgtatacagtagttgttagaaatgcaaaattctgggccccaatcatgacctgttgcattagaaaccctgaggatggggcccagcaataggatttttaataggctgtccatgggattctgatgctactcaagtttggggattgctgtgttagaagatcgttatctgatgtaatgaggcacacagtacttactaagatattcagctgctgcttgattcagggctgtagttcatctcaacctctaaatacagcactgtgtataattcatgattaatataactgttgatatttttaaaatattggattttacaataaacacacaggaagagaaaagacgcgtttccctggcaacttgggaaatctattcctggaaatttgtcataggaatttatttccaagtcatcaaatttatctcatgtattcttggaatttagtttgaaccacatgtagtatcttcaatatttacaaatacttgtacagtatttatatatctggaatccattgctcatgataaaagagatgatactaaaacccaaaaactaaataaacaatgaattaagtgataggaaaatgggaatacagaattggaaagtccctgtcatgcagttactagaatataaggttgtctgggaaatgactattaactgttcctagagtgttactaggatcagactgtgatgaattttgtgtgccaccctaaaatgctcacatcaatcaaagacaacattttaagcaggtgatcagggaggatagtgtaattgaagaacaaataggaatcagaaagggcactgtaaaagttcccattataggttaatgggacctagaatgagccttttattctttggttatatatcttgaggatttagcatcaagtagaacttttattattttgttaagactccaggaagggctattcttaaaaatcaaatcttcattattttcttttcttttatgttaatcagattatagtatttattataaaggcacaaaacaaagagaagtcatatgtggaaaactgagtaacttgtaggacctatagaggactcagtgaacatgaaaattatctagtaaactaaggaaagcaaaagaaacaaacaaaagagtgtgtgttgggggacagaaaagtactctcgcagtagaagttattatatttcccttctgtataacagtcaatattcttttgggcctaaggttaagaataagctaattttttaaaaaatgtaaatggctacctcccttctcaatgtaaagtgacaagaccaagaatccagcaatcggggagacagcctagcctattcaagaaaggagagatgcaatgcaatgttttaaaagaattttaaccattttggatggtctatacttggatactattccatgccatggaatcccaggaaaactgatagccgcacacttcataggtttactcaaaagtcttcaataggatttaaatcttgtgggtgatatgagtcaatttggtaaactgtgtttgtccagaaattccctgaataaatatgtaatctgtatccgtattgttggatggatgtactaggtagccatttcttaagttgaattagtaacacaattttgatggaaatttgcctatcctgagtgctgaaaaggcagcaaataagccataaaaatattatatgtagaatcttgtgaaaacgtttattgatagagctgcttccattttccattaaaggcagcaaaattttactttatttagagcagtaaaatatatttgaatgagtaatcaaattttagaggtggcagaagcggcagcgactatagaaatcatctagtgcaatactctaattagatagacaagcaattgaggctcaagtaggcttagtgacttgatgaaggtcacgtcattaccttctgggtctgggttcggtgctcttttcattcctcctctctgtggaggagtactggtctgtgcacagtgacaaagaaggatttaagattgtgtagtttaatattatcagattatactttatagaatttcaagactacttcaaccgagtgtcatgcattgcagcagcacccaagataatatccaaatctggagacacagcagacaaaatagagctacttttctcagcaggtgaaaaatgctgatctttcataagcccaagagaaaaatcaggttgtataggattattattagctttccattctcgtgaatgtgtatcccttcatcacaacttgatttatgatccagagactgagctgtcacttgacgactaaagattcttaactcattttctgacaagtagaaattgattttagcttgaattcaaagattaatctaaatctgcttgcattgaaagagtattttcaaatgttgctatgtaactaaaataaatatcacatagtttcaatttctgtataagccaattaatttttgaagatcttttaaaaattagtatatcattttcctacaactagtcttaaaacagaaggattggatatgttatcttctagccagtaaattctcaagatttaaaatatctctaaattgttggctttattttgtgctttctgaactgctaaaataatcactaaatacatgttgttcatatgtagctttcaaaataattggataatataaattagagtaacaagttagtccttcaacaatttttggagactaaaatataaaacagaacaaatgagctttataactcccaaaaaacctttgtggtgaaatttgctttagtgattatctcttggaaaataaacacttttattttctgaaataagtgattctgattcaaagaaaagtttaggagaggaaaacatttaggggaaggttaagtgtaatagcattatttcagaagtgaaaatatatgaggtaatattcgtttctagaacctatcaaattcttaatagtttatgtagcatacaaggggcttgtagaatctttagtacactgaaatttgttcactctgttatccaacaactgctttagctcctgctgtgtactaggtactattgttggcagtagagatgcaaacaatacaatagctaatatttctctaaagggctatatactattcctagtgctttcgatatatcatttcatttaattctcaccacaatcccatgaagttttacaagagagaacagtaaggcccaaagaatttaaataaatcgaacaaattcacaaatctagtaagtaaaaacatcaggaatggaaatcagacaatctgattcccataaaatgcacgtcaccactactttatactacatatggtaagagaagtaagctatttccaaggaaatcttaaagtttagtggaaaagaccaatacagagcctcatacattatgccaagggtttggcttccatcttaatgcaaaattgttatgaagtctgggaattaggatgtttactccatggacttagactagaggtgcagagatcagacggtctaccaaagtcatcagagaaagaggtctaacaagatatggaaaggaggtaatagatgccaggtgatttatgctatctgttctataagaaagggtgtcaactaggcagaaagggggtagagaaatcaaggataatttccatgatattgtgattgatgataactgatgcatgtcttggtttctcctagatcaatgtttcccaaactttagagtacatcagaaccatctgaaggataccacccttatagttatggattgccttgctaatggtgcttgtccaaagatcacactttaagaaccaatgtcctacattaatactaaggctttcgcctgcaaataaatttaaatggcttggtattatgaaagtttaaaggacagaacttcaatgaaactttaaaaagagatgtgatctgttatatatatatatatacacacatacgtctaggtgtgaatatatctatgtatacatctacacatatatctgcatctataacacatatcctaacatacccagtggtatcccatgtgctatttcaatatatgaaattgtttcatggcccctatattataaataatttctaaattgctggaaatttagaagataggaaatttttacacagattcctccaggcagttgaagaaatttatataatgtacttctagagttttagcagagtcaattatgggtattttggaggtagagtatatatagaagctaaaaataaaacttttttctaaatattaattttatattgtatgctatttgctatctaaaactgatagtttctaaaaataattataaaatatactcatgacatttggttgacaaaagggaggtaatcatgaaactttaaatagaattttaaacaataatagccttaggaaatgtctaccatatcactttttcccccaacgttcaatttccctttgaaaagcactgaaatgatagatacaacatttgtagaaattatgattcttaatagaaactttggtctatatttaccgcaatgtttaaatgggagaggagttattgtttaatctgttactagatcaggggctgttccataggaagtggctgtaaataaacagagcatgaaacctctcaaggcacttataagtaaatgagctaacttttgtggccataggcctgctttaaacataccaaaaaaaatctcatgagtattaacattgatttcatcccaaaatgtttacagcaaagtaaaaggatgttttaattgtttaattattggtctttattcaaaattgacataaactgttacttatattaacgtgcttttagagtacttcctcaggaaatagacacttttgaattgtcatcttagaagaataggatatctctcatcaaatactgtggccaaagtgcaccaaaaaaagaagatttttaaaatgtaaaagccatttatttaaattgtacatactttatttttattgttataatcattaggaatttcatggattgatttagaccagtgagccatcaaatctttcaatagcctcacgcagtagagatcccctttatgccttttcaaaaaagagcatggatccggcacaatgctaaatgaagattatgttcaaaaaattgaaatgactgaacagttaactagctgtaacatgtttaacaatagaatggggaaatcctcttttaaccttttagctaattattaaatatcttaatatgaaagaatctaaatattatttatagaatattctataaaatataactaatgaaaaaatgaaaaggttacctgtacaaaaggaactataacattatatttataaaatctttaagtccggaattctgcacgatacctacagagtttgggaaaaaaaattaaattgtttttaatgagactagatttctctttacttttctagtaatacttttgtgtttcttttggaatatacaatgtagctggtctataagcaataattcaaattaaatagaaagctgtcatgttaattaatataacccaatctgtactactaagtggcgttgaaagatcttgctttcacttgattctaggtgattaagaatcagtcattagtaatgtataagcactttttccctagatatttcagagtcaaaagaaagctagaaacaagtcttacccacaaggaccaagtatactagtgtgttttgtcttgttcttgcactagagctatcaaagtcaagaaagaatatggtctatagtggttggaaatttcattctagctgtcaattatttcatgtataatgcgggttttaaaaaaattctttttaaaataattttagatatacggaaaagttgcaaagatagtacagagttgccattctctccacctactttctcataatgttaaatcttacataactgtggtacactatcaaagctaagaatttatgtaggtacattactataagctacagactttattcagatttcactatattttccagttacttcctttttctgttccaggatccaatccagggtatcacattgcatttagtaggaaggaatttttttcttttctatttatagtcaataatatattttaccacatatcattttgtcatcagtttaactttttaaaattaataggtttatttttagagcagttttaagtttacagaatgattgaacagaaagtacagagagttcacatatattccccatttacccccacagtttcctccataattaacatcttgcattgctggggtatgttttttgaaaattgatgaaccaatattgatacattattttaacttaagtacgtagtctgcattagagttcactctgtgtattctacagttctgttggttttgccaaatgcataatacatattttcaccatttcaatatcatacagaatggtttaattgccctaaatatcccttatgctccacctactcattcctttcctcctcccactcatccatggcaaccacagatctttttgctgactgtcgttttccctgtcagaatgtcacttagtgatatgcatgtaagattcctgcacatcttttcacatatgatgctgttttgtgtttgctttgaccatctatgtatccttccagttctacacatgccattttgaattctgagtttacaaaagaagcctctgtccttgtgtgccttccattttgtacttattgaggtgtgcttctttttgaacttagttttcttttggaattattaatggtaacattacaacaaacctttcagtgcagtttactattagaaaatatctgcacatatgaacactttcatttcttttcatattatcacttgtaagatgacagtgtgcatttcttttacatttcttgttatttttacaataccatactattatttatttttgcttaaatggagtgctgaatactaggcttgctcctcgtttccaaacactctgtggttgtgttttgttttggtttgattctttttacagtaataacatatggcaattgtttatattttcaatgcccaaagctgattattaaactttgggtgtttaataagagttgaggaaaaaagtccagaataggcataatttaccaattgaaatataccagtttattgacctactttagttgaactgtttgaaataaattaagaaataacaatcatatcgttcttatagtatcaatagtaagcattgaataaaaccactggatttgatcgatgatttaacagggtaaaaataaaattgaatttaccctcataaaataagacaagttctttttcctttccaggaagaaaagaattcatcctctaaacaaaattttgttttcttgatagaggaggggagacagggacagggattaaaaagttgatattcttttgcctacctgagtcattgttctcaaaactttgctgctaatgaattactttattttctataattcaaacaagttagaaacattctattttagttgtgtgtattacatatattcacaaacagacacacacacacacacataatagtgtatttacctttatatagagattcttcaaggaaatatacaaaaatatttaaaataatatccatcatatcaacttcttaataaaactactgtgtgaacatactcaatttccagatatgtatatacacatatattatttgagctaaatcaattcttagcacagttatttaaagcaatatagaatgatcttcataatatagctctttgaaagatcttatcttgcaatcttttctttataaatttgtctgaatttataacattcaatagcttatatccttccattcttttcactaagttgatttaaatgagtcaaattttttaaaatctgctttttctatattgtctatttcaaataatgtattaaatatccacttagtcacctaatgtagagacctttgagtcaattcttatttgttgttttatttttattcatattcagtatttatcgtttcctgaggaatttttttttctcaagtgtgtctagaatcgatttctcactctccatttcactgttgctttatttccttcagtcaaacaatatcatcaaagaagacaccactgtgtaataatatctttggctttaaaataagttgcataatttagttaaaaaagaaaaattaacatcaaaataataaaaaaatgagatgtagtgttaaaaatgaatagatgctaattttggaaaggaaatccttacagtagttctcacttacatgtgattttgatttctgtgctttcagttaccagaagtcaacagaggtctgaaaacattacatggaaaattctagaaatagttcataagttttgaattgcccactgctctgagtagtatgatgaaatctctctctgtcctgctccatcccactcagggcatgaatcatccctttctccagggtatcctccatgtatacacaggaccagcccattagtcacttagtagctgtcccagctatcagactaactgctgcagtttcacatggcttgtgttcaaataaaccttatttaacttaataatcccccaaagtgcatgagtaatgatgctgccaattcagataggccaaaaaaaagtcataaagtatttctctaatgacaactgatgatgagcttttattcatatatttgttggctgcataaagtcttcttttgagaagtgtctgttcatatcctttgccaacttttttgatgggtggtttgtatttttcttgtaaatttgtttaacttccttgtagattctggatattagacctttgtcagataggtagattgcaaaaattttctcccattctgtaggttgcctgttcactctgatgatagtttcttttgctgtacagaagctctttagttcaattagatcccatttttcaattttggcttttgttgcaattgcttttggtgttttagtcatgaagtctttgcccatgcctatgtcctgaatggtattgcctaggttttcttctagggtttttatagttttaggttttacatttaagtctttagttcatcttgagttaatttttgtacaaggtataaggaaggggcctagtttctgttttatgcatatggctagccagttttcccaacaacacacatatgtttattgcagcactatttacaatagaaaaacttggaaccaacccaaatgtccatcaatgatagactggataaggaaaatgtggtatatatacacaatggaataccatgcagccatagaaaaaatgagtccatgtcctttgcagggacacagataaagctggaaacgatcatcctcagcaaactaacacaggaacaaaaaaccaaacaccacatgttatcattcataagtgggagctgaataatgagaacacatgaacacaggaaggggaacatcacataccagggcctgtcgggggtgggggtaagggaaggcagagcattaggatgaatacctaatgcatgcggggcttaaaacctagatgatgggttgataggtacatcaaactgccatggcacatatatacctatgtaacaaacctgcacgttctgcacatgtatcccagaacgtaaaggaaaaaaaagccacagagtgcttttctaaatgtaaggtttctaagaaaagaaaaaatcttacaataaagttgctaagatgtatggtaagaataaatcttctatccatataattgtgaagaagaaaaaggaaatttgtgctaattttgctttggcacctcacactgcaaaagttacagccacagtgtgtgataagtgctcagttaagatgaaaacaacattaaatttgcagacacgaacagaatcgtgtttcaattgaccgcaatcagttcaatactgtctaggatttcaggcatccactgggggttttgtaatgtaccccctagaaaaagggcagaatactgtatttacatttaacctgacctcaggaataattcctcacccctgaggaattttggtctagaagtataatatagggcatcaaaagatgctagtatgaaggtggaaataatgactactaacaattgagaaaacaaaatgactcatatattagtgcaaaataaattcagtaaaaatcagtcagttctttgacagtagcatggagtagctggtcaaaaaggaggaaaaccagaatggaaaagtctgtatgttttgcctatggaatattaaggaaaaataatggatcgtgcattaggctaggagagtaaaacaccatgagaaagaaaaaggcatttgggtgtaatgatgttatattctagaagtatacaatgtctagaatgtacaaagatttttagggaaaaaatgcatgaacttgtgtgttgattaaatgcaaatatcagtcagtaacacacacatgtgctctctgtgtgtgggcatttgtgcatgtgtgtctgtgtttttaaaatgtattattggaaaactaaaatatttattaaaatgaaaacactaacatataaggcacttaataccagggtcattattactgagaataagagtctattcaagtacctgtttttaaagtatctaaaagataatggagagtagagtttatgaatttactgttttactggaaagagtctcttcttgggtttaaaaattttaccaattaagcagagaagacaagaagcattaagcaaatttatttaaaagcaaacaaaaggaatttatgaataaattaagattttatgacaatatcaaaagttatacaaaatgtttgtgtctttcatgaaacagacatccaaactgaaattaaatttagttttctctaggttttttcttcttaaagattgaaaagttatcagggaaaattgtgcttttaaactttgtgatgacatatgcttttaaggagcctgtataactttcagaataataaaacaaaaatggctattttagaatattccttgatgatgaattaatcttacattgttttccagcatacccatcttaggaaagttctgtttatcatgtcacttatagaaacaactggtgaatgcatctgaattattttcaattcctgtcacttgcatgtcaacttgcaccatcttccgccattcctaagttaggtatttgcaaatagaaaatagacattattgtttatttggagtcataattataaacatataacatattattatttcattggagtcatatatataataaactaattgtgaaaaatagacatcaggaacctgagaataccgagtcagagaaagctagaatgccataatgcaaattttgaagccagcgcataccaatcagagattatagttcttcaaaagagacagaaaaatgggagcatggtttttccattgaaacagaagatactattgcctaaacaatcataaaatattatatggttcaaaggattttatagagtgctggtttctacctgaaaccagatatgtctgacatggttgtatgcacgtctgctttgaaaaatattttcttagtctataaatatttaccaaaagcaatctatttactgaagcggtaccagacattttggaaagtattactttgaggatggaacaaccactattttataatctcagtcatcttttgggtttccttttctgaaatagaaaaccattgaaataagacacataggagtggtatgtcatccatcagacactagtatgtgttcttcccttcaagtgcttggtgtatattaaaaactgcccacattaaatgcatagaataatctttttttattattattatactttaagttttagggtacatgtgcacaacatgcaggtttgttacatatgtatacatgtgccatgttgtgtgctgcacccattaactcatcatttaacattaggtatatttcctaatgctatccctccccctcccccctccccacaacaggccccagtgtgtgatgttccccttcctgtgtccatgtgttctcattgttcaattcggcattacaaaattcctgtggaaaatatgagttgtgggtatttatctttataatatttaaaaagttataagaaactaaaattaagattctttaaaagcaaaaagaattcactggtgtgtgactatgtgataaacaatggaggggtgattgatattaattaataagaaagtttaggtcaaatattctgctctcatctcagctgttataataaacaaattaaatatttagtgagagtttgcaagtaaaagcaccgaaatatatttctgtgtacaagtaccagcttgttctcaggtaccactaaaatctacccttaagcagtagttgtttcaaaggtcctgtggttgtacatccatttccttgtatctctggctctctttttagtgacaatttggatgggaaagtatatgattcttaacggatattgatttcatgctaatgacttcatgattaattatttaagcatctaataagtcaaattatgttaaatcacaccacagacattgcagatatgaaagtctaagtggtagccaacaatttcagattttcatggggtatattttgtcagatgaacaaataattcaaattttaagctagaagtaaagtcaacatggtctttaggaaattcagacaataaaatttgatacatattcccaagatatatgtaacttttatttatatgttttttgtatagttggataataatgtgcattcgttattggaaaaaaagataaatttaaaaggctaaaacagatatcaatagagggtacccatgcacctcatttgggagaccttctagagtaggtaatagctaatatccttcattttatgaccaatagtgatttctagaatttaaaaattcatataacttccccagatgcacatatacatattattgagaaaactccaaaatgttgaaaatggatccatattctatgttactgaaatgtttaccagatatcaatttgaatcttatgtgtattcagtttttccatagcattaattccttacgtcatatatcaccaaaatgacggactgtttcaagtagaccagaatatcatttgtacctttagaacacttgtaatttgacatttttagtatagaatttactgcttagaaattacagcctggtatggtgactcatgcctgtattcctagctactcaggaggctgatgcaggaggatcacttgaccccaggagttagaggctgcagtgagctatggatcatgccactgcactccagcctgggtgacagagtgagaacctgtctataaaaaagaagacaatacagacaagttctaacaccttttcttatttacgcttaacagtagaccctgtagaagaagtctgatcttttaagtctgataataagagatatattatgaaaaagataaaaattatacaggaaaaggaacaactgatgatgcataaaagcagcagaggtatatctaattatcatacctaaaatatgtgccgtcgaaagccatgtgtgtctaatagtctactctcaaatccattatctttactagaagaaacccgatttttattcagacattcagagaatgtttcatatatttacttcactggacttctaagataccattatactggcattctactcagctaaaggagtacatttcccagcttctatcaaattgaagtgtgtctgcatgaaagagttttaactgaagggacataagtaggggtgtgggacttctacaaagatgctgtacaggaaatctggcatttgggtagtgactggcactacagaagccagtcacttggggacattagaatgagagctatgacttagggtcagcatagtgaggagcaggaagaggcagctcactggtgctttgcgggagatgccacagcacgtgccagctgcctatttcagtactgtttatacaagaaaattagacttgtgtatgactgaagattttctaggttcaatcattggagcataattccaaactaatatacaaacaatatattattttaggaaaaattaacataaatcaaacatggatatgtgtataaacgcacaaattctccattctctacatgagcataatagaaataatagaaataaaataaaagcatagaatttaaatattaatatcaaaacatccaaatccattttgtggtctggcatgacctgaagctcaagtaagaaaacttttctccaaattctgtttgcaatgatccacttacctttactcttagaaatagtgagaggcctttacagaaggctgcagaatagctttttgttttttaaattacagattttccacatttaaattttaatattgtttggtagaaatgtttgttttaatgaagacttctgccttaccttgagattattcagtgcatatgtttatgttatctcaaatatttggacgcatattttaattcatttttctgtggatcacgaaggtactcatcaacattatggtgtccttattaatttatatccatgtgttctcttctttacctgattaaaattccaaattctatctctaactcaacaaatgatcagagggaatacaacatacataagtcacctatacattagaattaacataatactctcagttgtgttctggtaaacctaaaacgacctcctcatgctgttccttattatgattaaacactctcagaaactgcacaggccttctctttccacccacaacctcctttcacatatggaagttttaacttagggtcaagaccattcaagatgtctaggtgattttactcatctgttgttatgagtaattctcaggacctaaaacgttcatactgttaaactttttagggaggactaatggaatacatactattatatattttttaaaatgctggaattcacatcattattctttcacttatagtttcaacctccagaaacttaattatactttttaaaaagaacgtgcttacattttccatccagtcaatgttttttacagagtcaaaatatactagggtaaaaagtaaaaaccatctttgaggttataggaatatatttaacaaaaatgactgtgaaaaatcacaaaggaattgttaatatgtttctaaatgaacgaagaaatgtaggcattatatgtggtgaggaaagtttgaaaagattcattacaaactagcaactaaattccagaattttgataattagtttggtaaatttagaaaaatcacccaaggctcagtttgtagtatttatctgtaaaactgtctaattattttttgtctactatttcataaatatcatgtgtgtatttataagctattataggttgatggatataaaacctaaacatagattgctacaataaagcatatttaaataagcaccactgtaataagcactatgctataagttaattactaaatgggctatgtatgcaataaaagccacagatgtttggaaaatgaagagttccattgtgaattgacatgggtaaaggaaaaggcacttaaatctagaatttcagcttcatcttgaagcaggtaaatgagtcagagagaagatgagaatgtttcatatatttacttcacttaagatactatgctctcctgctttaattttttcacacttgcgggtccttcttcattgactttgctgttgcctctttattttcagccttctgcaaaatgtagattcatatatccaacttccttattaatatctccatttctgagatattaaaaggaaaaaagttgttttcctctttttctttgagcccacccccaaaacatatttctcctgcagtcttcctcatccatggccacttcttccttccaggtatcaggccaaaatctctggagtccactttgattattttccttctctcacatttcacttgcagtggtggcaattcttgttgactttactttcaaaacatatcagaaatataaccatttcttacccaccagcaatgctacctttctgaccaagccaccaccatcttttacctattttttgttaaatccaggctccctgcccctgcatgtgtcctattatagttacactctgtgttcatcatagaatgatcctgaatctacttatctcactcctttgctgatgatcctctaaggttttcccatcacattcagaataaaagccaaagtcctcagaatgacctgcaaggctcatcatgatttgtcccccagtgacatctgtgacctgctcctctctccttccttacactgttccatccttgctagtgtccacggtgtctatgaacaagtcaggtctgcttttatctctgagcttcagcacttattcttcccacttcctgcaaatggttcccctttgtcctgaagccatgaggccccccgacatttatttctgttctcttcaaatattgacctctcgttgtggcttgccttgatcactctattttaaattgcatttactgtttttattttctccataacaattatcatcttctaatattctccttagtgcatttacttgttactgttattatttatatcccctttccttttgagcaggagaacaggaaagttttgggcttccttgttttttgggtttttgtttgtttttttttttttttatttttatttctcattctttggacgcataaaaaggtgagcactcaatagatatctgttaaatgcatgaataagttaatgaattaataaatgtaggaaagtgtcatttctccatgattttttttcagaaaaagttatgagtatcaatggactgtgtggtgcttatatactgctaattatgtataaatgaagtgcagcaaaacatagtctcataataatttcaaaaatactgattttggacctagcttttaagatttatttatttaatgaacagctatactgaacaatattttaaattgtttgattgaactaggattaattatataaatcatgtgaaaaatttcaatcatttggcagccattttgtaaacaactcactctatcattttgtaattggtagattgctcaaatgttggaacagtgtaacacaaagttttcagattcaaatagatcatgattttaaaaggttggaactttaaaaaaaacaggattttatttgagacattaggcaattatccatatatttcatctaaagacaaatgtaacacacagccaacttcctttaagccacattaaagcatctaagaacatatatatataaaatatatattatataattataattatataatatttataattatcattgctccactattataaccattagaaacataattctgtttaaaagtttcaaactttttaaaattttttcaaagaataagtgtagttaaattttcttgaagtttattcaaactgacagctattaagcacttactgtgtatatgtctgatagtgctgtacattaaatatagaaagatgaatatatgtcataatccccaggatgaaggcattatggagttaatagactcagaagtgtatgtaaaatcaatacataatgagaactattctaaaatatgaataatgatcttgtacattttttatctgtaatagcttaggtactatttctttatttgttaactatggttccagcctatctgcgtcatttaaaacaaacttctcaaacttcaagaaacatataaaataccctttttctagttatattaataagactatcaagtagcatttagtgggtgtataccttgtgccaagcactagtgacaatatgtactgtttcatttaatcttcccaaaagtccattgacatttcaagcatagtattaaccagacaatgctcatatagataaaagagtaaacaaagtttgtaagaaagatttcagattagattaccttacaattgcaatccattttgattttcatggtggctttttgattgttcatggaatttctgaataagaaaatacattttcacaatgccaggctttacaaatatcatttataaaagctaaaaagtaaagcaaaataactactgttttacaattacgttttaataatgttaacttaaaacttaaaaataaaaccacttctcatataccagtttgtggaggattgagttcccttgagagagtgaaaatatggtcttagtgatttcttttatgagattaccctttctcatctttgaaaacattgaacagattcatgctttatacagtatgtagttgaacgttgggaaccaagtcgtactgcagtggtaggagtaattacagctgtcagttctttcaacatgagaaaacaaccttgtttcaactttacaagaaacagattgtaagtatccaaaggaaaagaaataacagtctttatgtgatgaacagtgtggtgattgttaaactagtaaactcggccatttggagcgatgtatttactggaggccgttgggaagaagatactgtttacgtgcaagtttgagagtgttttatgaatgaacaaacaaaaacatgagcactaagtatctcatcaggaagattataatgactggtggacttttcagagtagagacattgtgtctaaagaaacttgtcttaactgctttcatgtgagttttgtttttgtgtgaaagcacttcctttgtatctgggtgttcctcacatctggtttatttggatgttagaaatccaggacttccttatactaaacaagaagagagcagatttaaaattggaaaaacttgaaaacacattataaaatgaggagcaagtgctcttatttttaactgctctgcaataaattgtttattttttaagctatttgtttaacatgtgcttcttctcttaatctgtgtggagggggttatttggtgtgcttttggcaaaattcagtctaagtgccaaaatcagatgacagggaaactgacagaaaagcaaatccattgtttttattccactgttaggtaaaacttaaggtcctggtttcaagcgtttgccattttttttctttactttgtgaaaatgtttacttcttaggtaaaaagaagaatgatattagttagcaaattaaccaaaaaagttagtgtgcaaaagctaaaagatgtttttaatgctaaacagagcaggaacattttatttaaaaaaacgagaccatgaaagtgctaaatatataagaatataagattctgatgacttttggtggcatcactttcctttatctttacatattcactcatgtccactacacattttattttttttttggaaaaaaaaatgtaactaagggcagccagatggcctaggacagaaaacaggacacctctccttgcctggacagatttcaagattgacactgcatcagtgcacaaatgaatccggataatgtggcagaaacaaggtgtctgcctcttaatatgtagcatgcaaaagctgaaggaataaaataaactttcactgacagttctggtttgcagatatataagaatgaaattgtgatgaagtgaaggtttgtactgggaaagaagccaggatgctatggtagtgcgatccagtgttccactcttggccaaccaaattctgctcttttatgatcgaaccacttattctcaagttctgctttagaaaaagcaagattaatgtggaagtcttcattaaaattcaattgccagatattccttaatgcaactttaatataattttctaggatcgccaaatttaaacaaattctatttgacctttattaacaggcaccccttctcatacttcagctgttatccataacacctgtagcaaattcctatggtgttctttcacaaaaccagatctcttgcaaagttgatgaaaaacgaagaggaacaaggagcatagaatatcatatttcttttaggtgtttctcctgatttcctttgggtcctggaacatgtgcttaagtttacagttatctaaataaccctgctgctccaagcagatgactgttgtaaaggggtaaccttgcggggataaaaccagggcaggggaacccagaagcagagatgaaactctctgcgggctgatgatgtatgtatattgatttcacaattgtcctacaggtactaattccaggaagttgcttctacatgtctctggggatgcagcagtaagtaaaagagaacaaatcatccttggcagtagggtagatagaaaataaccaacactaatatatacagtgtaggtagtaacactcgctatgaagaaaaagaaaaaaaaaaagggaaagaagtcaggggaaagagagagttaatgggcagggctgaaattttaaatagaatcaacagagaaaaccctgagaaagtgagataaatgcctaaagtttgtgaggtcttttctgtccacctcagttgaaagagcctaccattgcttgtttgtgtttttaacagatacttcagtagttctatgtataccattgcttcacaaatattaattcatttgaatctacaagataacacaatgggacacattctattataattttgtagatgaaaacaaaactacaatgaaaataagtaaattatccaaggttgcacaaccagttaatgttgaagataagatttaaacctaaacagcttgactccagaatgttctaaaccatttttagatgcgtctttaaaagtagatttatttctgtggattctaccacttcattgaggattgcctttaatgttcatggtagacagtatgtggtttttcattaggtgacattgtctcttacttctcaattaaggtatacttataaattcttggggctttcttttacactgtctattaaaaggaatgaaagaatatgcaaagtattggttggctatttagtctggtcaagaattcctaaatttgtttatcagaaaacaatgtattattacaaaaaatgttaaagatgttaagcaagataaaataaatgtacaggatgctccttattatgtctgcttttcccagattcataataaatgaacacattaatattttatagatttgagaagtcctctttcaaagagacaagatttgcttttgtatatcccgttgcttctcaaacatattttacagtgggcctcttcttctcagcaacaactgcaacattcaaaggaccccaatgtgctaaggagcattcttaataaacagtgccaaaagagtactggatcaagctgtcttccaaatttggaattagttctatttgaaaggagtggaaacttggtaggcaaatacatatgaaaaaatacatatatttgcccttaattttgttaaagaaaaaattcctatgcatgtatttggggaagaagaaaagaaataactacttttttttgttatagtcctaaataatacatcactgtagggcaagggcaatatattataaatagcctcacccacatttccttaagcatatgtgcattatttacctaattcattaatatattagttcattttgtactaatatgtctggcatattttcaaatgtttctaatgtgattttactgattcattaagtcaatatttatcaaatatctactaggcattttgataatcaaagattttatttttagcatcatttctatagccctgattattttacacaaaactgaagttccttttaccaaaatcagatgcatgttttatgaatcagagctcttagttgtaagcattggaaacctgctgaagctgatttagtcagaaaataaatttactgaaaagagtattactaacccagctcagaaagtggctagatacaagttagggagggtacagtaaggaccacagcaagcaccaccaaaatccactagtgaagtccctgtaattaccaccaccgttagtccctggctatggtctcattgacaccacgacaaggctgtcaattgaagtcagatggcattgccaaagctgctgccaaaataataaattctccactgcctctcactcccattacagagttctgggcaggaatagtcaatgaaaccaattggaactacagaaaataagtgaggtgtatttgatgattgtgtatctaaatataggaaagtggctcattttcttggaatccaaagcggataaatatcttcatgacccccaacattaattactattagtgctataattttcatcatttttattattacattgtagtatatagaagtactcactgtaatgaaacatcttagcttcacacggtgatttatgagattgtgttgaggtataaaggagattaattaagaaaactctaaacaccaactaggctttatatgggctatgagttccttccttctttgcttccttccttccttcctcccttccttccttcttttccttcttcctatttttgtattttttaactttttcttcaaaaataaaagaaaaattatactagatttggaaatatgactaaatactacaataacccgacactctaagaccgttatcctaaagcagtataccaaagagtttgaataagaaatgatggtaatcaatttccttacattccgttaggagaaggaagtttgcaaatgctgtaaatgaacataatatataatatattagaaatcaataatgtttggaacaatcagaatggatctcacatttcttctgggggtaacagacaacaaacatataataaatacataaactgtatgctatgttaaagtttgaaaagggatatgaaaagatagaaaaagcagtgtagcatatcttgttagtgtctgtttcttacagaaaatgatggtaatatttagattgttttccttaggttgtttggagaataaaatgagacttcatgtgaaggccctctgaaaagttgttatgattacaaaattgtcaatattcttaagtaaataattataaataactgttcataagtaaataaagctttatattccacaagtcagagaaaagtaatattagattttgtgtgtgtgtgtgtgtgtgtgtgtgtgtgtgtgtgtgtgtgcgcgcattctttttctgtgtgtatttctttcaccaaagtttggatcatgttgtacagcaaacttgtatctttttaattgtcagccctaaagattcaaccctaaagctttcttcaatattgtcacaaacttggtatatctctttggcaactgctttccagacttttaataggaaatccatcagcaaaattttcactttttatagtctcctcagcttacaaagttgctactgtctcaaacctcaaatatttctacattaaaaacattttttaactacctatttcagagtggttctccaattttttggtctcaggattgtactctaagaaattattgaggttttgcttatgttggttatgtgtgtaaatatttaccctaatggaaattaaactgggaaatttaacgaaattattaatgcatttaaaaattagcagtaagtccactagaaggatgttaccatctgagtgatgatctcatctcacatcacgcagcttctaaaaatctccaccaaactctggtaagacaattagagtgaaaaagacaaacattactgtactgttactatgaaaatcattttgatttccctggatcacactttaaggaccatgccatattagaaactagaataaaaaaggaaaatgtttgaatgggtaacacattcacatggttacaatttcaaaaattatagaagaaatatagtgaagtctctctccacctctgccagtaagtcattgtttctcctctctcaaagccattaatagtattagttatgtggttatatgtatacaaaaattgtgtaatgtttacatagtataaatataacacctgcttttatacaaattgaatctttcaattatgtcttatagcttactttttttgaaatctaacaatgtatcttggagatctttcatataaagagcttccttgttctttatttttatgtttgcatagtattacagagtatggatataccatgatttatttaattagtttttttactgacgggcagtcattcattttatatatacatataaaacaaaaacagtggctgtaatgagtaaccttgtgtgaatatcctataatttttattattttaaatctgactttgtctaggcacagtgatttatgcctgtaatcccagtatttcaggaggccaaggtggatgagttgtttatcccaggagttcaataccagcctgggcagcatggtgaaaccctgtctctatgaaaagatataaaacattagctggatatggtagcatgcctgtagtctcagctacctgagaggctgaggtgggaggatcacctgaacctgggaggtagaggctgcagtgagccatgattgcaccactgcactccagcctgggtgatgggagtgagactctgtctcaaaataataataataataatagtaataataataaataataataaataataaacctctcttgcttagtgagccttcttatccaagtgaggtaattcacttaaaacacaagtaagagatttacacaggaactgggaattagatgaacacataattatcctcagagcaggaatgcttgaggctgaaaaggggtattacttaaaattaaaattggggataacatgtagaaagtaagacaatcctggacatattaggtaatttggtgtcctggaaatcatgcattttagaaatgaggaaagcaggagtaaatacaggaacatgccatactccaaataaattagatcagaagaaataaagtaccttattaattaataatgtccaaataatctatttcagccattgtgaatgatgatgttagttttatgcaaaagcaaatgcaatgacctagcagaatttgttctttgaggatctgatttctgctcattttctaaaatgttccttcactcagtattgttctcttccttcctctcttgcccagaaatcacttgtccaacctctctccttctcctcaattgtagtttgggttcccctgaaatcagactgtaggaaggcattttgtatgctgaatgtttagaaaggagtgcctttgggattcaaacctgtggaaaggaaagaaaggaagcaggaatggacagaaggtgaagtgaagctgtgatctagacctaccaagggttttagcccaaccctgcatgctggaactgagaggggcttttagaaagatcttgaattgggctgagattgcaaggcctttttattcctgcaaaatcactggatgtgccacccttgggaaggacctgaactctaggacggccactccatgcagcaaagacaatatctgaaagggttgaaagctgcagggtgtctgctgacagcatcccagcagccggggctgcagtccttcaatgaagaggtattcaggtggcaaattgcagtgtcagcctcttgtatcaacatagtcgcacaacaaacatgattcatactaagatataaatgattaaagtttatatttaccaggatatttcattttagcatgagcaaaataaatgagccaaattacaggagtgattatagctttaggatcattcacacctaaacttgaaccctgccattgcctcttattcactgtaagcttcagtttcttcttctataatatagggatgatgatacctattttggaggatagtgtacagattagaggttatattttaagtaaaggacttaagcgcctagtacatagtgagcatttagcaatgatgacttatttttaatgagtaatcataaaattgatattaacttgattaacttttagtttgatactaaatactttgctatgattttgaggggtcgggggagaagggaacaataaggaaataagaaagctttcccagaacatctcatttatgttgctgctgatgctttatactaacctttttatcatattttttaatattattgattttattacattataatagcaatacctcatattcatatgatataaaaataatgtgtagatgttttgtgagttcccttaatatccaatgtatacttctattgaaatgtgggaatgaaactttgtaaataaactaaatgaatactagttgtgagtatcttaactacacacctgggaaatcgaggactcttgtccgatttcccaatcagacaagattgtgagctgtgggtctctgctgtagctgggtggcaggtataaatggaacactcctgaacaaatcagaattaattgccaagagaacctacagtgttactttcaaaggatgatggtatggggaaggaagagacacaaaaacccattctaaagtgactgttttctctttgaggtcaataaaactggtctggtggtttatccaggtgaataagaggctgattaaggaatgagatctttaaatctgattgtgcctagtttttttgtatagagaagtcaatagttaggagcaacaaaccagagtaccaaataatattaccatattattttcaagggaatagaaacatctcaaattaatccagtgatgattttgaattcttcagacagaggtagcgtttcagacataaaggagtagagaagactaattgatttagcagcgcatggatctaccaggtagcctagacaaggaatgtccaatcttttgtctcccctgggtcaaattagaagaagaataattgtctttgcgccacatataaaatacactgacactaacaatagctaatgagcttaaaaaataatcaccaaaaaacttataatgttttaagaaaatgtacggatttgtgttgagccacattcaaagccatcctgggccgcatgcggcccactggctgtgggttgaacaagcttggcctagacacgcccccctaaaaaatccaacaaacctttgcagagtgtatgctattgctgggattaactggaaatctttcttggaagacatttttcagacctgtgtcacacctgacatctgaattttcccattcacagcttctcttgccctttggatctgcttccacccagacttgctgtagggtaaatcccactagtttttctgtcttcctctgaacttactagaaatcttccagcacaaaattctagatgccttcatgatccttttcttttatggagaaaaaagattaagtaggccaaggaaaggatctccagattattcaatgaaagtatatgcttttctgcccatttactctctagagagcatacaattagtgttaatagaatgtgtgctggtaggataatgccccagaacaccctgcagaatagtcacagtatatctcagggactagaagagagtgtttaataaatgaaattatctgataatactacatttaaaatggaggtgtatttacacaactacacagagacaacttgtagtactactcaaacaaacaaacaaaaatctttcaatgcagcattgctgagtcagggttttcatatccttatacttcagaaactgtttcttatttggcttttaaagattgcaggtccttcttagagtctttctgtcacctctgattttaatcagtgagggattaggaacataaaacagattaatacaggagacattttgtaagtgattctaatgcaacaacattctagacaatcccactgggatccatgggaaaattcaacctcatttcttttgtagctacaattgaaactctgggaaagctgaatgagaacacaaagaactttcacttaaaataagacaaattgccaatgcttaactaatcctcaaaagcagatcttcctaagaattaaaacgaaatgtcatagtatgtaatccacccaacatatattatctgtatataaaacattcttgaaagaaattatacttttcgtaataattatttttaataaatgcaatgcaatgcaaatatatttcaaattggttcaatcattccatccccaatgctatcaccatagaacagaccatctcttaactgttctaatgcatggattaaaaacttctgtgctcttctgtgcctttcctctttccatctccatattgtagtcaaaatgatccattcaaaaatgcaagtcttatgttaattctctgcttaatttttaatgttattaccttcaaaaaaatgtgttacttttgtattctccttttgaatccttgatccaaatatcttgcatctttacatactcatcttctgaaataaaagaagacatcagcttttgtgcaacaaaatcctgactcctttccaaggctgttcaggccttgaatgataaaggcccctgccgttctggaacttggtcatgctgtggctacactggccaacaatcagctcctcagaaacaccaaatacccattcagggcttttgttcctgtgttttcattttcccagaacacttttccctggctcttcaagcgccgttcaccctatggtttgttttagatgctatcatcatctttgttttacagatgatgaaactaaagccagagaggttaagtaatttgctcaaatgctcattaatagcaaatgagtggcaggattaaaaccccggtgatctaactccagattcccggctcttcactgcatgagatctctgtcttagcacccttcaggtctggttctcagcctaaacgtccgggtagttttccctgttccaccgtctaaagtaggtttaagaaccaccttcatcttctcattcttcgtttatcttcttcttcatataatttatcaaaatttgtaattatttattatggtagttgttcagctttttaaattgtacactaaattatgaggtttctgtgggcaagaccaaaatatgcccagcacatatactatcttttgaacagaagcactcactctacacatttttgcttgaaataactaaaacacatggagaggaagggtagttattggatgcctgtaacttttgaaaatgatataaagtctttaaattataataattgtttttttctgattttttactctgataaccatgttacaagattctatttcattcaaacgtataaaaacaacaccaaccataaaaacagttctttgaaacaatgaagacaaatcaattatcttctatccttagcatttctccctttctctcccaaattcacctgcttcctctgatttgctctccttttttcttttgcttcttggaattatttgcatataattagtttccaacacagtgacatatcagaaatgtcgtactctcagaatattttagaatgaggtctagggagaacctaaacaaaatgcacccttttattaaattgacctgacaatattaagggggtgcttttgaatggataattctttgaaagcatcagttaacaaacagcacaaaaacacaagcacagcaacccagcaagtatgatgtattatttaagaaggggttgagtggggtctttatctgacaagtcacaggcagaaaacacattcctgcaaattgccccatttctcctcaaaatgtgtctgaggtgaaatggagcatcctttgtttcgtacaaagaaaataactcaggaaaatgacagtttagtgatacatatcctcatggtctaaaagtcaatgacctggaaaaaaaatgatgaaaactaatttgttttaatggacagatagtattgtatatttttatcatgtacaacataatgttttgaagcatatatacattgtgaaacagttaactagctaatagatgcattacatcacagagtttttattttgtgataaaagtacataacattcactctgtttacattttttcaaatataaaatacatatacttggaaattcaaaggacatataatttaaaatatcacatttatattctctttaatattttctattctttcaataagaagataaagcataactacaagatttagcatgggtaggggtagggggagaaatgagaaaatgaagtagggagaaaagctatttctctcccctatgtggggagaaataacattacaaaaaagaaatagaagctaaaatgcatcatcttcaattgtgtgttatactaactccatagtttgaagtttgtgcttattagaaatcctgacatctgtgaatttaaggtagttgtctctgtttttgtcttaaatgaaagtcaaagttgaatacactgaactttctgaggagcagcagaatttcaagggttccttcctttagaaattatagggagtatctgaggactaacttgatactggagaaatatttgcacattgctaaaacctgttattctcttttcaactggagcaagatagaattcccacagctaggtcattactatactttgactcctaaactctcatgtttatactgtgtctacatatttgagaattgcaaaaggtgggaacaacactttcttcactgatttctattatttattatatacacatatatacacacacacaaatatacatacatatatgtacatatatttttaaacaaaattatgattagcattttatttgaagagtgcaaagtacctaaaagtcactaagacaaaggtttgaagttgacactggataaaaagacaaccttgaaataattttaaagtttgcaattaacacagatcacagtgtggcaagtaaaagttttaatagcagactggcccaggccttgaggtaaattatgcataattattcataactgctatttttggcttgcctgatttgtcctagacctctggctgaggaaacaatttgaaataattagtgtactagtgcattgacaatgatgaatgaattgaatacttcttgtgccaaacatagatcttgataggaagcagataactttgacaactgtggtattttgttattagatctctgaaagtggaaagtttatgttattttttgtgattttttatagggtgtttcataagtcattctctaatgtcctcaatcattaatgaggctgtgattaaaaacaaaccaaaaaaaatttaaaaacagcattgatgtttatttataccaaatttttacatgtttaatgttaagagtttaaactatgatattctaaaaataacttcatggtaattaagagacttcctttcaattttaatttcatgactaaattagagtttagtatattatatcaaaactatatttaagaaaaataatacagataattaaacacaatgcttcttgaaatagagaagctttaaatttttcatatgataattagtaattttttctaaatattacaaaatgcatatttgcctacctgttgagttcctattgctaggaaacaaaaccttccctttacatatgttagtatagaaaataattttcaatgattaaaatatgcaaatgtattgaaatttaaaaatttagaaattctggtacaccatcaaaaaataaaactagcagaaaattatagaaaagtctcagagagatgtttttccaattcattgtacataaattatataaagctcctcttttaattaagcaaatactcagaacacaatatattcgcatttttcagtagaataaacactaacaattgtctgtctggagacaactgttccttggctggaggtttggacagacaggcaatctttgttttggtataaaagcatcagcccatttaggtcacctgagtgaaaagaattagacttattttttctgaaaccataaaataatttaaaagtataaaaagatgaattcacagacaacctttggcatctataataattttatcactgctaattatacatgtttttttttctaattttaaaaggttagttagggcatccacatttgcagtaaaatttttttatagatattgtacatatttttcagaccgaaattataaacatttatattacacaggcacatagtagttgggtcttagctgtgcttctgaaatacagcatctaatcaatgttctcattctctgttacttataaccatgacaaaattatttaaatgattcttgcttttcatgtatagaataaactgcaatcttaaataaactgctaataaaatatatcaacttgtttgataactgttatatataaactattattttatgtaactcttacccataatgaagagataaaaaatcacacaggtgaccatacagtgtttttgtgtatattttcagatatcatatatttcaaaattgtgcctatgaccttgaaaaagctgtttttttgtgggatcatatggctacataaagagacacttctcttaagttctcttgcatttattaggtttaaagttcaaatatatcatttcttcagttttactgggatgtatgtaaattctacttcataaccttaattttgtttttttgttcatattttctgatagtagaaattgcagcattcaatctactttacctgaagcctttgttaattagatacagttactggttttgacagagccagatgaacggctctgaaagtcaacaaactctaatattgagattatagcctcggcggggcgcggtgactcacgcctgtaatcccagcactttgggaggccgaggcgggtagatcacgaggtcaggggatcgagaccatcctggctaacacgttgaaatcccgtctctactaaaactataaaaaaaaattagccgggcgtggtggtgggcgcctgtggtcccagctgctctgctcgggaggctgaggcaggagaatggcgagagcccgggaggtgcagtttacagtgagcagagatcgcgccactgcacttcagcctgggcgacagagagagactccgtatcagaaaaaaaaaaaaaagagattatagcctcagaaaataatgatttaatcacagaactagaattacttaagtttaaacctaaggatacttggcttaatctgtgagatagcttttattttattttcctcataaggactttgtcatattggattactttggacccaaaccttcaaggacacttagcctggctctctgtcctgatggaaatggaatagcggtggtctgggagtgaagatttccactggtctatggaatgcacacaacttggctataaagtgtagccaaggagttgatgacatacgaactagttcttctacacttttcttctgagacaggtgctgttgcgactactcttgctattgaagtgaagatagagcaaaagtgtagacagtgggatcccaagctcaaatataaatatttaaccctaagtatcagttataaaaatgatacgtttctatatgtcattgcagaagagaaacacttggggattttgagacccttgagtgaagaaaaagaaaaaacaagaatttatttgagagcaatttgagagcaatttttgtgaatgctcattttggttatttttgttaatattacctagaattaagttcagtagttttctggtctagtggatcgttaaatagaagatgtttacagcatgaagagcatatgctaactctttaaaaccattttttttttttttaagaattgaatctgatacttttgcttagctggataagggaggcaaaatttttaacagattgaacactttaaaaaggcttctgtttagtatcacattatgggcatgcattttcagattggtacaaattagccttgatattacatgaagatttttatgtctcaaatttatcaacgttgtttcaaaaactatatgaagaaagaagcgttttacccactaaaataaaatgaactgttatatagcaggcttaactacctctgtggtaagttctctgtgagagaatataaaataagcatattttatttttcaaatgcctcttgtcatttgaagccaagcagattcaactttgtggcaatggctacatactgaactctatgagaacaataatgtctcaaattgattgaatatcactaatcggttctaaagaaggtgatactgtctttaagttggaagcaattaattttggtgtacaatgaagcaagcaatggatataataggtgtttttcttatgacacaaattgataacttgattttgaggcttatattgagtgaatgtcgtgggaagtaattttacaaactcttctcacatttgtttcattctaagaaaatggtgaatgataaaataatgggaaagaaaacagcatctataacttattcaggattgcacactcttttcttaattgctttagggtacaacttcagagcttattgctaaaaggttatatgttttccttgtgatgtgattttctaatcacggggaaaaaaaatatgatatcatcccaaaggaggcagttgaacaaaagacaacacataaccagaaaagcaaaggttcatggcctgacttaaaactcctttgaatcaggaaccaccttatgatcacaactgccatgtttaaatgcatgactcagagatgtgcctatcgttgataacattagcgggtcattgtgtaagcctgaccataatctttctatagacagaagccctctgtttgggtggaaggcttaaaaagtagtgttctgtgagatagattgcaatttcttccattcgcttttgtttcttccttcttcgtaaccaaccgccccttcttctctactcccccaccaccccctttacgtctgaagccatcaattcatgtatttaaatgtccttggaaactgaaagtaatctagaaggttattagcatattgttataaatgttaatggcctgacagcaaggatgggctttttcttttatgcgtgttgttgtgaacattgtgagtttaaatggggtaaatcttccccattcagagtgttgccctggcccttcattcacatgtcaggagctcattgtgtgcccaaaccttgtcagaggcttctagatgtttagtggcagcagcttgccattgagagctgggaagagggctgtttgggatgggggaaagaccagcctaggcagccaggtggtggccaactggccagtaactgacagacaatttaacctaaccaggctgtacagtcaggcctgcgttacaaaagacccacatgtgtccttagcaagcttcattaactcttttggctagggctgtactcctctgacatattaattagttgcaatgctttctcctactccaacttaacctttccattggtcactcgattcaagtggatccattggaagctattagaataatatgcaaaataactggaaaaatagctgtaggaggaacaagattccctatcacttcactgattttgtaagaaacaacaatgttgaaaagaaaatgtgtgatcattaatacttcactcagaaaggtgatctattccatattgttaataataacaggacatcaattacagtgtaattatgtgcatgtcataggtatagaattgtcatgatttattctgtctctgtaataaaaataaaggaaaatactataaaacaacattttgatgtattttaggttatcttaatgaccagagtgacttgatgtggggattataaattggttcagctttttgagtaattttcacaagttaaagtcttaatgaagaagaaattgcaatattcaaaaaagttaatatttttaatattataacaagtacagtattcagaatctgtaaatatgtttcatatgtacataggtagagatagatatacatataaatgtatccaccaaaaaagatgagttttttgtgtactccttgatattttacatttcataatcaagtgctgtatcatgtaactctaagtagagatgcatcaagtattgaatttaatgactattgaatctaatttgtatcctttgtttgttttgcttatagaatgttttttgtcagaggtattctatacgcataaattaaatgtccaaatttaatttggaattcctaaaatccaaggccaaaaatgcattttatatatcaacccttacataggcagtaaatcttcagtggtatagtacttttaacttctcacagcagataagtcacctctcaaatccattgggtgagtaaactcagtttcattttatcgttttagatactgttatttttccaacttaaggaaagtttcatattacttagttcaatatcctaaagaaaaaaatagaaacaagtacaatgtgtatacttattattaaatgtttttattagctatgtaaaatcaataattctaaaagtagattttgctttaaactgtattaccagaaagagagaagctgtattcaaaacctgatgatgagcattgtctgcttactttttggtcagcttcactgtatttttcctcacaataattggttaatatgagtcaggctgactctaaaataagcatatctgaggcaattcttgagaactaaaacaatgtgtttagttttaagttacatataaaaataacatactgtcacatttcaagaaaaaagaaaaaaatgatcccttcaacattggctattgtctctaaaacatgttctataaaaaataaagtaaattaaaaaaacatagtgaacaaccacagtctggtagcaaacatgcattttattcccaaatcacacgtgtgtcttttgggacatatattttgggaaaatagttgatattggtggtagaagcaaggaaaaattactcggcttttacagagaagaaactcaagaaaaatgctatgtaagaaaaatgactcatggagataagttataatagttttaatttcaattgattttaatttaattgtgaatcttagggactcagaaatgatctgttttctgttggtgaaagctgcacattaaatatcaagaggtcttaggtttccgtgatactaggtgttctcatacttagatagtctcatgtatttgcatagtaataagattataatatctgtctctaggagtgcttaagtcttctttatcatccacgagtaatctgaatatacctgatcaaggcaaaaatgtaagtgtggtcattatgagtatttcattattgtttttatcagggaaatgagattatctgcagctacatacaatgagcttattatctgttagtagattgggtctcttttttaatccatttctaagcagcatgtgcatttacataatgtacatatcacttcaggaagtaaaattacaaaaagattgattgcagagagtatatttaccctatattctagcaagttcatcatttttttaagaatccctgtcttgaatgtaaatcagaattattatatccttaataatatagttataaatcagagccaacagtcttagaaccacacatcttaatgaagttactttttaaaattaaccaccaagttaaattatgaaatatatattagagtatgatatttgccaggtgataatactttaaaaaagatggagctttggaaagaatttatactaatcaatttaataggatataaataattataagatgttttgaccctacatttttaaaaatcaaatcaaatttggtaaatctgataagaatagcatgtgcagaggaaaaaaaaagcatgaaacattgtgtgaactaatttggttgtctccatttaattggaagcatgtattaacattctgtggttctgcataatactttttctgttaaactaagcttcaaaaatctggtaacaataggtttggtaaagaaaaaaagtgatagcattttttttttttttttgtaatctggccttgaaactttcacctgaggaaataagcatgtgttggttgtatttggcagtagaatgttacctttgaaaataggccctttttatttgatgtgatccaaaataaagctgaaacaaattgggtcacaggtgccaacacttgataatttacagtgtggtaaaaccgagtggtgtttgtaagtataatttgctccgggaaaatttgaaaccactttaagttggaaaagtgtcaatattttataacatattttataccaaccatacccagattgcaagatcctttctaactacaagctgtagttaactttcaactattcatttaaatttgtggcttacaagtgtagtgtaaagtcactggtcatttattaaagcacattctttaaatattaagacacaggaattgataaacatatatattttagtatgtggaagtttattttgaaccttgttgagttattaacttcaaaaaaattttgaccaaattagtaaaattatgtttcagccttattggctttatgacatttaaaagattataggcgttgaagttcaaaaactaatattattaaatattagtaactaacattattccactttaaattttgatttatacaagttaattaaaatacttcctaaaaggacgggttgtcatctaaaattttccttttggtttctgaaccatgcctgcgattctattctggttctcttatattctggtacccttagcattgaaaaaggaaggaggaagaggagagagaagggcaaaaacatcctattctccaggactgaattcctccttctgattagagttattctgttgttattgttgtttttttacagttgttttcgttttggccaccactgacccccaagtgatgctatcttgtgcaactttgcttttattttttgtttaagtttcagatatttttgtgagatattttgtaatactttaatatagaatctgaagtttcttttagcattttcccatttcatttctcattttgtgatacacatctcaatatattccaatttggagatattagtatatgccactgtagaaagattataggtgttgaagttcaaaaacttgacttagaaatatctttttgtggctggacatggtggctcacaactgtaatcacagcacttcaggaggcggaggcaggaggatcacctgcggtcaggagatcgagaccagcctggccaacatatagtgaaaccccgtctttactaaaacgtgcaaaaattagctgggtgcggtggtgcatgcctgtagccccagctacttgggaagctgaggcaggagaataggagaatctcttgaacccacccaggaggcagaggttgcggtgagccaaggttgcgccactctactccaccctgggtgacagagcaagattccatctctaaaaaaaaaaaaaaaaaaaaaaaatatatgttttttcacctactgtttattcttacaccagttacttaacctttctaattctcaggaatttctcttgcagaatgagagtaataatacatgtctcacagagttgctgtgtgcaaccatattttgtaaagcatcttacacatattaacagtcttaaatcttatttagaatcatagtgttacaaatgtatttaactataagtttattaatacatacatcataaaatccttgtctctgttggcatttgttgtgcaaaccacttggaatttatctgtaatataccataggaaaatgaattgaagaaaataaaattttcaaaatggctttcaaatattttattttaattttatatggagattaaaataaatacatgcagatatttttcttaatatttcagattctcttgtaacaacaaataccaaatacaaaaacacagccacatacaggacacatatctcacacacacacacacacggttttcttagacattgactaatttgcaaaaccaaacgcttacttatatgtagcatagcataaagggttcactctgcgtgtgtgtgtgtgtgtgcacgtgtgtatgtgtgtgtgagttttatcacttctcataatcatctgaaatttcctaaatattataagagtagtttttcttcttatatctgattccacatcttaacaaaaacttttacctctaagcatggacagaatgctggttagctacctgccagcaattctttacatctgatctgcaaaaggacacttgtctgggtgttgtgcatgccttggtgtgcactgacaactgagtgttaaaatctctgggggacatccagagcgaccacaagtctgaggccttggattacctgtccacatttgggactgtaactgtgaaaaaagatttctctctcatacatctgccttctctcttctgatttgatgttccctctcccattggtaagatttcagtaaacaacttcaaagactgacataggctgacagcacacggcagatgtgaagggttacttcctttctcttttaggtttcattttttaaaaatttttgaaattatcaattagccttaaggtttagtttgttagaaagggttttgaaaagccactcaaattgccagaaaatgtgaaggatagcaaatcttcaaggtgttagttcaaattagtggttgctaattaaatgcactgttttatcaaatcactctgtacatctcctgtgggtaatttcaactgtagtcctgacaacatttgatgtgttttatatttgcattcactgtttttgatgcttgctttatttcctcttcttctacctctctttccctcactcgttttattctctcctatttaaatactgtgctgttcaattaaatattgattgattgatttactacactcagaattttccaaagaagactgagtcacaaagcaaaaatataatgtctaatgataatgaacataatatcctccaaaggaaccaaagtattagaggaaaatcccaaggggtgaactaaattcatatctatttgtacatttacatttttattttgggttctaccactgaaatttttatcttctttgtggatagtcttaaagtgttgattacaattattctactgaactttttcaaggtgcagttcccctggcatgatgattctaaaacaaatatttactaggaataaatgacattttaagggcttataatcaagagacatatgtagccaatagatagatagatagtaaataatttcaagtcatttttatgttattacatcttctaaatataattttgatttccatgttgatattcctttattccatttgtgcaaagatggaactaaggtataaagaaatgctgttagcatacgtataattacacatacattattgttgaggaaggaattagaaataggagtctggctgtggagttatatgtcatagcaaagatgtaccaactgttttgaaagaaattcttgttctgaatttttagtccttggggaataatagctcctgtgaatccattatttattactgtagatagtacactatctatgaagtttgtggattggagcagatattgtttagatgttttagatgcactgaaaattatattataaaaccttttctgttttattattaattctgaataatataatgtattaactaaaataataatattttcaatactgttatatagaatcctctatttttaaagcattttgagtccataacttctatttgttgagccacagaagaaatttatattttatttttatgggtaaaagaaaagtgttttatatcagttactgcttataactagcatctgaatcttgagaataaccttttctatgtgtttaaagtcataattttattgcttttatccattgtgtattaaatcataataaggtagtcaaagtcaataaatgtttgtggtataaaaactagatgtatattatattattaatgtgggatgtttttctaaaagcaaaatggtacaaactatatcgcttatattttataaaaattttcatttttctttttttacttgaataaaataatttctttatacctaatgaaccatttgagtagtgttatttgtgtttcttgcaatgttgaattgtttcatgtgcatttttatgtttgccaatgattcaagtattgtgaaattatatttgagatggaatttatttggaagactaattaatatgtctttttctaatgtttttcctactgttatactgatctctgatatctcttattcctccctcaaaaatcacatgggaatggagtatagatagttatcagagaaggggttttaaaccagtctaatttctttaaaaaggaggggaacttttataattagttaccaccatttgcctttatttttcatataataggatacttactccatcatctaataagaaataaatcatgattcatagtgagtctctttatgatctttggtccagaccagtccaaggggaatacaagcataaagtctgaatcttctctcatctttttcgcttagattgaggtcactgttggggcagagcagggaactgtgtggttaactgtagtgaagacagcctttgagcccaatgctaagtgttatgttcaaatgttgccaatatttttaaagtctgtaaaaaaaaaaaaaaagatcttcaaaaaatgtggacaatgaaatccttgtctagctcctttttcgctttttcctattaacacataaagtcacaaatgcatgttaccaagtcaaacatactcacacttgtagatacatgttcccagcagggtttcatttgtgcttagtgctgcggtttggtgaaaaaccctctcatgtgtatagttgttttcatttttgagcttgtcacagcatgaaatcagtgtctcactgagagcagggtttttttttttcaataccctgagacttagaggctaagtaatttaaatgtttaaatatgcagaaatacaactcaagtgcagttcgtatattcatatcaatttctgttataaaaggttaaaacaaaatgctgtaatctgtagttgagggtgtttagaaaacctgttctatttgtttccgtgtttttctacaacagcataaatttcttccctaaaaatctacaaatgcatagtgtgccaattaaatgatgtcaaaacagctcaacattaatttttttttcatgaaagctttcttacctgctatacatctaagatatcttaaatagaccaggcttgaatgtggaaatatttaggcattgtcctttatgcaattccaaatctgattttttttttaaagtaagttacccactataccataaacagagtcagaagttagtttctcttgattttcaagtctgtgtgtattcagttccctaaaaagaaagatgaaaccattctcttaaatttatggtgtgtatatttactgactggcatgtgacaggaacactggttagaaagccacagcattatgatgcattgggtcaaatattgttttgacattgtgcttactttacagtaatcaacatattaaactgaggagcatttccttatatatgcaaaatgcaaagtataagggcagcagtttagtagcgttataaggccatagaaggttaaggtttgcttgccttgtggtgcagctgataaaacaattggactgtttccaaaattccttgactccagctttgtcatttatttttctctgtcgttattttttaaggaaaaaaatagacttgtttccatgaaactctgaggtggcaaacctgtacttcacataaaataaaaactttttttgtaagtgaagtgcatatgggactactctggcaagtttagtttgtgtaatttgctaagacttgcttgtataggaggagctaaaataatttccagagagttggaaaaaaagagattttgtcacagccttttggacaagatgttgataaaccaagtgactgataaacccctttaaatgggatattttccatactccaacacatagtatgaaaatttattttcatagttttgaaaatgtttctttttatgtaaacaaaaacactcatattgtaattatgtaatttgagtttgacagacttaagtaatctcctagttttatttaaatgacttttgtattctacctgtttcttttatattgaagtttactttttgagcatttcagtgaatttattggtgttcattggttttctgccttgttttcaaaattgtaataggcatgttgaagaccacagaagaatttctgagttaatttccagttgagcaaatatgacagatatattaaataaatgaatactaccatagagtttaattcttctaacttctactgattttttttcttacagcaaaatatatcagttatatattttgtcacatagctcagttttgtacactgattaaaatatttgagaagccaggcagacattcaaatggacctgtttaataggtagtcaatgacaacctcagaaggtgatgcagccaaataaacagaaaaataaataaaagacaatgtaatggagatggtagtggagagagatatacttaatactgcggtgttttaaatttgagcttttggattattagtgccatatgcaatcagtaagtatgtcataaatcttgtccttcagaattatgagatatcaagaccagctccataatctgggggtatagggtatttttgaaataccttgttcaaaaactaacaactttaagattgtggcagcagatcgttaaatctaagcagagagccctaggagacgatacagattgcatgctcagaaagctggcctgtcaggcatgctaattgagtgaaagtcttcaaagtaagaaatggttttcaattatttgaatcattattccttggcaaaatgctagtaccttttttaagggtcgctgggaaggttgatgaaatatttcatgtaaacgtcttaggcaacagtgagcactttagatagcatttgaccagtgataatcattttcatccttacttatctgttagctttttttttttactatggttttcctcttatttgatgaccatactatcataaattttcctttatttttcccctttatccttctcttctcttctttatgactttaattggttttttctcctttcattgaaaaataaatactggttttataccactctttatttcctataacaaggacagctgtacccagtggtgccactttatagccccaaccatgcctccatgctgagtgtgtcctttcatcagatttccttgacatctgtaaaagatcagtccgggaatgtataattgctaatggtatagtctgtacagtacagaaaatatggctattcattgtggagagtagcctagtcactgaagtttaaatacatcagagtgtcctttaaaaataagaggtaggaatgcattgatagcttggtgtaggaaattttatagtctgaatagattctcaattgattttccgtatagtacacatagatttctattcactttagtggagaatttacaaaaggtatgccttacattatgtcatgaaaaggaaaatattgaaaaaaaggtcaatccatacataaattttgagcagagaaagtatagcttaaatgaaataggtttttctaattattggtaatttgtgtggtgcgtgcataggcatgtgtgtacttcttttgctttacctggaaatagtctatgtatgtaaaagttgaggtataatcaacaaaaacttagcatatctttctacatctgtaccaatgtcagggaactatgatgtctctcacactcctttgaaagagaacattaaaaaaaatcaaaactccctctaagtaatataaaaatctattcattactggttttcagaatcacatggtatatattacattgttactaaaatattttgaatgaaaattatctacaataaatagcttattatttccactgaattacacaaagcagacattgaaacttgtcagaatgtcagacattttttaagatgaaaggaaaactgattacaaatgtgattttaatttgaggactcggagaggtaatccttgaagtcagagttccagtataatttaaaaacatccaaaacttttgatgatgtactctgatagttaaaataattattgagttcctactacatgtatattcatagatagctacagatttagttattaaatttctacatgtacctttctatatattgtacacacaattgaaattaaatatgaattttaaaatggactgcacaaggatggatgacttcctaatctcttcccactgtctcacatgcttcattgagctcctaagaggtttattctattatgcatagtcctggatggtgctttgggtgagatctgtaagatttggtcttttctcatggctgcaattagatcttctcttgctacatcatcctaccaaatacccaaagatatgtcaatattatcctgattagaaggtatggtaacccacaggacctttataaatcaccttttgcctcaccttcctctctatcacttagggtcttaataattattgcctaaagttctgaagtactccctacacacacacacatggcctccaactttatattaaggtgatttaataaagaaactattttttaatgaaaacagatgcattctaagccttttctattaacatgatgattttttaaagactttatgttccttttgctttatgagcagaaatctagaattttataactcttatactttgtttaatggctcaagaagtagctgtcactttttgggaactgggaattagctacagattatatactgctgtcttatctgaaattcatttgcaaaactctagggttgaaactacttgtaattgtaaaagtctgtgagatttgctggttacatagagacattgaaatgattatgtaaatgatcatttaaatcatattactatatcctattctatgactataaaaatttttaagatataatttttatgaacagtattttgtgttttttttaaggtttgaccttttcctttaaatatattcacatgattcggagcagtgtttggaattttcaagatgttggtattcttcaaatgtttcagggaccaaatagttatagagatcactggaaaatgatggtgattttcctcctcaacttattcttagatagaaattgaaagaaaccagttcccctaagggaaaatattttcccttggcttcatgaagaaaacacaaggatatgtgtgtagaagtagttgaatggctggttgacttgagtggcttcatcaaaatggaggcccctgtagagtaatggtatccttagtaggttccaagttacagggatttcttggcatgaaaaccattgtgctctatttgtgtttgaaaggcctccattcattgggctggttgtttacattggcattaatctaattacattccggttgttttgaatttagtttagatatgccataagtgattctactttctataatcatatgcagaaattacaaagtagcagtcaacgaattacttttaaaataagcaaacactggaacaaccaaactcttatgtttttcaggagcaaaatccaaaatgtaaacacacactgaaaagctctttaaaaatcaatgaaagatactgtgcttttccaagccagaattcttggtttcccttgtgattgttaaaacaaaaggaagcaaaactcttgaaatggattcgtttcagcattttcttccccacatctaataagagggaatgttttccagcaagataatgatggggagtcaggcggaaagataggggacttaggaaaagggatagcagcagtgatattagaatgtgaagctggaaactactgctcccaggactaaatagtctaagtgctcccaaatcttgtgtccattaccaacagggagattggcatgtctggtttggaaagcatgtttttaatttgcatttgtctaaaattaaaaagccaacttcttattgggtgcttttctccccctgctgtctctggattatttttctgctgtgagctcgtgctttatctgcatgtgtgggctgtgaaggtagtatatgactgggcacctgtaatcaaagtatggtaaagaacctaaacctagaaacattatgttgtttcctgtataattcaaagtcaaagcagcatcagtaatataattgtaacaacgtccagcaaagttctagcttttctccttgtcaaacatttatttattttcttttaaaatatcaaacaccgttttagattttagaaattagaaaaaaaaagtttggtgactttgctgtcccctacatacatgttgaactctctggtgggtactccagcacctgttggggctgaattaagcattttattggctacttatgtagaaaggaaattatatttgatatattaatatatttagtagttgagagaatagatctcaggaaagctaagtaatttaacagatatcaacagatattgtgaaaacaagaattaaaatccaattttcttacttgttcaattccctggtcctcctctacgtttttcactgctggctagaggactgtcttttgtatcttctctagggcttaaacttggcaaaaatgtgaagtaggtgggattggaggaatgtgttttgttccttcagttctaccctctcacttttcatttcacttgcatcctcacaatttccacacagctctccctttctactttgtctactctcagagccttcttggttcacatattcgcatttacacaaatgatgatttaggtttaacattctattatacccaggggtgtggtcatttttagggacaagcaacaggatttagagggataaatggttcagtagtggaatgttgtcttttgaaaagtgatattttgagaggaatagcccctcattgtctattactcaaatttaatgcatattacaaataatgcttattttgtttgcaagaaggttcattttttttctttcttccttctttttactttctcttttttctttctctctctctcctctccttctttctctttttttcttctttctctgtctctcctattcattctttctttcatcaagtggtacatgtctactgtttgtttctagagatgaaacctaaattatagtcttacattcataattggcagttagtgagtccaccttatttttcatatagacttcttttggtaaaatttcactgcattatcatgatatattaatccatcttgatactatattgtaacttcctctacacctaacaccctttaccttgtctttgaggtccagggacctgtttaaatacctctgttcatttttataatgatacaatctgtaactatcaatacatgtccttggtttaaaaaaaatataaataagatagtaagtttacaactcacctatagctttgttaacctttttttctttaattcttaaaaattatttcaaagtcaaaacggcttcaatttactttccactgtcacgaatttcactctgtgaaatgagaacaactcaaacttcacattgagaagtattttctgatgtttattagttgtgcttgtatagtactgccaattacatttattagccctaaatattaaacagctggcagaattccattgtatataaataagacatttgagacctggacaagtgccatgttgaatacagccagctggtgctttttacagtttttttcgggctactagtactgatgccacagtacattcagtgtttaggtaaatgacaatagaaaaacatgttgtgaattgggaattctataggaaattccattatgtagaaatatagcatttcaaagacttttaaaccaaggaaatgatacgttatgcacctgttgattgaatttgttgaattttgtgttgcctggaatatgtttttaatctttaatttactgtgtgcccattttatattgctgagttatgccatgcaaaatgatgactgcttttatgtttcgtcttctaataaaataaatttttatttcagatttattttaattataaaagtgtattgaacttaatagtagtatacagtttagattctcactttatatgtagaatttactctttcagagtactacagactttaatttttatcctcacgaatatttttatgttcatatcctacctttgttgaattactgtataaaagccctttcttattacatcaaatttgtgtttttgaaaagcaaacatatttataatatgcttaatgtatattaataagtaattaatatttatttatgaatgtatttaatatatgagtctatacattaccgatttattagtattcattaataaattaataaatattaataaataatatacattataaataaatgtatatatctatgcatttaatacatatttatttatatattattcataagtgtataaagctatacatgtattatgtaattaatttatcttatttaatgtgtattaataaataattgacatatatttacaatatacttattgaataagacaaatgctagtaaagtgacttgcactgttgcaaatataaaaaatatgttaatttaaattaaaaaatgaatttgagctgatgaatatcagtgtgattctaaaaatgtccctctgttttaaaagactatatgttcttaaatttaactggtaaatactgtagaaaatatttgttgatttacatgatgtgcgagagtgtgtgtatgtatacaagcatgtgtatgaaaagtttaaattaaacagtagccttgtcaccataaacacttatctgagataattggccatgacatagctttgtaggaacacttcagaggctgcgctgggcttgagaaatgtaatataacaactctcttgacttcagtgaaataaatgtatattatatattaattaacactaaaaatctcttagcaccacaaacctgctttctttgacaattctacatatattttaaagtgtataactggtatctcctaaacagaaacaagtaatctgaaaaaaattcaggattttaatgggcaatatataacaagttactttattccaataatataaaagaaaactagtaggcagaattttgtttttatttattttgtgatttaatgattttcatgatgacaataaatggatacattcttgtttgtaattccccctttaatacccacacataatacttcctcaataaaatgttattgaagaaacaaatagatgaaacacatccagataaaaataagccagctacgatctcgttctatcataggcacgtgaatgacacccatgttgccaaacgctgtggctcagtcgtcaaccgtcaccttgctcatcttgcagaagtatttgggagtgcttactgacttttcttcttttcatcatcgacttttattcagaaacttcttcatttggtgtcagcatactattttcatagttctcttgctttactgggcactttttcttaagctctttcctagattctcccaaaaattcttgatttctaataaatgaaaaattctagaactcattcttcaaactccttctattctctgtacaatcttttcctagccaatatcaccatctacatattgaccgtccttatattatatccttgacttcatcatgctcctaaattccagactcataacaggtgctattacaaacttcacttctaactaatatatccaagatacttctatattctttcaccaaacctgctccttcttcagttaatctttcccatcttaataaatgattttcttcttcacatcattcacacctcttcccatgacaatttatcagagctgtgatccttgaccactgtgtccctctaccctccttcattcttcactatctgttctctttttcctccttaaaagtaggttccatgaaacttgagactgctatttgtttatctaacagcctctatccccagttttgaaaagtgtatggttcatactaggccctcaagaaatacttttgagtgagttaaatataagactatagtaagtgcttctctcatgtgctatctagactagatgcctgtgcctggagtgtaatacctggagttaaatggattccagtttatgtagaaagtttagaaaacatttctgaaaggaataaattttagtctttctcaggagtatgaagaggactaaatgggaaggattgtccttaccttatgaaatgagatgtataccttaaactataattgacattaagtgggattctagtattaaagtccaaaccttcatttcattagtattaatgtccaattcttcaatcctaatataatgttgaaaactatactaagagactgggcacggtggctcacgtctgtaatcccagcactttgggaggccaaggcagggggatcacgaggtcaagagattgagaccatcctggacaatagggtgaaaccccatctctactaaaaatacaaaaattagctgggcacggtggcgcgcacctgtcatcccatctacttgggaggctgaggcaggagaattgcttgaacccaggaggcggaggttgcagtgagcccagattgcgccactgtactgcagcctggtgacagagcaagacttcgtctcaaaacaaaaaacaagaaaactacactaagagacctagctctagtctaagccacttttctcttcttgagaattcctcgtttcctgaacgttactttgagttctgtattgctcccctgacaaattctttttattccaaaacagaacccttgctttcatttgcaatattttttcacattatctattttttaaaactaaattactgtaagtactctattttaaacaactggttactaaggaggcattaattgtgtccattatgatctgcaatttattattagtacgtcttcctttgttcagtagccctgccattttgcattgagatttaatactggaaaacaaattttaaacccagttcagctcatttggaagtataatttcaacatgagatctgagctgaaaacaggtacctcgttcagaaatttaaacctaagacacttcctgtgcaacagtattaaacatcctctatctgtagcagctcaaggttttactatttaaccattttatgactactttacctaaaagctgcacctgcttctttgatttatattatatatcttattgaaatcaggccacactttcctttacttatttttttaacacttactaagagaagctgataaagaaaaatattaacatttctggaccggtctgatgatagtactttaaattatttttcctaactctcttcaaacaaactaactctcttatttttcctaactctcttcaaactcgttgtttgccaggtgagtctatgaaaacaaatgaatcagtcatttcagagaacaatatatctaccaattaactgggtaaccaattaaccaattacctataaacataggctttattttaatattaaacatttaaattttgtataaatattgttacaagatatattctttgttacatatactgtgactaaagaccacagactgggtggtttaaacaaaagaagtatttttctcacaggctggaagtgtgaaatcaacatgttgacacgattgcttcctctgataaccttgaaatacaggtgtaattgcataaagttgtagtttttataaatataacatttgaaaccccaaaataatatattctgtgaatatcttctctttatgtaggccatttacaaaatatggaaacctttgagataccacagttgagaagtatctgtttcaagcctctctttctggcttataaatggctgtcttctcgtgtctcttcacattgtcttccctcaatatatgtctgtgtccaaatttcctcttcttataaggcctccgtagtatcgaattagagctcacaataataacttcattttcatttaattacctctttacagatcttctctccaaatatactcccatcctgagatcctgagggttagaacttcaaagtatgaattttgggggtatatgattcagcccataatatatgtttaaacgtttacccatttcattttattctttttattggaaatattaaaatacaatattcctctttcattggtgtagtaaacattgactgggtgacgcctgccagatattatgctagcttagaagacaaaaatggatgaatacatttgagccacagtgcttattaaaaattaaagtggagtttcttctgacctttaatgcactctccagcttaccagagttcccatgattcctaattgtacccaactagtattatatttttatttttatttttttaattttttttatttttttattttttttgagacggagtctctctgcgtcgcccaggctggagtgctgtggcacgatctcggctcactgcaagctccgcttcctgggttcacaccattctcctgcctcagcctcccgagtagctgggactacaggcgcccgccaccacgcccggctaattttttgtatttttagtagagacggggtttcactgtgttatccaggatggtatacagcctgtgagaaaaatacttcttttgtttaaaccacccagtctgtggtctttagtcacagtatatgtaacaaagaatatatcttgtaacaatatttatacaaaatttaaatgtttaatattaaaataaagcttatgtttataggtaattggttaattggttacccagttaattggtagatatattgttctctgaaatgactgattcatttgttttcatagactcacctggcaaacaacgagtcttgaagagagttaggaaaaataatttaaagtactatcatcagaccggtccagaaatgttaacatttttctttatcagcttctcttagtaaatgttaaaaagataagtaaaggaaagtgtggcctgatttcaataagatatataatataaatcaaagaagcaggtgcagcttttaggtaaagtagtcataaaatggttaaatagtaaaaccttgtctcctttgtctcgccctagtgtgtgacttcgggaccttccttaatcttttggcagctccctgtcttcatcttttgaaaggagatattatttatttttaacttgtaggttggttatgaggactatattaggtttataaatatcaataacttagaaaagtgtctggcccatgaaaaacatgtagtgcgtgattaaggatttggcaaacccagtgaaagaacgtccagatccaagaggagaatcctaggtataatattttgttctagaaaccacactacattatggagtgttcattaacttacattcaacacctacaatactgtgagtgactgctgatattgaaaatgatgtactctgagccttcgtagatccagagttataggagtaaaagtttaattttcttcaaaatagtaaggctaagatttgaagcaggaaactataataataaatataaataaaaggtaaaatatactatatatactacatacactaagaaatattttatgtaccaaaatatattcatatatgtatacacatcaagtagaaataaataaaatgactgtaggatttaggaattagttctccaataaccagaatacacaattgaccaaaatatttgccttctggtatacttataaaaatctctaaaatatagagttaatttggttttcttcaatgtaatcctacttaatttcatggtattgacttggatttcatattttgaatagaggatcctaatacagagaaaactggtatatgttaccattttaggtgtcataaagctctagaagctgaagaattctctggagacatgtaatattaggcaaataaaataaggagccatcctgctcctaattcagagtaagtaactgctttaaaatatactggatttatttagcctcatcagattaggatatagccaaaatcaataaataatcacttgtaaaatttgaggtagaatttagagaaatattttcaaataaatatatttttacacacctattattaatacataaactttgaatgagtttgtaaataatctctgaaatcttttgtacaaagttggaacaaaaatttatctggatagtaaatagaggtataattgcataacgttgtagtttacataaatataatatttgaaaccacaaaatatctgaatatcttctctttatgtaggccatttgcaaaatatgaaatcatttgagatgccacccaaaaaaatggttaatctgtgaataaagacaacaagatctttgtagcttaagtagctggccattgtttttgggtttaaaaatttcttttaagttcaaaatattgctctgataagctacaagtttgtagctgctccccaccaaatgatagcggccttggcattaccatgggaacaattgttacaatttgataatcctatttttcacaattcaatttgtgattagaaagattttcttcatccttgatcattttgatgtagaaaggatttgttaaaagacacaaaattacagttagagaggaggagtaagtgctagtgttttatactgcaggatagctaccgttaacaataaaatattatatagtttcaaataactagaaggaggatattgaacatttccaacagaaagaaatgataaatgtatgaaatcatagatatactcattaccctgatctgttcactgtacattatatattccaaaatgtgactatgtgccctatgaatatatacaattattgtcaattaaaataatattttaaatgatattgaataaactacttttttagaaaaatttaattacacaaaatgatatgagtacacactatttagctttttaagtgtttcccaatatgtttacctgctatgaacatgttatatgaatagtattgaaccatttttctgagctcaaaatttataaatgttccttcatctctaaaatttcatgtccaagtggctatttatggttctaatgtatttcattatttttgcttgtacacacattcacattaggctatgaaacggaatgcactatatattatagaacatttgtaaacatatgataattttcaaagtagaatatttatcacttatgatttatttataatcatttttaggtcaggattaaaatgagatttagtccattcccaaatattcttccagaaatgtaacttttctttaaaaatactaatatttcagaacttgttaaaacatactctttatagtacatggattgatgtgctaacaaaacgatattttaataagataactaggttcatctaaaattatagtaatactatatttctgtatttgtttcaaagttattaatatttgcctgtaactggcaaatctcgtattaagtattagtagagcagagttttatccagactgactttacaattagtcccttctgccttgcagaaacaatgtggtttattggcacttgaacaggtctaagagtaagaagatctggtctaggttggacttttattagctttgacattggatgtgtttctgtctctctctgtagatatcgattaagaaacctgtaaagaaagttctccaatctcctatagaatctattgaatatttttctattcaataataaaattgttaggacaaaatctctgtatctgctttgacttcttctctgctatgctttatgaagtaaatgacgttttgtgaaaacctctgctaacaaaaatacatgtattttttatagtcaatatctgtcttcttgtcagttcactctcctcagaccatactttgctctaaagcatcctctataatacctatacagttattgaaattctcttctctccagcaactctgacattgtttttcccttgttctattctcacctctgcaaatgctccttttccagcagtatataccatgccgaacttgaaaaactttttgatgtgggaacatttcaatatggatgttggaaagagcaatttcgataatacagtatttccacttctctcatcagctcatagttctcttcctaccctgtacacacaagcatttcataatacagtttccgacatttcatttttcttgtatttttttcttttttaaacataagatttctaaaactttaattatatgactccaaaatctgaatttatatgcatgtaatttttttttctgaattctggatatccatttcaacttttgaaaacattctttttctgtgtttcatgttgacattattagattctacccatattaaacttttgctcctcttctttgcataagttctcacacctgttttgctgctctttctgctcataacgttatctccaagtcaccaagacaggttcataaaaaacaggaaagctgtgcaactgaagagttctgggtttgaatctaggctccaccattaacagctaacagatttaggggaagttattgaaccccctcctaagcttcattttgtctcatctatagaattagtagatgatggcacctgcagcacagggttttcaaggataaaatgatgcaatgccagaaaggcccattaccttgaacataaaatggtcaatatgattatccaatgttagcttaaaacctcagagtcattttcaggtttttagttttctcaaaacaaatatcaatcgtttgtcaagtccttgtcctactcctaaaatatttctctcattcaaaaattagttcatttatttgcttattcaatgagtggattatgtggaactgtcctgggtgttgggtatcagtaatgagcaaaatgaacaagtcctcattacctgtcccttagataaccacagtaactctcagatccatctgcctccattcctcatctagcccatcctaaacactcttgccaaagcaatgtacttaaatctaattgttgcttaaatctcacgagtgatgagaaaaacttccattatattccaaaccatctacatggtcattccccactgttctaattttctactattgtctttatagcacccagagtgattctaggaaaaagtaaaacttgtcagtcttctgctcagatcccaggattgggctaaactcttcaacccttccccttcctccttctcccagtcattctctttacctctctcctctgaggacatacaagatactgtctaccttgggattctttactgctgtttcctttgccttgaatgatgtttcctgatgtatccatattcttttattcaaatagttcaccatgaagtcttcctctgacttgtctcatcctttgaggttttatttaagtatcacattttcagtgaagacttcccaggccattcattttgaaatcttcccctcctctcaacatacacaactgtgtcctctctctggcttccgtcattgcttctcctgaaaacataacactatgtaagaaaacacattttaacacttaattttgttttgttgtatatctctcccactggtatggaagctccctgaggagagatttcaagtcatagatttcaagtcatcattttcactgctgtaatagcaccttatagagtcactagtgcataacaggtgtttgataaatatgtgttgagttagtcaatgaaagatcaacttcatctctcactgcagctgcccagtgatgtccaaactcagttggaattttgggggttttatgcctttttccatatcatttcacctgctcggaatgtgctcatcctccttcttcctcctcatctattttcactagtcatagtagtcaaaattatacattttgacatagtagtcaaaattctacttatgtttaaatttcttccctaaatgccacctcctgactgctaattttttcctctggtttttgtactgggagtggcaactttcaatagcataaatcacattcaacacttttctctcatgtcccacatcaaatctataaaatcccgtggctctaccacccaaatggttttggaatctgttattttcttcctatttccaccaatgctatcctatccagactccatcctatgtcacaaaagtattacaataacctcccatcccacttcttagaccgtcactccttgctgtttctcttcagcacagcagcctgtgacctttttatgacatgattcagatcatgtcactcctctattcaaaccctttactaaatttccatttatctaaggataaaatccaaagtctctcttatgacctaaaaggacctaaatgaccttctactcaactacttctctgatgtaatgtttcatgacatcttgatcataatggtagtgccaagaaatggttttgtagaatgtaagggcttcataaacatttgttttatttagcaggtaacaactgtgtaagcacttactatcgatattatctattaagccactaagcaatcctgttagaaaggtgctattattatctccattttaaacatgatatacctgaggcttaacatactgcctggtatgaaataaaaacataaaaaaaaacataaaaacataaaaaaaaaataaaaacataaaaaaacttatttttattaaaatatagaatatatctcttgacgtgttatgcagatagatggcagatatattttacttttaaaaaagataatagtgaaaagaagtgaagtcaagtgtctaataaaattacagaaatatagaacatggtaaagtgtggaatactattggcaaagattttattccagtttagaagggcaaatttatcttagaaaaaagatagcagactcatttctcataaaattgtggctgggcacagtggctcacacctatattcccagcactttgggatgccaagacaggtggatttcttgaggtcaggaattcgagactagcctggccaacatggtgaaaccctctttctaccaaaaattacaaagattagcctggtgtggtggtgtgtgccttagtcccagctactggggaggctgaggggggagaatcgcttgaacctgggagacagaggttgcagtgagccaagatcatgccactgtactccagcctgggtgacagagcaagaccctgtctcaaaaaaataaaaataaaaaaataaatatgcaaagcagccaaatattcagttaccttttgtcaattatatttagtgaatttcaaaagagtaaaacagacttacactggtcataattgttatagcctcaaattagaagaaacagaaactccagcaagtgaaaaggaataataaatagacaaactttgaatttaaaatacatttatattattttataaggaaaacaaactagtatattccggtgacatttttggttaactcagctttgtcagcataataataatgaatgtttatttgctgcttcccaagtggcaaacacagttacaaccattttaaatggacaatctaattttgttcacaatatctctagaaaatgttattattatttttcccattttacagatgtgtaaattaaatcatactctattgaatctcttagttattaagtagtagagctaggtttcaaacacagggtcttttatctctacaggttagacccttaaatctaggctcctcaggatactcaacggataaaagattaaacatgtttctatgaagtattgttgctacccttgtgaagagaacagtagaaggggtctctgtagctttaaaattggtgctataaaacagcttacatttcagagaagtgctctcaaaaattacacttattttgttaaaaagtaaatttagctatctgaagatctgtaaaacttagcatatgttccatagtgacaccagttaatttcatttccgtcaccgggagtgctccgcaggtatattgtaaattgctatgaattactgtggctgtgacccattatcatagcaggaaattgcatgaatctcacaactgatatgaaatatactgctgtcactgttatgcattaatttctaagtagttggtcatttgtaataattctgtaaatgtccatcttagcacagttttcagtctagacaagttaagccaatgtgcatggaattttcctcattatcttcaagcagttatactgaattctaaaattacttttttattggacaatttcaccttgaatatctttccaagaattggaaacatgctagtctcattgtcctactctctaatacttaagggaaatttactctataaaaagtaaagccatttggctatatatgattagaaagacagagtgagaaaatctctgatgaatgtcaacagtgtatttttttctttctaacttgtattgaatatattaatgatttattagattattcttaaatcgtattgactcccactttactgaggtaattttcagataatggtatacttcatcacgatagttttaaaaagaacatttttgcaataagtgtcctttacattataagtaaacatatttcaccatttaaaaaccaaacctttacaatgcaaattatacttttcttctcttttctttgatattgacattattctcctcacaagaaagaaaattcaaatagcacacttcattgaaacttcttgacaatggtgaattatatgttgtctccctatgttatactttatattttagcataacatatatctgtttcgagtcaatgcttctggctagaaattctcttctttggtaaatctttgaatacttttaataatttttgaatttttttatttccaccccaccatatctcaggttttcagatgctttttcctttatcttccaaaactattttcaccctctatttcaaaaatctgaattataaatttactgacacatagtttctagaaatgtataccttcttcttttttcctgtaagtctgtcattggtcttatagttactcagttaaggatactctgacagataactgtctacattactgattttctaaatccaatgcctcatgtagccaaaagcacacttctgtctgtactttgtataattttgacatttggcacattgcatgccatttaattttagtaaattaaaatagggcgcttacttggttttaggcacagggctagatgcttgggaggggaagatgaacaaaaccagagaccatggagggcagcaagactaatgaatagagaaatgagtgagtgtgttttatataaaataacagtagatataactggtagatattatgttctataagaacagctatcctgtctatctgtgttataactgcattatcaatatagagcctgatacacaatattcaataaacaaaaatttgaatgttcttgaaaggagaaatggagtctacattggacattatttcacagagaaaaattaaagatatcaatttatttatatacacgtaccttgtctctttttgttgatgctgcatctttcagcagaaagaagaatcattctgaaatatgttttggtatatccaaaattctaagataagctgagttactatcttcacatgtagatattcactgtgtgcattcataagaaaaaagagcatctctttataatctttttgggaaatgttcagtatataattgttcaacagaagtcatcttaagaagtcttgcctgggtctttgccatggtcttgctaaagctcttctcttttttattctttattgtaccaactcccagtccagagctaaccatgcacctctcttcagtagtttctcactgtagcaaatgaggcagagacacattgcactgcccaaattgttcctggccttacatttctaagtatgccagggccttgaataaggtagttttgtccaatatctttcattgtaacactgatgagaaataaatgtaattcacagccagggacactgtctggagtgttcacatcgtccccatggctgcatgagttttccctgggtactctgtttttctcccatatcccaaagatgtgcccgttaggtgaactggcatgtctaagtgttcccagtctgagtgagtatggtctgtgtgagcgtgcccttcaataccatagcttcctgtccagggctggctcctgccttgtgccctgagctgctgggataggttccagccaccccagccctgaactggaataagcaggtgtattagtctgttttcacgttgctataaaaacactacctaagactgggtgatttaaaaagaaaagaagtttaattggctcatagttctgcaagctgtacaggaagcatggctgaggaggcctcaggaaacttacaatcatggcagaaggcaaaagggaagccagcatatcctacatggctggagcaggaggaagaaagagcaaagagggaaggtttgcacactttcaaacaagcagatctcatgagaactccctcaatatcatgaaaacagaaggggaaaatccacccccatggtccaatcacctcccaccaggtccctcccccaacattggggattaccattcaccgtgagagttaggtggggacacagagccaacggttagaaaaagaatgaatgaatgaatgaataaatgaatacaaattattttaaaataaaaatctgtcatgtgtacaataatcatacaaatacatggcattaaatgaggcagtactaaggcactccacaagccaccatatttgccatggtttttgaactacacagtgggaggaggtgctccttaaagtgtttactttgcaaatgttcattcctagatgtaacccactacccattctgaccactgtctcgcagctattcaccaaaaattgggttaataatcatcttgttttcatgaatttttcttaaatgaatctgtatcttacatttatttccatgtttaatattagaagtgcttcgagtgtttatttagaaatttggtgatgttttcataaccagaaatatgccatgggaagttaactcttgtttatatcaattagcccagggtaaaattggttttgttatacattgtttaaagtcacagtttccaagaatctatcgaggatgttaagtgtgaacttcaagtacttgtccacatatccacagcccgctgccctatattccaatcgtactggaacccagttacttaaacaggttttgtcctcacatttgctaagcctgctgacactttttctccctctctgtgtcctccttaattttcacttacagaagttccaataatctcatattttcatttccgtatccttttccaggaccttccttcacatgataatctttcctttctcaataactccttgcagtacctcaaatacagaacatattgtcatctactgtatgtgttatgcctcctccaccagcatcaatttctgataagaaaaatcacattttgtggccaagcgtggtgtctcacgcttgtaatctcagcactttgggaggccgaggcaggcggatcacttgacgccaggggttagagaccagcctggccaacatggcaaaacaccgtctctactgaaaataaaaaataaataaataaataaataaaaagtagctgggcatggcggtgcatgcctgtaatcccagctactccggtgactgaggcaggagaatcacttgaacccaggacgtggaggttgcagagaaccgagatcaccctgctgcactccaacctggatgactgagcgagactctgtctcaaaaaaaaaaaaaaaaaaaatatatatatatatatatatatatatgaaaaattacattttacttatctttttactatacacaatttctaatttaagctttgcacatataaatatttaatatgtccatgtaaaattgaataaaactgcaattataagggcgttttcaaaaatcacaaatcaccacagaaaatcacagtagaatgctatcaaactacagcaaactataaaaatagtagcatgtctaaaatcaattgtcttcttcataccagtataaatatgtgattgaaagttatttccccacacactgtttgcatgtttttgtaatacacctacctgttttgtcaggtgttctaccaccagatgtgaaatagaacactgtgaggatttacttggtttgttataatatcttatcattccttgtaggaggtagaagatgaggttattcaggtgagcttctgtgtaaggcatgcctaggccctggcaaatctggagtgaaaaaccagatgggataagggctgaacatgagaccatgctacagagacaggggaaggacgacattttagacgcagtttctaaggagactcagaattcacggaagctgatattggagcatcctatcagttcaggtagagtgcagacgttaaaagtccagttggccaagggatatatagcattagttctcagtgttgggggttagaatgttagaatcacctaggtttttttggttttgtttttgttgttgttgttttttttttatctgggaagcagtattttaaaaaagcttcctggttccctgcttagccggaattaaaaaaaaaacaaaacaaaacaaaacaaaaaaaaaattacataaaggaattaaacagacttaaaggtatgagacatttgtccaaaggtgcggtatcattgcaacagacctgagatctcagtacagtaaccctgaatcccagctgggagaaaaataacttaaagctccggctgggcgcggtggctcaagcctgtaaacctagcactttgggaggccgaggcgggcagatcacgcggtcaggagatcgagaccatcctggctagcacggtgaaaccccgtctctactaaaaaaaaatacaaaaaatcagccgggcgcagtggcgggcgcctgcagtcccagctactcgggaggctgaggcaggagaatggcgtgaacctgggaggcgcagcttgcagtgagccgagatcgcgccactgcactccagcctgggcaacagagcgagactctgtctcaaaaaaataaataaataaaataaaataaaaatattaagaaaaaaaccttaaagctcctagaagagtggagctgaggctacttcaggtcttctctcagtctaggggtattaaggaactagaagacagagaagaaaaacacagacatctatgagcccagctgcgaggttgctgggtaaagcggagacagaagggacaacatactcaaactttctggagacattgtgcctttaatagcctgtatcttgttaaaaccacagaaagtactgaggtatgcccaatattggtgagaattctaagcagggatcttacatgattctgttcctagctcttctcactctctaaaatactttgttggctttcctcataataattctgattcttttacatttgtctttgtttcccagatcttttcagtatactgtgccaaactgtggatattggcttttctatattccataaggcaattctaataccattaccaaatttctgctgaaaacttaggggctaaaggtggttgggtatgaatagtagccattataattaagataactgtccacatcttcccacatatgcccttttcggtcatatttgtcttcggatcctgtcccacatcttgttaatcatagggattttccaacatcaaatctccatcttctgtcttcctgactcctcggccacaaatgtaattctctgatttgacacaccacacacacacacacacacacacacaccccaaacaaaaaaacaattctattcctcatttgtctcaactatttgacattactctgatctttttataatatacctttagaaatatatatctgtgtgtaaatgtgtgtgtgtgtgtgtgtgtgtgtgtgtacttttgagaccagaatgggctaaggaaaactacttatgaataaatagaaatataatgatttttgtagatatatttgtgcgtgacacttgacagtgacagccttgctgtaagagattctgcatgcatgcttaaaatgctgctgcctggtaaatgcccaaatacttccaggacgaagactggattttgaaatggctatgagtgtacaaggggaaataaacataagaataaaaaacgtgagtggagaaaggaataacatgaaccgacttaatatcacttaaaattactgggtgcaagattaatcatcatcagcattttgtaaagcgcagaaattggtgtttcttataaaccattgaaatgcaaaaataatgtaaatgtaacaatattgctgatgcatttcccttatattgtcatccacaaatttcttagaaactggttttaagtcttaaaaggtaaatcatgactatcttgcaatcttaatattttccaaattatattagcttgtgcactaaatttattgcagcttctgtttctcttaaaggaagtgtaaacttcctcctcaccttactaccccttgttagcaaataaataaaaatgttttctatgaaagtaattaatatcaacaataaatataaattcttaattaccataatgatgatatactagcataatagttattaggtaaatgccagttaattattaaaatatatgtttccctcaaaaatatatgtttgattcagtgacaaggaactgtgctatctagaaaatataaactaagagcctccttagtatcttatactacctttgatgatggagaggtttggtgtggttattttcagaatggactgtccagtgggagaaagtttggatgcataggtttcttatacttgaaatgatccagagaaagatgaaaatacaaggaaccctatgtggtctaataattaaagcttaaagtcaaaatctggaagctaggctaaatatcagaattgtttattttaatgagttagaggttgaaaaagtattttgagctcctcttttgtttgtatccccttctgctgaagctgttactggtggataccaatcacagagatttcttgaaagcattaagaaaatgaagagaaagatgcttttcaccaccaaattctatgttaccattgctatgtctcccttttttttttcatctctgccttgagacaatttctttagcaggatagaatctctgataaaatataatgataatatataatgaatattatacattagttcttacagtagaaaaatgaatgaaacatgggcattctttacatttacaaagcatgagcattataacagcagctttaattaatgattttttcttgttgctgctgctatgagaaaatattcatttaagaattttatttctactgtctttagtcctcagcaaatgctagagttagagacttgttgttttcgcaagtggtctgagatggcacatcaccatcccttacaagcaatttggccttcattacaaattaatgaagtgataattgctccttgcaaccttttatgtgcaaagaatgctggttctgtttgcattatcttcttgcaatgtacacctctgttttcaaggacttgtggtatcttgccaaatgttaaactacactgagatctccataattaaaatcatattttacatcaagttatgaaaacctctacacaatatgttctgtttgatgtccagtaaaatgctgttcattgcagaataaatttgcaaatgattcatcaaagtaacaatctcatttattactaaaaggaaatcttgacttaagaaatttaaagtcaattggtttacattcaaataatattgtcatgatcgaactttctataagatggttatggaaagcatttgttctctagagtttttgctacatctgtactttaaaatgccattgtagaaccaaggtaatgttactagagaagactctataaaacactaacttttaacaccagagatttttggagcaccaagtctgttgactgtttttttatattcaacatatacattcattttgctttgaatgtgactgtattattataggcacctcaatgtaaaaccctaagaactgagacgctcagttgctcttatcttcttaaaaactcagtatattacatacatatagagtggatgcatgaaaattgtatattggcaattattacaaatataatgtgaatattttctttccttaaactgaggttagaatgtatcttgtatattacttctgagatcttctaaaatagtctcaacttgtttcgttgttgaatctcggatgtgacaatgaagctaggtcaattttgcctccagaaaatgagtgcctatcttgtattttagatcctgaacgatcaaggtttttaaaataaatagtgctgttaacttgttttgtttgtaagttaataggtgagctatgaagaactagaagtttttaaactgtgattgtcacaacagtaaagttcacaaattgttttttataatttaagaatttagtataaaaaaatttcccctaatgaggcttaaaggccaaataaatgtcatgttcctttgtttgtaattaccgacaatttaataaattaatattttattttattttgtgattagaaggtgtgaattaaaatttctgtgtctttaaagatggcaacaataaaaactagggactgctgaaggagaaaaggagggaggcaacaagaattgaaaaactaactgttgtgtactatgctcacaacctgggtgagaggatcaatcatactcaaaacttgacctcatgcgatggaccaatgtagcaaacctgtacatggcccaaactgggaaaatattcgtacagatgaattttaggcagtagtattttttattctttttttaaacaaacaaacaaagcaaaaaacacacaagaaaatcataacatagtgtcaatagaaatagaaaaaactgttaatgcattttatatgctgttgatttagttaaaagtgtttaatgtctattgttcttgatgaaaattattaatgctttattggagaaaaatgtaggaacacatttataatgggcttcacaagggttttattcataaatttaactacaatatttaaatatatttaaatattttctctaagaaaaacgttttgttgtattcccatgaataactcttacttataagaaaaataatatttgtgcatatgccaaaaggtgaagttttgtgctccatactacagtgaatatgaagagacctgcctaaaatttagcaaatgcctatgaaacaaaattaaactaactttagcatgtatcatgaattaaatttacaaatgaataggggattcaataagggttctataatacagaaattttcttaagattgtcagggttatggaaggcataaggcagaagaatgcacagtcccatggggttataccgtaagaaaggcatattccagatgggcacagtggctcatgcctataatcccagcactttgggaggccagggcaggtggatcacgaggccaggagttcaagatcactggccaacatggagaaaccccatctctactaaaaatatcaaaattagccagttgtggtgttgggggcctataatcccagctattcaggaggctgaggcaggagaattgctttaacccaggaggtgaagattgcagtgagctgagatcgtgccattgcactctagcctgggcgacaggagcaagactctgtgaaaaaaaaaaaaaaagaaaagaaagaaagaaaaggaaggaaggaaggaaggaaggaagaaagaaagaaagaaagaaagaaagaaagaaagaaagaaagaaagaaagaaagaaagagaaaaagaaaggagggagggagggaagaaaggaaggaagggaaagaaagaaagaaaaaaagaaagagaaagaaagaaagataaaaagaaagagaaagaaagaaagaaagggaaggaaggaaggaaagaaggaaggaaggaagggaagattccacaagttccacaagaaaagaataaaggacagaatatccaccacatctttcgtaaacaataaaagagtttacattgacaataatataatatgtggaaatattacttatctcgattcaaacacttagaaaaattaacatgtggtttaggaccagttttaagaggaacacaaatgtgaaattcaagagttagaaagtttttgcgtaagtaacagagatccctagaaaactttacattcaagaatggcatgacaaaagatgtagtttcctgcaagaagtaagcaaaatggggcataagaggaaagtatggacacagagataacagaaacaactggtctaatagttttaggatcataagtaacacacacttacgatgctaagttaaaagcttctcaaaatttgtcctaaggatcacagaaaatagtgcttcactgttctcaaaagtctgaatgcttttaaaggtttttacagtgataaaagttgttctaagataaccttaactgctataacaacaaaaccccaaatatctatctatttcttgactaagaaaagatccaatgtgggtgcaaaaggctttaagaatcgaatgtttgccatgtcttctgtttttcacacataacttggttttatatttggcgggaagctgtggggtgaggaacatttctatttttacttcaaatttttttttcatagttctgcaacacatgtccattgaaatgacagtacattaaaaaatgtcatgcatgatgatacatagtaaaaatatcatttatattcactttattttaccttatatcaattttaccaaaaacctggcacaaattgggaaaagattaataagcatgaattttaggcagtattattaattttttcttttttaaactgagaaaaacacccaaaaacatatgagaaaataatattatagtgtcattggagacaactgatttgaggttttgatcctggaatgtttgattaggctctattaactgctaagtgtctttttcctgaatattcaacaaactgtaacgcaattgaaatgtgttcatcaaaattataaattactttatgtccattaactcagagaaccttgcaaataaaaactacaaacaagaatgtttttaatgagtaaatgatgatttattatatagagatggctctgacacccttatgttgtattcgttattatcattaattctgcctcactctctgtttctctttgattcttcagtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaaggtaagagccttctctatttttctttgagcaatatttctcacctatgagtttatcatagtgtcattaaatgaaatgcactcagtctcaactcacttggcaggaaaacatgcctcaaactgaccatagtctatttatggactaaaattaattccatttgatgtggtaattcatgctttgctgtagaaatattaatgtatttgattatacagtgctggcctgcaccctgtaataggtgttatacatgctatatttaagtttttctgctgtttaataactaaggtaatctaattctagaccacctggaagaaaaacattctatctcttttatgtagaaagttgagaaatctttagcactcagctaacctaattctaacagaattagatactgtggtggttatttatgctggtgctcatctatctcatagcaatatttacttcattgctataaagtacagtcttttcttcactgacatctgggtatcaaatacatgtttacttacaagagattagtgcttttagaagattatttgatttaaaaatccagagctgatgcttcagtgtttaatgtatacaggcatgatttttaagtgtcttttgcaccatgatttggctcgttttagtgctcaaaaattatttgtatcatccgttaggcttgaatgcatatttgatattaatataatatcacagaactagaactctttaatcaaattaatatttattaaaatcgctttatattttaagtggaatcaattaaaatatcattttatataaaattatgtatatcagctgtgctatatcatatcataatttcacttaatcccaaaatttacttagcattaggcaaggttttatgcttaagaacacactaaaattgttactcaaattttaaataaataaatatataggagaagttaagtatattgtccttgaaattttgtccattttaatgcccttgcttgctgttacactctgtcaagtctggtgttctactcctgatcgcataatcagtcacttttctcaaatgcaagtggaataaatgagactactttgcatataaattgtcctctttaaatctggacagaacataatattttgcttttgactgtagacatggttcacagaataaattcctcttcctcttcctcttcctcctcctcctcctctctctcctccccctccccctcttcctcttcctcttcttctttttcttcttcttcttctccttcttcttcttcttcttcttcttcttcttcttcttcttcttcttcttcttcttcttcttcttcttcttcttcttctccttctcctcctcctcctctttcttttggctaggtaggataggaaaaaagaaagctaagaatagtaaatggtaaatttttctctttcaatgactgtttagagagagaaaataaaggagggtagaaagaaatattggcgactaaagaacgatttaagaatcgcatgccaaacaaactccaagaagcaccaggaaggtaaagagtacttattacaataaatttggtgaaatagaaatgcatataaaaataactatgcaagcttaaactgataaggagtggtataaaaattagtaaggaaggtaagaaaatatgtgtcataccgtttactaggaatttatctaatatattttaaaatatgacttttatttaaatacattatctctcatatttgatgaaagagaaggatactgtaatatattttctttaatttaccatgtatataacttaaaatttatttggaccatgtttctgggatctgggcagacttgctggattttgacagcatggtcaaatggcaggtggggttgtttttttggggaggatgttcataaacctccttttaaaagggtaacactgaaaaattaaaattataaagtgacatactaaaactgagtcatctggcattcactttcaagcattgacaatattttacttgattttttcatttggatatttcatattttttagatcccagcataactcttcttactggttttctctttttaagattggaagtgtgggaaaattttgtattaataccaaggaaacatcatgattttttttttttgttctttttaatccagcctaatgaattatgttatctgttttggtttagtttggaggggagagatgaggacgctaatggctttttatatagtcagttaattacatttgagccagatagcagaaggttactataaatattccttctcatataaactttgtttagacttagtgtaccaaataccttattaatgtcactgaagaatttgttgctctgtgctttatctctgcacattcattgtggaatgctaactttattccttcttcttttacattagcagctaaatagaaaagtgtgtttgatgtgatgtatgaagacacctagactttttgatgactatccaaaattatatttgttttacttctgacttaggataccagttcttactctccactcatttctctgttaattcagaaactcttaaaacagctgccaaagtttcaataacaggataattttaagactctgcttgctctgacagaggcgctagagaaaattgaaaaccttagtatattcttcacacctactaagtctgtgtgcacaatcagaaggcaccctctggaactgcaaggtgctcatgagtgtgaatgaactcagaagcattcctttctagttgttttttgcctggaagttccttaaggggagacaccagaaatgtcttttcttagaaacatcttgcttagaacatagcagaatctaattgagtaggttctcaagtagatacctataggatgtgtaattactgtgagatttctatatttctataccaactatccattcttagaatagaggtcctgaagagaatagactttacattatttatctttgattccactacgcctttcagaatgcattgcaaataaagatgttaattttatctaatttgaaataaacatatttgattattaggtcacatacagttgcagccaggcaataatagattcatctgacttctcgttagaataacgaatagatgatgaagtaaaggaataacaaatatttttacggtaccaaagatcatacttttttcttttatgaatttatgatgcatattatctttctgctttaaaataatcaattgtttctagattaatacctgtaataaagcaaccgtctaaacaatttttgtagatgctgaaataaatgtggcatttttgtcccttaaatttactgatctagtgcttaaagcattggctcacctcgtaaagactaccctataattatcgagattcttaccttcggttatgaaaaatttcctttctctgaggttaaaatgacagctgtctatttcctctttgcctttagcagttatacatccattgtttttccaaccaatgaatttatttaaataaaaagtatggcactgataagtaataagataaataactttaatataacaaattaaacagatacattatagctttataatagctatcaagcctctgatttatacaagattctatgtcttctcatcaatttatgtacatgagcctaatgccaaaaaaatttctgcacttgtcttcaaattacagtttgcatttaattgttctatttagccaaaagctcttgtcactaacaagtgtttgagggcttgggcttaggagtcctaggaatgcagcttattaattttgtggctaaacattttgagccttagtttcttcatccacaaaagggatgggcttcaaaatggccagtggatgtattgcttagtccactgcacaatatacagcactagacacaaggtatttgaacgtcattattttcagtcatcagaatccctgaaatgtgttaccttccttgttttcttgtttcaatacattttagaacatttagatatgatgaaatcacccattcaacagcttaccttagaccttagacatattttaagagataaaacatgtatttaatgaatgtatatatttgtgtattcattatttattcattgattgcccaccttcttccaaacaaggatccaaaaggattgtgcttttctaaagagacattttttttgttcaattaaacctctagtctattaaaccatgggtgatatttcctccattatcttattgttaagtgttatttttcttccaaacagcagtcacgcttgatttttcccatctggtattggactcagtctcttttttttcatagtatgaatcttcccactgatttttccaaagtgccttgagtttataaatgcacatttttatattgtatattcagaaagacttttaggttttaactggtttgatttaagaaagcatgatttaggaaataagcaaacaactgcaatgcaaaaataaaattaaaatgctacatctcaaaaatgttaagcctaggttttgttcatattgtgtttgtgtcctaacattccttctataaaagacgagtttagttagttggaaaggatataccaataaataatgcccttgccttgaaagaatcatgtgaatcaaaaataagtaagcaactaagaaaaagaaaaatatatctgttgaaacatttcacctgactctggatagagctaacttatctatttactttgctttaggtagttattatgtatacttaagaatggcccaaatactataaaggcagtggagaagcagtataagttgtttgaagtatatgtcaaatgtgcttacacgaattattattatgtgatattactggaaatctgtgatcaaattatgtgagtgcactatctaaaaagtagttaaagtaaaaacttattttttaatatgaaaagtgagagaaagcaagggaatatatttggtttgtgacttcttaaatattgtagctcatttttgagtctctataaaaacaatataaatttaaaccatggatttgcaagtttaggaaaatagaaatgtgaattctttgttctgtatatactgcaaatcagattattttgaacactcagacacaatgtaattgcaaacatgtttaggagaaatatgtctgtggttaaatttagggagtagagcaaattcatatctaagcatttgaatacctcgtaatgaataagttaaatgatcagcaatgaaccactataacaggccttaaaaatcacaagaagttccataaatgttagtaacattcttacgcaggattacaattaaataagacttacagtgttttagtaaaatatgaactgttttaccttatgtgggttaactttagtaatataatctcaccaattctgttcagagggaaaaaatcttaaaacacattttctctttaaataggcatttcactctacttaatcccaacctaaaagatgattttataggtcattattaaagtatacttctaaagctctaatttaactcacaggcattccttatcaaatggctgtggggtatctgctttatagtatcaagttcttttcattaaattattattcttacactaagttctttgggcttttagatgctttgactggtctagtgtttcaaatgtgcaaatagtaatttaggtaatatctatatgccaagtgtataatctttgggaaacataaataatgtgtccattaagcagtttatttgtttgagagactatggtaatgtatgggttaatcttcccaggacagtattcactatgagcatctgaggcatcagaaaataattttggttgcagaaaaaaagtagctctcattttacttgaaaggggttgtttccatcatttcattttcagttttctgtccaaaggaagatagaacattgctttgtagacaactcactaaatatctattaaatgtaaacttacctgtaaagtgattgaaattgtccaagaaaaagacatatctaaacttcttttttctgtgaagggtgggatattggttattgtgaatatgtaaaaattatagttctcctatcatcttaatgaatattatcttgtcagctagctcgtgaatctgccatcataatttactgtcaaggctggttggaccctaaagaaagtcttgaaattccttttctttaacttaaggtgttttatatggatgaccttccttagctctgatttgctgcgtgccactttgttaaacaacttctgttaaagcatacatgttatataatttatggcttttgtaaagaacattcatcttcacttcaaacttatcctttttactctaactattcagatactataaaagcttctgtgttttcaactttcaagatgcaatgtaaccatgtttttcagaatacatgtaatgattccagagaatgattattgatatttcattaacttttccagctaatgtttcattttctttagtcaacttcttccagcgtaaggagaataaaaccctatgcaaaataaactgagaactagatctttttttccctcctgatggacttagattctgtgaaatatactggtaatagtttcacaaagattgctttgtcaatgcagattcattgaacactttccacctttttttcctgtgatttctccacccctttcacttctgtctgtgtttagagttttgacaatcccttattagttccagagtagaacttatgagagctaataagggtttacattacagctctgacagctggcactaaagtttaatagagagcaattgtaaagaagtataagtgttgataatatttgatgaaagtgctcttaaagaaagagccttttggaaataatcacataactagaaaagctgcatatatgctctttttttgtagcttctcatcttccagtatgcggacaaaacatcctgttggcagatgactctgtaattgcttatggatgccttttctaggaacagaatccagggtcgttaaaaaaacaaaaacaaaaacaaaaaaaaactctaaactttggtcatattcttaccgctatttctataaatctctgaaattcatgttaactgtcctttagaaacacaatcataacgtggacatctaatcgcagattcattctgtgagaagagaccccagggattccaaaggcgagtcattgagatcatgaaacccataaaccccacataatccaccacagactttttgtattattaaaaataaacaaataaaaagcaagaatggcttcaaatatagaaagaccctgagtgtaaaatatttctgaattctctattcaatggtcagttgcaatgccacaaaaggttaaaagaaaatgctgcaattgaaaacagctgtggcttttttaacatgaagactaactttcaacaaagagaaagtatatgctatgagatgaaggaatacctgaatttattgtgcaccaggaacatgtaaagttttatgaaactgagaagtgaatctgaatatataaataattggtaaggaacatttttgcttctctgatagttactggagaggaaaatttgtatttcagagatttagattcatttactgtttatctcatacttctacattgaatataaaatatttcaatccatctatcatcatgcataaatgttttatggcatacagaattgattcatgtattgaattggggggaaggaggatatagttctggctgtaaagcatcttggattttattattattattattattattatgctttaagttttagggtacatgtgcacaacgtgcaggtttgttacatatgtacacatgtgccatgttggtgtgctgcacccattatctcctcatttggcattaggtatatctcctaatgctatccctcccccctccccccaccccacaacagtccctggtgtgtgatgttccccttcctgtgtccatgtgttctcgttgttcaattcccacctatgagtgagaacatgtttggttttcttgtccttgcgatagtttgctgagaatgatggtttccagcttcatccatgtccttacaaaggacctgaactcaccattttttatggctgcatagtattccatggtgtatatgtgccacattttcttaatccagtctatcattgttggacatttgggttggttccaagtctttgctattgtgaatagtgccacaataaacatacgtttgcatgtgtctttatagcagcatgatttataatcctttgggtatataaccagtaacgggattgctgggtcaaatggtatttctagttctagaagaagacatttatgcagccaaaaaaatatgaaaaaatgctcatcatcattggccatcagagaaatgcaaatcaaaactgcaatgagataccatctctcaccagttagaatagcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaagcatcttggattctaaaggagatatgaactgaatctatcttaaaaggaggcaagtatcctattcataaggaaaaacatggtctggtaagcatgaaagacaaatgttgtttagagactcataatctgcttctaaagtgtcatcaaagagttaaagagttaaggtttcaatctccatggagtttaatatttcatcatttacccattttttcacaacaacatttttttttttttcgagatggagttttgctcttgttgcccaggttaaagtgcagtggcaggatctcggctcaccgcaacctccacctcccaggttcaagtgattctcctgcctcagcctcctgagtagctgggattacaggcatgtgccaccctgctcagataattttgtgtttttagtagagatggggtttctccatgttggtcaggctggtctcaaactctccacctcaggtgatctgcctgccttggcctcccaaagtgctgggattacaggcatgagcctccgtgccctgccccccacaacaatttatgagtgtctgctataccaaatgtcaactggaaatgtggcactaaacaaaacagaaaaatgttcctgccctcaaggaacttagatttgagtggaaatattaagaaaccacatgttaatacagatcattccagggtattacctatagaattctggagtctacaccagtgttcctagcccaggtgatgttacctccaagaggcatttggcaatgttttttttttttttgttttttgttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgggcaatgtttaaaaatatttttggttctcacagctgaagaaaggggttgcttactggcacctcctgtttagatgccacacatgttgctaaatatcctacaatgcacagggcaatgtttatagcaaagagttatgcagaccaacatataaatatgtagtggaagggttgagaaactctggtctagtttaatcattgtcctttacagatatgtctattaaggctaaaggttcgaattatacattagcagagctcgaattggtacttgacatcttgtgattgtgcttcaggacacattcgttcaggaattttctttaaaattagtgaatttttgaaggcatataaagtcttactaactacttagattattggaaagtgacacctctgcaagaaaaacaaaactaagatggatttttttctgggagaaagaagaaagatttcaggaatagtgacatgaagatggatattttaaaactgaaaaacaaaaagttacctgcaaagagctggttaaggtgactgacgttcagcgggtagagtttcgtagtctaagaactcagaatgcgaatggagtaataaaagagatatcaaatataaagcatttggaggttgagggtgtttccgtatggaaacagttcagacagctgttacagagttagtttcctttgaggatattctgacgtgctgacatgaaatcaaatctaacatttgactcccttttttctgtaatgtgatactaatacaaaaaatgacaggtagatgtggttctattccaggacatattgtgttaatagtctttgtataaaaagtttctatgctttagttttagtactggtcctttgacaattagagtggctcttcgatatcagctgtttcttttaaaaatagccatttctttcctttagcatgtgactgagcttggcacttcatttaatcctctcaacaacatatgagcttggtggaatcatgtctccattttgcgtgatagaaaactggaggcttagaaaaatcaggcaattgtccaaggtcacaattagtaagtggttcaactggaatttgaatggtaaaactggaatttgaaagtggaacagatcgcttgtgtgggaccactgtttcctatgcttcctggcagagagaggctgaggtacctgaagctcatcagcctgctttaccagaaatagtccctgaagcgcagagtatgtttactgtaaggatgcttctcaggatgttattcaatacttttcattgtgtcctctctctgggaccaatcacggacatttacttctgactccaagggtgggagtgattgtgttccttaagctattcacttgtttttgctttttggatattgattcacgtaatggtcatcgtatcttgtttgcattccctatagaagagcagaaaattacgtgtcttcctgtatctgaaaaacatacatagatacgctctcttaacatgccttctaaatagtaaactcactgttttatttattctctttatgtaccctttttggtctactcttcaccttctaaaatgtattttattgtaatctattccatcttgaattgtgggaatgctttctcaaatacgaaaagccatacatacatttaaattactatttattgattgcctactatgtacccagtgaggaatataccatttgatcctcaccaaagccttacgaggtaaatcttattatcgttattttatcagaacaggtctaagaaaatttactaatttgaccagtgtcacaatgccagaatgtaaattcaggtctggctgactctgaaacctgatgcttttcataatataatatgtcaataattttcatctgaaatgcttctgcaagtcaccataatgagaaaatttgcaagttcctgctgccaaggggatggttggagaaattggttataagagttgagaaaaaaaagattggcaatggtggtataaaaaggcaaaaacctcatattaattagcataacatctctttctttaacataggattaggtaagcctctaacacgcaaatcttttcacagggcatctctggcctttattttctaggcatgtggaactgagccacacctctaattgcttctgcttctgtttccattgctcctgctgttgctgaggacatgattgataggagatgatggctagtggagaaccagggctcagaaagacacttgctatgtgcccaatgtgtatgcttgcacaatatgcttcattattagcttgacagatctccaagtggcagattgggaatgaattttggacctggctagcatttctgttacagacattgggtttttaaaaagctcataaatacatatacatatatatatatatatatatatatatatgtatatgtatatgtatatacctatgtatacacacacatatatacatatatgtacacacacatgcatgtaaatatatatagatgtacatgcatacttgtgtgtgtatatgtatatagacataaaatgcaaaataatatatgtattatataaatatatataaatatatgtatgtatagatgtatagatatgtgcatgtctatacatgtccatacacatatatgcacttagcactatatacttagtacatatacatttttagtaaatgtgtacttataagtgtactttaaattctttgtttctaaaaaattgagaagggtgaaggctgtaataaaatatcacatcaatttctggtggtattggactgctgcacacattcctacatttcttttactgcttttagaatgaggcagcacacaaaatacgttaataaatataatatgtataacttccaaaacttgaagtggtaacacatactgatgaagctttacacttcattaagtaaatgaatgtgacttaaagttgcagacttcttaagtatctgacctggttgttctatacaaggatcatgtgtggaactaattttctttgaaaatgttattggtgttatagattacaaacttttgtgttgctgttaaatatttcttagtcttttaacctttacaaaatctaaaagcttatttaaagcaaccctttcattaacataatacaactctttaaaaacactgatagtcaagaacagaagtaattaccaggggctttcattgtttatacttgttatactttcatgacaacatgtatgctgctttaaaatctattttttctcctttttaaaaaactcctcttacgatcattcccagtaaatcaaaatctctgcaagatgatgggtggcatcatggtgttctatgagtgcttcagtgcggaactattaggaaagggaggctgaaaggaaatgctgactccatccttcatacggttgatggttgctcttattagagatgaaaagaaaatgagaaaatgcattggcttgctttttattaagcacagtaggtaaaacagatgaatgcttgaaggctcattgagctgccataaagaaatttaaacattgttcatattggctagtcgccaggctcatgctgtaaactccagatgagggtcatgattgcagaggaatcgtcagctctattggtagacagtttctgtacgttcctagactagtaataaacctgagatttacccagcagggttggtgggattatgtttgttgtacatgacttggtatccatcttaattcctacaaaataattaagatttcttagcataaaatgatggcgtgacttgactttatacatttggattttgtttgtatcattgtattataataccttatatgtgtgaataaatttagcttcctcatatgtagatctagaataatatctaagagtaagagtggagagaaaatcgtataataaagtactaaaatatggttagtaaatatggttctaaaatatagtaacgaattttttaagttaaaaaataaagctttgttatcattataatttgtaatctttctaagattaacagtgtgctttccacttctttttaaattctttcaatgcctggttcaaaatctgaacacagcttttgtgtgaataatgatgattattttatcgatcaatatttttgcttctttattaataaatgtactataacaatatctaacaaaaaatgtgaagcaataagaaaaggtggataactttcttgaacataggcacacatgggagatgtaaacctggacatttgttacactctcatttgtagtttatttcagagatttatagcatctctcctatctacacaaataatttaccatgaaatttattcaaaattaagcttcataaaatagagacataatccaaatatttggctgagtgatcatgcggttgactaaatctttaaatattgaggttgccagggcaaatgagttgggatagttaatttacaataaaatgataaaagaaattctgctgtattaggtaacaccaaatttgccttgtatcagtttaccttttttcaccttcattttatttttagaaagttacaaaagaaagtaataagaaggtaactgtttttatttctgaagaaggaagatggttagaaacagccattaatttctattaaaggtagagatactcttataaagcatacactttttggtcagacacggtggctcatacctgtaatctcagcactttgggaggccaaggcaggcacatcacttgaggtcaggagttcgggactagcctggcaatcatggtgaaacactatctctactaaaaatacaaaaattagctgggagtggtgtcatgcatctgtaatcccagctactcgggaggctgaggcaggaaaattgcttgaatcctggaggcggaggttgcagtgagacaagatcatgtcgctgcactccagcctggtcaacagagcaagactctgtctcaaaataataataataataatgataataaataataataaaaaaataaaaagcatacactttctaaatactctttgatgctgaaaaatatagacgggaaaggttaaagagtggctgtgattagtgagattagctttccagtttaaataaaaatttagcaatcaaattcagttaaaaagaaatggattactttaaggatgtaaaaatgtgaaagttatttggaaattatcaagttatttacaagtgaaattatccatcttggaatagctatgttaagatctaaagacgtgaaggtagtaatttgtaatcacattttatttgctattatttattcactggtcagtcatggctatgattatgtgctactgcttcgatgcctgtaatgatcagaaaaaaaatgcctttataatccagtggattctatgactggaaaagtcagtgaaaatattctatgaatcctcggaaaatactctttacttactccaaaagattttggtgtgttcgaaacaattttctaaaattacactagatacgaaagtaaaccttgtggaacctttacattttcaaccaactgtaccatgttatacatctcagcctgttgcatattgctacatttctcttagcttaatagctattgtgttctctaagatggtgccagtttataaagtttggtcatagtagcctaatgtattttcaaagaaagttgcattttttccccaaataattttacagaaaacgtctttggtaaaattgctaagtgaggaacacaggcttacaaatacatcccctaggtatgccataagttcatagtgaagttctttacactttcaggaacactgaggctgcagtcagagcctaccctattttaggtacatagttttaatatgctgagtaatttggtttcaaagctcataggagatgaaaatctgaaagttgaaaggggtaaagaagtacatagaatgagtatagtaaacatcacaattggcagcctgagaataggaaaagaacccaaggggctatgataacatacacacgtgttcaagttacatttgcctggggccactgtgggaccacagtcttctatgcctcagtaaactctgagtgttcacaggactgcaaagtacataaagcaaataaaaatattcgtagttgtggccttgagacatcaataaatgtttaaattatattcactccactctggtaaagaatcaaattgttatataatatattttatatttcctccatggaaaacaaagattagaaacatcattgctttaatcagtataaatggtatataaatcagaggtcctcagggtttagcttggctctatcccttatttgctatgggactgtggacaaactatgtaaccattctgggtcccagtttcctcacatataaattggagctaacaagagataacaatagcatctccttagtagtgtcattgagaggataaagtgacatcatgtttttaaaatgttcaacacaggtcctggcacctaacaagtactttataagtgttaggtttatcataagagggataaatccttactatggggaaacgttagctatctagaaagtctttttcctaaacgttccaggaatccagacaactgaaggtttattatacatcaagtaaaataccaaaataaacaaaataaaatttcactaaacagtgtacaatttgtcataacatacagtatttctgcactctaatttaagagctcttcaatttttaattatatttagaacttcaactgatccatgattggataggttttcagaattaaataactttacttggttcagtaattggttctgatggtctgtctaacatggttcaggattgtttcttttaaaacaaggcatgtcataccattctgaattccttataaattctgaattaccttgctgtgacagtattttttttatcatgtagaaaaccagtccttattcagcaccagataattagctactttgcaaatgtcatgacgtttgaagcttaggcatgattactgagacttaatcacactaaaatccttcatatacattccattgcataagattgttgagtataaagtggaggtgcagggatatagatggtgatgtgtctatgaataggtaggaaatcagaagacattttgaggcagacagagagcacatacaccttacacaataaatttggttaaacatagtcaaaagagaaaaaccagtgaagacttgttactcaggtgtccatcaatattatatgcaaacgttcagtcaggtatataatcagtaactgtcctgaatggcatgtgtattcatatttttatatgttaaacatatcatttctacatttactttttattttttcctctttttctgcaaatagaccaaagttctcacattgggaaacatattatggctacaaaatgtttaatcatttttaagtgaattatttcaaaatttctttgagaaacaaataacagctactctcttggaggttctgaaaattgacttcagacgtgggatgtagtcctgtttagatattgaggatctaagcccaagggatcacttgcaggtctctaatccctcatggatgaatcatgcatttcctgtgtatttcttgagtaaatattaaatcgaagtaaagaacttgtacgttacgagagactgaatatttaagtcggtgtttaacacattatggaaaacatgtataagtcatggtataaatgtaaatcctggaatgtggggcaaaatttctcaattaccttgtacatatccaggaacaactagtgagtcttctatttgtgcatagttaggtactggagggtgattgattcatagcttcacctgtgatttcagaaggctgagtattattatttttattaatttaaatacttcaggtaaattcactataataattcagagtaaggatatcctagaacatgatggctgttattttgggcagtttatttgtaacgttccatgtccaagaatgactcactcttatattaggttgtttaaattggaaaggtcaaatgacttaagcttccaaaaattggtttggcaaatttcacacttactttcagcattgtagttcctttcaccaaggtacatgcatgttagggctctatgtacagagaatttacaaggttaattaaagtgtattgtgcataacacagtcgtttagttggtagttcaatattatgtttggcatgtgtgataacattgcagagtagatctgctgtaactttgactttggtatccttagttagaaacgactactctggtagacacatgctccccagataaaatgcctactcagattcactgttaaacaataagaaaaatagtttctgctgaaaactgtttcatccatgggttgatagtcacggacagagtgtgtataattggcaatgtgtatttaagtgttctacaaaagcagaaaagaaaactgaatattgaagatgatatagtgttcctttgaaaaaattggacaaaataacaatgagaaagcctgccagcacagttataaaggattaatttcctggtattcacatacagggctgataaatatagtctatctacaacttcattatgcatagtgctcttgtcattcaacgtgttagggaatgaatatggagaagcataatgacaatgtcatattgatttacataaaaattttgtgtgtagaataattatatacactatcatatggtataaatttggaaagataaatgctatatgcagtcacgattttaggaattattaattttatatatacatactgattaaccattaaggcattatacaaaatactgtgtaagatgtaacacctatgaaaaatgtgccgtgttctctagatatgttaaatctagtggatgagtaacccataaacataccagagaagtatgtaaggacgtatgaatggaaacatacacttgatattgataaccaggaacgtaaacatttttttaaaagttttctgaagcccagagagcagcagttttcaggctgaagtacatataaactaaagattcacagagacttcccaaggcagtacatgagcttttgtggtttaatggaaattaatgtttatatcctcaactttcatatgtagtgaagttaacatgtgtgagaatttgactatgtttaagccgaagctcttaagctagttctccttcctcacttcccttttcactatttctctttccctattttctacagaaaagcattcttctcatttttctgaaatcttgctaagatgctttgttcgtaggatgtaagtgctaaacaaaaggaaattttaaaatgtgttaagagtgtgaatgaatgtgaatcaaattacatttcaggtcaagtggtatcagttcttggctctgattcaaattgaagaaagacttactaaaattgtcagtgaataaagaagtaaaaatcactttagtgataaattactctgtaatttagcatataactcaagtttgaagaacttccactactatagaaaaactatttttattcctgcctaattatttatgtaaataagattttctggtgcttgcatttataacaatgaaaactagaaaatgaattgattttcagtgcataaaaataagttatatctatcttaaatgggaaaaaagcctagctcatctcagtatgacatcaatttctaataaaaattttattttaattaaaatagtttaaaaatatatatatttaattaggtttcatgagttatttactaaaaataattataataagaaaatttaggaagacaatttgcaggcttaaagcatcaaaatttaaataaataaactattaagttcaatttcaatatttgattactgcaatatatgatagattcatcaatatgagatgttcaaacataaaaaatataaatccttagcataatattttaaatggcgagttaattggaaatatgaacccaagggacagaaagcaaacaacataaaagttctgactattaaagaagaacttgatcgtttatttttacatggatgacattgagttacaaagccttggagtatttagattccattgggtgcatttaggaatagtgtaactgttttattttaaaatgtcaattttagaatatgttagaaatggcataattttcaattgtttacactcgaggaaacattttacataccaccttgaaatatataagtcagtatgtatgagctttaaaaattattttagagtgtatatgagtaataaaagttagaaatttacagatctaggctcatcactttatattaccagtgaagagaggaagacccagagcaattaagtaaactcaccaaggtcattccagctctttgtagcagatcccaactagaaggaagggactatggagaatagaaaggtttcaagaagtgggtaatacttaaggtaaaatttttctgggtgaaaatggcctctagataggaggagtttttgcctaggtgtatcatctccatcaccaccaaaccacagaaaatttcacgttgcctaaattatgaatttttgttggaatgtattggaatgcaagagtgcaaagttatgttggaagtacatggttcaggccaaagattttaaatgctcttcagacattgtatgtggagtgagctgtggaatgtttttaagtagagtgaaggagaaaagtagtatgaagctactataaaacttatggatgaacactatggtaacatggttttgatcatctatccaaattcttctttctatagtattatgattatactaaataaaaacaatatttttagatgttgttgtttagttgtttgtgtttcgggcagtatcagggaaagaattttgatcaaggtgctatttttataaaatcaatcagttattactttacttcgctttatcttccttcagattttatagtacatctagatccactggtatggttccacttcccaatatacatatttctctctctctctctctccctctctctctctctctctcacacacacacacacacacacacacacacacacctttgcttttatctgctccccagaagagctttatttcagactatgggctttgttttgatgtacaggcatggtcgtgcccatcattggctttctccatggctaagtatctatgaatctgtaatattttttaataatattatgtttattctgaataaaagcaatatattaatcacacacaaaactcatttgttgtacattacccatcaaattttaaaataattgaatttatgtaatgggggaatagacagtaattaattcttttaataatttgcaatgaaatgaataggataagtttattgacacaattaattttctgtcatttaattggagaaactatttacctgccatttctcttaatatatgacattagtaagttatttattatacaaaacattaatgaccctattagaccaaactcaattaatgatcacattttaggcatgttgttatattatctagtgctttctatattgtttgaatacacatctaaatatgtatgtatctaaatatgtatgtacctaaatgaaaacaacctagattttaggtaaaaccactattttctattaaatacctaatttagagagaaagcaatttgtttgctatttgcctttttccttcttgcttccttccctcatctagctcctaattgtgttgtcactgctcttgtgtgtgtatgtttgtttgcgttttggacaatatagaatagtgcttttcaaacatcatgcagatggataacctggtgatcccgttagaagtgcagtccttaggtttggggcagggcctgagattctgcctttctaacaagctctcaggtgatatgaactttagaagggaaaaaataatatcctttccccacccattataaagtttatggctgacatgctgtagcaaaaacagattaacaagaggaaataatacatctatttaaacaaagttttatgtgacatgggagtcttcagaaatgatgacccaaagatccagggaaaagtgtatatttgtatgcttcagtttgatgaagaatggacagtcatgtagaaatgggattagaaaggttatgatctaataataatggtttacttaacaaggctgttaatggacagttctttttcgtcttccttctttcctccaagtgcagggcaggacacctgtcacacgaagatctgaagggcagaagggaggagagattctttatgtaactcacaggagaaagacaggagaaggtcagaaggtgccctttctgcttgtgccaagatgttatattttggggtgtcgtgttctgagccccaatgggaccacagtttagtaaggcttgagagactaaaataacacatatttccatttgcttataaaaaattccttaaggaattttaattcacatgtatatatttaaagaatgaagagcaaaaaaattggtggttgggcaaggaagactcatttctggccaggctgatagattagaggaagctttattgctgggaggatctggaggccaggctggcggaggcgggagcagcaggtcttaaggtgtgtcttgtcaggtggaacaaactgggtgggaaaggacagactggtgaaaggccttgacaaaccaattatgttggaaacagaaaggtgtcagagtcttcaaataatttttaggagaatagcatgcttgctatacataggttccatgtaaaacaatataaccataccttcttttggagatatctttctattttaggttaatggggaaatttaaatactagtggggcaaggtgaagtttgtaacaattcaatttaggcaaaaatgccacttcttaattttatgccagattaaataatgaaaggcaattaattttacaatgtgttatacaaaatggcctctcaaacttggtaatattcaaatagccaagaagaaattgaagtgctctataattaatcctaaactttgtattcctatactctaagctagaagagacttagctatttgcctatcattcattgaggtcatttcttgtaccaaaattagaaagataacaggcaatgaactttcaattttattgaaccgtagctgttagctctcttttctccctgtacctgaattcatgaataagcagtttccttttcatggtgtcagaaaatgaactcctactttatatccaaaaatagtcaagttgaggctttactaaaatatggtaattttatttcagtatgcaagaccacagagatctcatgtctaaatacttacgttacaaggtacagagacatctcagataacaaaaaggttagaatttaggagaatagctttttgtccagagtatttgaaatatatatatatacacgcacatatatattttagcctatgtctgaagatgaattatttagaaaatcaaagaaatattaaaaagaaaaagtggaaagccttgttcatgggtaactattttttagtgtggaatagatgcaataataatgccatgaactgcaatgcttcccccaagacctacattgtccccccacttttctgcctttggcattgaactagtgtgcgtaaatgaggttgctctttttgtccagttgttaaggcatgagcagcggggcttgcctttggtactgaggctattcatcaaagcttttaaaaatgttttcattgttattgttgttgacatgactttttgcttctacctcccctgctgagccagaccctaagaactttgcaccggctgttgttttttctcatgtactgaattgctgttggtttgaagactgcaaggggagagtgaaaattatatcggttcctcaattggtgttggctataggtcttgcacaatttctaaccaaaggctggagtatagtactagccctctttaagggaaacggtggaaggcataactgagataaatggatgcattttggagtttgtcagctggagtgtatgttttacacatatattcttatggaaaagctctgtggtatgtgatacttttgtaggtctatataatgatgatttgctattttccaagcatctgtatcaggtgcttataaaccaaattactagtgtcatagttaagtgactgagatttttctattctcttatcctttgtgaaggcaggaagtatgaccattttgggcttgcagttaaagtgggtttagtgtgaaagtagaatgattgaagaaaaacagcacaaatctgagtggtaagtcttcatagttacaccttttagagtttcacttcttgtaaacaaaaggcaaataacatagagtaggaatttaacaaattatgccatgaaagagaaaaatgccactttgaagtgattgtaaataaaagatcaatttaattatacagagcagtaaggatgaaatatataaacaagaatataaaatagaatagaaattgcattattgaagtaattctacaaaatcataatatcaacagaaaggagaacttactgtttactggaaccaaacattctggtgttactcattttccatgtgacagctgttttcatgtattttaatcaataaaatctcataaagctctgcaaaactgtttggaaaactaattatttgaactacacagtcatgtaccacaattaatctatgtgaatgttttttatttatatttcactgtttattttggccaattttgtaactgggtaattttgatgggttaaaatttgaaatccacatggaccaatcaaatgtgctggtgtcttccttagtaatggggaatatcaattacatctagaggtgaatttcagtagtgtacttgagttaggagattatgaggctttccatcatgctacagtgtttggaggggatttatttcttcctttcttcctttcctcctttcctcctttccttccttctttcccccttcccttcccttttctttccttccttccttctttccttcccttccctcccttccttcctccctctctccctccctccctccttccttccttccctcctcctttctttccttcctttcctttcctttctttccttccttccttcctcccttctttccttctcttccttcctgccttcctcccttctttccttctcttccttcctgccttccttccctcccttccttcctccctctctccctccctctttcccttcctccttccttccttccctcctcctttcttttttctcttttcttttcttttccctccccttccctccctccctccctccctctctccctctttctttctttctttatttctcttttttgtctcaatatttgtagttttagtagagatggggtttctccatgttggccagtctggtctcgaactcctgacctcaggtgatccacccacctcgacgtcccaaagtgctgggattacaggtgtgagccaccctgcccagcctggattttcttgacaataaatgtaatcctgacactcactgatagatttgtagattttaaaaattttcattaaaagtgcattcttttctttaatactgtttcgacattcaaatagatgaaacaaaatgatttctaataacaatctagagatgtgagcctaagatcagatatattttacataaatatatcaacccatgtgccaattctttactttcttagtatagcgtcgtaataaatcttgatatctgaaacagaaaaactctcattcctgactttaatattatagataattcttgcctttcatttcttcatatgcatgtaagagtgatgttattaaatgccatgaaaatctgtattgagatttttcttagaattctacaatgtgtagataaatttagaaaaaaaagagtatattttcaatataccataatttttcatgaacatggtgtatctataaacctattaaaactaccctattttttcatatgttttatcatttctcttttaggaaacttgctgaattcttaacaccacaatttttatttatattaaaataaaaaatcagtttacatattttatacattttaagaaagtaaaaaaagttacaaactgagagaaattattctcacacatataattgaaaatatataaagaatttctatgtattaataaataaataataaaaagtggagtaaaagttataaagtagaattccccccacaaagcaaacatatatattcaataaacatgggaagaaatgttccatatcattagtggtcagtgacataccagtcaagtcaagaaagcaatgaattacaattttaaactgtttcattgtgaatatatacatttgtttattttagatatttcaaggattgaagaagatgtgatttttacatcttccatctaaatttaatataaattgtaggaatataaatgttttaactactttaggaatctgtttgacattatcatcttgagtaaactaagcctttcttctcctaaatatataccccccaaaaaacccttgcatatgtttagcaaggtatattttcataaagcactattaaaactatataagatctcaaaataatacaaatattattaaaaagagagtaaatgaataaaaggtggtatgttaatacaatgaattactacactacaatcaagattaataacaaatgacattaaaactgtgtacgaaatttagcaatatagtattaagtaaaacaatcaagattaataacaaatgacattaaaactgtgtacgaaatttagcaatatagtattaagtaaagagtaagtccttatgagaacacatggacacaggaaggggaacatcacactctggggactgttgtggggtggggggaggggggagggatagcattgggagatatacctaatgctagaggacgagttagtgggtgcagcgcaccagcatggcacatgtatacatatgtaactaacctgcgcattgtgcacatgtaccctaaaacttaaagtataattgaaaaaaaagagtaagtccttaaattcacatctataatagtaatttttttaaataaaattaaagaaagctacatttttttatatctaaaagcaaaattaccatgtaaacgtgacttagaatatcaatagcccagtgtgtagggagacagggatgaagtgaggaagacaatatgattagatgcatgtagttgttatcaagtgtacattctgcatgatagatttacagatacttattgcagtactgaatgaatgtaattatgaatcaatgaatcaatgcatggatcgaatggataaatgaatgcatggattgataattgaacaaatatgtaaacaaatacataaatataagccagacatggtgactcatgcctgtaatcccagcactttgggaggccaaggcggttggatcacttgaggccacgagttcaagaccagcctggccaacaggccaacagggcaaaaccctgtctctactaaaaatacacaaaaatcaacctggtgtgatggtgcgtgcctgtaatcccaggtgctcaggaggctgaggcatgagaatcgctcgaaccaagaggcagaggctgcaatgagccgagatggtgccactgcacctcagcctgggtgacaaagcgagattctgactcaaaacaaaacaaaacataaatatataaataacggccatacatgagccaatttcacaaaccaaggattatgattaatgtagttctgtgaatttagtttcaatagaaatagagatatccataattgtcacaaaatgttactttttgttgacttttcattttttcctaagagtttctgccctatgatttcaactgacttgtataaaaagttagttggtggtggatgtgtactgttgatatccaagaataacttttatctgttttgttaagtcgtggccaatttttcagtttgtaatgttatgttagatgaggaatgggctgggtgccatggctcacacctataattccagctcttttggaggccaaggcaggaggattgcttgaagccaggaattcaagggcagcctgggcaacaaagcaagatcctttctctacaaaaaataaaacaaaatttaaaaaaaattagctgggcatggtggtaaattcctgtagccctagctacttgcaagactgaggtgggaggattgctagagctcagaagtttcaggatgaagttagctatgattgcaccactgcactccagcctgggctacagagtgagaccatgtctcaggaaaaaaaaaaaaaaagaggatatgacttttacacttaaaaccctacatgaagagaaaagatcaattggctctcagtatattaatgtcgaattccaaggcagaatttttcttgctgggacattttagagaacagcaatgataacatgcaggacaatctttaaataacgggtattcactattcaccagtatgttgattattttctcaaacattaagaaaagtatatttttaaggggaggtaattacgcagtatggggtagccagatggatatgtgaaaataatttctattcactttggtagttggttcaacatgctctgccaaaaaccaacacaaaaatattatataatcatctcatcaagtaacaatagagaatttggagacttaaaaaattttattttgctagtagcttgaaatctcatagaggtatgtgagcccaattttgaatctgataattgaatttttttctaaagatttcaatattgtattttatgcctctgctgttagaaccacagttaagtcagttccagcatgaagaaactattcttctttaaccacagttctaaactcaattcttgagtttaacatctcttactttaggaaagtatttcattttactgtttttaaaatgtggataattgtcatttatgacgatttacctgtaaccaatgtaggtttcgggaaacactgttgcccaggaaaatatgttaaatagtggcctaaaatatggaattgatcttattttctttagagtgttgttaaccttaacaaatcacttacttcatttccataactttaaatgccaaatacttgtaaaacaatagcaaatatttaaaattaaactactcatagtgtttataataaactatactgtggacttgattatattttagggggaaagaaagctttctaagagttatttggtatccatgaatctaccctttattaatctcagaaacagaaacctattgtattctgtctcaaacagctaggtttatattaggttaaaaaagtcatactcagcatggtataaatacatcttaaatttggccacattcccatgctcaagaatatgacgtaagaagtcacacagtatgcgagagtgattaaacatctttaatctttggtccttctaggctttgtagctcaaagtcaaaaagaaagcccatatgatctatctctaactgtatacactgcactatggaatatcaaaagcagtcagtcctcactcaaagaagattgcactgctcaaagtaaatgctgtcttaccatgagttttattgctgaaagcaattcatgtaaataaaatgaggataaagcaacacaggaatatttcaccagtgatttcatttctttccacatttcaaaataacagttgtataatttggataattcctctaattcctactgatttaaggaaatagcccagccaagccaacagaataataatgacaataataataataataataaatcttacatcttagggatattatatcttgctgctggtgctgtaaattttaaaaccaaagccactatttgtgcagtatatattttaacatgacaataaaatattaagttttgaatgaagtaaatgggaattcatagtagcattttaaaaaatcaactaggctttctgaacttgtaactcaggattacagatataaacacatcacagacatttatcaccactattcttctcttttatgaccttttgaaaagaacataatttctcaaaaaaatatttttcagtaatctctgcacaagataatttgccctttttctaatcttcaaagtgacagattgcataggttgagcctttctgacttacatcacagagagtttcatgtttcagtatgctttcctgtctcactggctgacttgattgataatagttgaggtagtgcaaaattaaaaattaattaatttgagtgaattggtaataaagaggactgagcagttgtattgagatgctaataggtctattccagacctattctagccatctgatcctctggaatagccaacagctgtggtaggcaaaactgacaactgagcacattcaagggtaagggtcaagagtttgtcatctaaccccagtggggccaaagcaggggctgttcttcccaagactctagttctgggacaaaagcaggtcgcatggttgaaataatacatttgtatggcattactagaaaatatttttataaaataataatatagtctcagatgatgattttctgttttgttttttgtgtttgcttgtgaattagaactttctgagcaaatttctgtaagtcctccagtaactataatgcctgcttcattcactattttatcgggaaaaagcataattaatgcaattaagactagtagaaaaatacttgactggtattttgctatacatatagtgttatgcacatatttataccagcctaaaatgcaatacatttgtattattttaaaggatgaaaggcagttaattaagaaaattacatttcatgacacatataataaagaatattctttattttatgatagtcaaatatttcaactatccagtaaaccagtaaagtaggaggtttttatatctatcacaaaactaatatatagtgtgtatattttttataattatgcagatagtacccattcatttatgagatttttaataaaaattcagaatatttttagaaaataaaaaccattcgcattctagttaaaattatgatttttttgtctatctaactaaactatagaaaaataatattaaagcagaagaaattatggacaatttgttaccaataaaaataacagaaagcacaactgatttaggttatgaagatggataagctgatttgagacaattgagttcaataattattatagagtaaactctgagaaacaaaattttaaattgaaatgttaaattcagagatgaataaaataacacagtacatcttgaaaattaaggacatggattaaaataatcaaatgaaatgtttaatttttactttataaacgtataatttatcttttaaaaaaattttttttttcatttacctgaagaacacattatataccttgtagcttcctagagatagtgtcaccagcctgttaatttgaagcagtcaaatatctaatataaacattaaaaaaacaccagtcattgcataataatatactttttaatgtctctcctatttgatttctttttgtttttccttaggaagaataagaaaaagatgattagctattttactcgaaacccaattacctccacgtgtctggtgggaattttcacaccacacaccaatcagtaaatcagccaatcagtgttgacctactgtagctaaatattaggtatttgaaaactgattggcatttgccactgactgaatgcattcagctaaaatttactatagtggtggtgatgattttcttatattttagcaatcttgaaataactatttctattacatctactaacaacgccaataatgataacatttctactattgtgtatattaagactattatacctgcttattaattccactaccattactaatacatagcatttattgggctctttgtgacaggcattgttcatttgtatagtagtgtatttaatcctcataacaactctcattgacaaataccattattttctccattttaaaaatgagaaaatctagatggtttatcagtcagtttcttttatcacccccctgcatgattttaagagaatgcaacgtacattctttgtttctcatctgaatagtctattatttcttggaacacaactaaattaaaatacagtatatttcaggtttttgaaacagaagattaaaagaaaacatattttaagaaataaactaattgttttttccaatgatagtttaactttatccccctctcagccccgagattaagggatcatcaagcagatttataaaacctcaagccttaagcttatattgataggaaggtaaataaaattatacttctctgcatcagaaaacaagattaaattgtcctttagtgcaataaaatgctgatctcaaacctaggttgattcttttaaggtgctttctaatcaatgaggatatgaaaggaaatacacggttggcagagttgggaatccaactcaaaatctaaagaagacgatctttgtctaattgctacaaatgattgtaatatgagctgctgagttttaaagtgattcaagtcaagaactgtaattctacagagacaatcattcccactgcaggttaaaatccatagaccatttccattaaaaataattagcaatcatgtcttgggagatacacattgataagaatgtttcaaataactttagaatgactgtaagtttcagtgtgaatacaatgtccaagtgtgcactgcaacataatgttttagtattttcttttttgttgttgtttttgttttgtgtttgtttgtttgtttgttttttgagacggagtctcactctgtcgcccaggctgcagtgcagtggcatgatctcggctcactgcaagctccgcctcccgggttcacaccattctcctgcctcagcctccccagcagctgggactacgggcgcccaccaccacacctggctaattttttgtatttttagtagagatggggtttcaccatgttagccaggatggtctcgatctcctgaccttgtgatctgcctgcctcagcctcccaaagtgctgggattacaggcttgagccactgtgcctggcctagtattttctttctttcttttatttttttattatactttaagttttagggtacatgtgcacaacgtgcaggttagttacatatgtatacatgtgccatgttggtgtgctgcacccattaactcgtcatttaacgtttggtatatctcctattgctatccctcccccctccccccaccccacaacaggccccggtgtgtgatgttccccttcctgtgtccatgtgttctcattgttcaattcccacctataagtaagaacatgcggtgtttggttttctgtctttgtgataatttgctgagaatgatggtttccagcttcatccatgtccctacaaaggacatgaactcatcattttttatggctgcatagtattccatggtgtatatgtgccatattttcttaatccattctatcattgatggacatttgggttggttccaagtctttgctattgtgaatagtgccgcgataaacatatgtgtgcatgtttctttatagcagcatgatatataatcctctgggtatatacgcagtaatgggattgctgggtcaaatggtatttctagttctagatccctgaggaatctccacactgacttccacaatggttgaactagtttacagtcccaccaacagtgtaaaagtgttcctatttctccacatcctctctagcacctgttgtttcctgactttttaatgatcgccattctaactggtgtgagatggtatctcattgtggttttgatttgcatttctctgatggccagtgatgatgagcattttttcatgtgtcttttggctgcataaatatcttcttttgagaagtgtctgttcatatcgtttgcccactttttgatggggttgttggtttttttcttgtaaatttgtttgtgttcattgtagccctttgtcagaggagtagcccttcgtcagatgagtagattgcaaaaattttctcccattctgtaggttgcgtgttcactctgagagtagtttcttttgctgtgcagaagctctttagcctagtattttctttataatttttgtcttctttagttaatgcttaaaacacttgaactggtggagttcttaaagccatttggtgagacattatgtaaacgttatcccactgccaggactcatttatcttaccacttgttcttttacaccatcctatacactttatttagtgaagtacaaaaatatttccactcaggaaaaaaataaagcccctcactttgatattgtctcccctattacttctgacaatacttatatttataatttacaaatatggtgctgtgacttgtcttaggaatttgattatttaaaaatatgaaaatatggcccttacacatcattttacatttgtgtaatactaattttatgtgacattattgatacacaaactgtaattctgaaaaaatattattgggggaaattggctcataataaaatatttttatgaaaatcaaacagatttttaagccaataaaatagctaggttaccaggaatattaatttttagaaaatctgaatgaaagtatctttgttatattttgtttatgttgcttatgtgtttaaacttttatcacactgaaatatatgctaatatctaaaaattttaagtagtaagatttctaaaatgatatgagctaatagtattcacatggttacatatttctgtacatccaacatatttaaattttttccagttaaaaaaagatgagtaccttaaaaaatgttttatactatccattaaatttttgaagccaatgtatttatattatttttctgtatttctgtaattcataccaaagtatgaatttagtaattataaactttgaatagtagtattttcatgaatatgaatatgagaaaagaagtattatagaaaatacaaagaaatattttaaattagctctacttcctatattaaaatattatttcagccactgtggtagtaataccagtaatagcgatgtggatatgcagctttatcagtggctataatgtgaacatttcttcagctatatgccacacagttgaatgatccaattgcaggtctgggcttttcaattttgccaaattctggctattgtattaagcattggtttcggaaatgaagtgacacattttcctatgaaaatgcaattgagcagattgttctgggcaaagttcaattgcagttaaccctgcagatgaacagttacgctctcattattcagtgtcactcaggtcaatctgaattattaaagtgtattgcagaaagggtaagtattgttggccattcttgaagaaacatttaaaaaaattaccaaaccagcggtttgtttgcaatggttttgattcactttcattttattgtttcttaaagataaatagcacagatcatgcctatccagaaataattagtacatacatggtcttttttgaacaactttgagttactttaaagatttatgtactctttatgtccttattttaaaagataaatttaaggctagtatagaatattgttaaattctagaattctagaatatccagttatatagttatttgaagaatacttgaaggaacaagagtagaaaatagtaagatatatcagtgatttgtttttcttttaatgcatttcacagttaataatcttcaaaaagcattacgctattttcatgtctgtatactaatcaaaccttatgatatggttttatataacttgtaattgatgaatattataaacatgaaaaacaatattatgccttgccaaataagttattttcagcttgatttcataaaaagagaaagagaaatttaaagattccttatgttgattgttctggtgagatagagcaaatatagaaatctgttggactcccatcattgtgaaaaatcctactgcaatgggcaagattaatttgtaacactttctctgaagtgcgaattaaatctgatgtttcatgatgatctgtagtccatgtggatgcctgtgtacattatagacctggccatccagctggcatctactgttatcagagtgctagccctggctggttaaatggattttgcctcaggttaaaagcctttagggaagtgggtcaaattgtacaaggacagcttttctaattccttgcttgtgatgtaaaggtaagaggataataaggttacgtaaagccctgcaatatacaagctcatttagaaatactcacatggagaatctcaagagaataaattagatccacagttgggttttgcaaaaagtcatttactgaaatggtagacaagttcctctttaatttttttttcatattgtatgactctcttacgctcaatttaaacaataggaatgctgactattcaaagggaaatccactgagatagtgacttatatttcacatatgatatgtgatagttaaaattatgccaccttctgcattttagattatgtgattctgaagattgcagcatgtgtgataaatatcacacttccagtgcagtatggaaacttgaagtttatattttatttataacagaatttagtgttttaggcactcaaaggctgagagaaatcctcccaggaaagaataaataaacacttagaaatcactgaatcccacagttaattgtttatttgatatgtttccattttgagaaaaagtaagtttaaaaagttatttatttggaagatagaataacattttgatgggtctcacaacactttaacatgacataggacacagctgtctgtaccaggatcctctactgaataggtctggccccctgctggcctaactctttgaccctcccactaggttgtgtcaaagagcttgcaagggacacaatgaagttgccatcattcccatgggcaatggcagttcaattattttacatgtgaatatatcgaatatcaattgctactctgccctttatatgatacagtggacatactttcaataacttttctttgatagaaatatgtataatagctaagggaatgaaatatgagttgttgtaagaagaattccaggcttttcagatattcattgctaacatttacattatttaaatctttttttttattttgctccttattactgttgaaataatctggaagtaaggttggtttaatgtcctttggagcagtagattttcctgctggacaatttcaaattgaagttcttgtccttgagttcttactgatgctttatacagaacaagagcaaatgttagcatatagcatgtagcatgtagtgcctgtggtctttactgactcagtctcctgataagagtcttcagtaccattcaacgagtacttcttgagcatctactctttgtccatgtttttctagataccgggaataattagaaagataagtaaatcccagtcatcattaccaaaaagtcctagtttgggagataaagaatagggagaagacaaataaagtaaatcatttcagggcaatactgtagagatatacagactccatcctctgagactgggaaagatccagctcaagttgaggggatggggaataattctaaaaagcagataaacttaaggccatacttaaataattaatagaaaataatcaggcacataaaaggtgaaaatggataaatgaatcttaaataatatcatggcaaagttctgaaggtaataataaggtttaagcaagggaagtatttggtattgctgaaacataaattgtgagggattcaagaacagaaaatgttatctggagctttaactttatttatgtgttgtcagttcaagaaattgtgatgggtttatctagactagttttataaacctgtaaagaaagaagcagaacccaaaagtacataggatttgaagaccatggaaacaggttacttggaaaaagaagtctaggtaatgctgttttctgatcataggaaatatgaggcaaaaactagattgtgaaaaaagtgatgagttcagttttgggtattttgtggccaaagtcattgtgggacatccaagtataataattcagcaaacgaaatttgagtctaaattttattgtaaaagatatgattgacatgcagatttatgatcttcattgataacatagacactgctaaaaatctagagagtggatgaaattgtctatagagactaaaaaaagtagagacagtgctgatgtaaggaccttgggcaatgcagatgcttaaaagaattttcacttccttgatgttctttgtctattgtttatgatacatatatttaatttaccctttctacttgtccctctgttaatgaatacacctgcattctcccaattaaaaacaaaaccccaaatattttctcaatatatcaagtcaccttactatttatctcatttccttaatctagactaataaggcaatcaatctaatcatttccttaaatgcgctgcaacatctactgcctgcactttttcaccatgaaatccatgcccatttttctttctggcactgtatgaaaatgttgttcctggagtttatagcatgagacctccacgttaccagacagatgatgatttttctcaactcatctttcctgagctatctgcagcaagtgctctgttgatcactagactcattctaaaacgtctgacttcctgcaactcagggatttatcactcttggttgccttttaatccccacaatttgggtcaacctagctattttctccagttgaagacataagtgcccagttgccagaactttgtcttcatttttatttctcttcggctaatatttaatatcgtgaattctttaaaatatctttagcagctgaaatgcatttcggtgtagtaatagatacacttagttgaactggcataaacactgtatataatgaatataacattacatctcaggaagtccaaatgatagaagtgtttatacgatagtcaaccagattattcctgttatgctataatccctgcagcttcatcattggtgactggcaggaatttggttgtggcaattccaggcattatatccagaaaaagggagattgtctttctaggtaatcctactaatgaatgtgcagatttggaaaagaatcactttgcttctacataaattcatgttctttaaaggacaaaatgaaaaaccatgtgcacaggtccataacacacagcatacttcaaattcttctgaacagagagaataaggaagtcttgttcttacatgaaattaagtactttttaatcctatgtgtcagtcctcatgtggcagagattttaatctgcaccaaaaatctatttgcaatctccttttcccagtatcccttgcagttatatttgggtccagagggtagttcttaccaatgagctgtgagtaaaagtgactaatgccacttttgggtggaagaagttaagaattgtgttgcttcttcatttgcctattgcctttgccatggagagcttttgttcttgaaacaatcttcctcattcattaattcttcaaaggccctggttttgtctccttcctcattattttataagagcacatgggatatgagtggtcctggcattgagaagctttgacatctcacttcctcttgtttcctgtttgggctttaatttctttacatattgaacggcggtgacattttaatttttgctaaattcatggtttctttgttagtacagtttcattcatcgttattagcttctgatcaagcagttgtttagatttattttttattttttattagtattagtagtgattttgagacagggtctggctctggcacccaggcttgaatgcagtggcacaatctctgctcactgcaacctccacctcctgggctcgagcaattcccccgcctcagcctccctagtagctgggactacagtcgtatgccaccatgccctgctaatttttgtattttttgtagagacgaggtttcaccacattgccctcactggcctcaaactcctgagtacaagcaatctgcctgcctcagcctcccgaagttctgggattacaggcagttgtagcctttaaactaagcatttcttatagtgataagtttttgctgtttctatatctcaggataataacatctgttttgacataattcaaataaaaaataattgtttcctggccaacatgttgccatttcttactataacaaccacaagattcacccaacattcactctaatgctacaattctgatagatacacaattaatatctttatatattatggaaaatgccagagccgaatgcttgtaaaaaatgttacatcaccagacttactagcttcctaaccaaaaaatgtggggtcctcctgttttgtgatggatcttttcacctggacaatttccagttttaaagttcttttaattgaagttccacatttctagtatacattcctgaataaggacggtcacttttgatttaaatccaggaaggttaactgatgtcatacaaaaatcaaagtcaacattctccttatcaaatcagcttctctgagccactttcctctattagcaaagcttctttatttcttgagtggaatcatggaaactttatcaacaaatatgcctatgcatttactcagttgcttctttccatcatatttattgcccttttcccatatcttccatcctgtttcaggatttcagtaattttatcatgtaacatcaaggtattgctattttgttttctgtctcatgtcatcgtacctttatctaccctattatcacctgcaaaattaatcttcctaatttgttgttctagtcatgttactttcttaattaagtcttcattctataatataccaaattcttaaacttggttatccagaatccaatcttggttactttctgttcttatccccactgctaccctgtgctgacctaatacctaaaccaaactggaaatgcctgagttcaacaaactggatgtaataactacatcagaatttccttaaaaggctcaaacttatggcatcactgcccattagcaagatccttttctactaatctctttcttgaaatggcttctggatgtaaaatcctgccatatatttttaaagtattttatgtctaatagcatttacatacgaagccccaactgatcactgtaactaggtaaaatttatttccccttaatgaatgcttggtgatatctttctataagactgtaaacttcacaagcagcattagtcatgtgtgtccaagtaagctctgcagcccttctcaagaggctgtgtaattagaaaggattaacatctttcatggaactgctagaaacattagatatggaattatttctctgagactatgaaataaaaggtttagccttagatcaaagcagtcaggcatatagaataatgtataatgattttgcccttgaaaatttagaagtcttgacaggtttaataaccaatgttcttctggagatacttttatcaaactactagggttttttggtttgtttttttaaaatcagaatcttccagaataaaaaacaaactagaaaaacaagataagagaaaaacaaataaaccctcttgaatataaatctgtgggaaatcacctacctgggggattttttaaatctttccaatagattataatttttttaaaagaggagattaatataataacttatagaaagtgataaatgtatcaatcacagtaacaattctgggccaaataaatttatcatatataaattgaaaatgatatgtgggaaagatcactcaaatttatgaaagcatagtatgtgttagatatgttttgcataatattgcaaccctgaaggaagtggctattaatctaattaatagagatagaaaccacagtcagtaaaagctacaactctaatttaaatatgaatcaatctgattactaagcccctgctctttcaactatcatatgattataaagataaaatatattaagtaatcaagtgcaattcacaataatattcaaatatcatttttatttcataacaatttaaatttttgttaatttttctaatccattggcatgtcttgctttactcctaggatgtgttccaagaaattgtgtgtagaaaaaaaaatcagattgattagcatcacagccatacattcgatttaatagaaaaatataatgaggcattttaccattccaagtatttcaggccatctctattttaaagtatgttttgtatgtttattgttaattgctgtattttgttttattttactttttaaatggaacaagcatggataaaagtaattatggtatatacaacctaagagaaataaaattatgaattattactacgagtcttagtttctatagatcttctactcaggaataataaattataaaggaaaaacatgtcacagttataggaacatttcttttaaaaagaaatatgaaatattttcagagtaaatgtgattccatacacttcttatactgcaaaccatttccaaatttccacatatgcttgccaaaaccaatgataattaatgtttcattgaattctttgagaaatgttgaattccacgactggtttggaccatatttaaacatatattatgctggactaaattccagaatcagagagaatattttatattttttggctatttgtgttaagaaaaattctcaagtggagtacggacgtaaaatagatttggtataaaaacaatccatattctatttactagttgcttcttcagcatttaagaaactatttggggccagatacagtggctcatgcctgtaatcccaacactttaggaggatgaggatctcttaccccaggggttcaaaactggcctgggcaacacagggagattccatctctacaaaaatttaaaaaattagtcaggcatggtggtgcatgcctgtagtcccagctactgtggaggttgaggtgggaggatctcttgagcccaggaagtcaaaggggcagttcactgtgattatgccactgtactccattgaaacattaacctttttctccattcatatttttaaaatattattcaagtttttcatgctcttatcttaagagatgtcaacatcagatacaatatgatttgcagggagtttattgttcattaagatttttaatttatatatataatttttatatacattatacttaatataatatatgatatttcttatttaatggaatagtataaaagatcaaaatagtttaggcaaaacattgtctgaatttaggttctttaattggtttactttaaacttgctttacttctctctgcccccaacttagtcattctccattgccagaggctgtttagttattccgagcaatagagaaagatttatgcattgacaagtggggaggtgaaacgctggttaaaagagttctgcaaatgatacttctgatcccagcaggagttataggcttacagtttttcaaaaaaagcaaagttttccctgttaataactgtaaattatatactataatattttataccttttttctttttccaatgactaactatacctcactttagggataaaatccctcaagtgcatgacagagatgaatacaatatgtttatatttgggaaactcttgagattttctttgaaaagaatggatttatgagattgaaagacacacacaattcatactcacaccatgccctcctcccacctcaaagttacatgttcttttacaataaaagaacaaaagttctcaaaaacatacatggcttaaggcagtctttaagcattagagcacttctctgttccctgagcctctattaagacatgtatatagcttgaacttgaaagtatatgcatatatttattagaaagaaatatccacaggtggaggtcagttgtctaattcttgcaaaaatgtaaactttaaagatattgttttaaagaaatagcaatttaggaagacatccttgtttataaattttattaactgtcatcttcgtttcattttagcttacacactgagtttagtcagttaataaggaagtttctgactaataacaaagctcaaaattaagaaaaaaatctgatttgaaattatagtttgtggttagtttatatgaaatagaaaaaataagaggagttttttttttaagtagcaaaagcatgtattatgggaagctcatgatcttgcattttgatcattataggagttgaaatacctgcttccttttcatattttaaatatactgtaagttttagggcataaaaaaatcagaaaactatgtttaaccttcttaattagaagcctcataaatatatcaatataaatatagccatttccttgtccaacaatgtctacaattaaatacaaaatgatagtagaaaatgataaacaatattttcactgccctttcagccctccgagtttatatgttattctatagtaaaataatctgcttaattcatatttagactcttatacttagtaacaatataaatctctatagcttatattaaaatattttgaaaacatagcttggaatttgcattgtttagttaaaaaatttatgttggcagacctaatacatgcctgaaatcactttactctgcactgatcaaatagtcaataatccttgtacatttacttctgtgattagcattatttccttcagtgatacatttactctgaataatgggaggagccatcgaatggataaatctgtttataattgcatgtctaataaatcctggaattattttctcaggccaaaatgcttcaggcacctctgcctcatctctttctcttaaactccacatcctatctgtgtaaaactctatcttgataacattaaaaaatccaaccacttcccactctgtcgaattgtactcagctaatccagtcacatttaggtctggtcaagattgcaatggcttcctaactcctctccttgcttccaccccactcccttatccttataacggtttaacatttcctatctatatgaataaagcaagttcttttgaatgaccaacacattgatagcatttaatagatttagaccatctttcaatgtgtgactaccactttcttgatgaatgtcctaaattactaatgttcaagagagctggaagcttcagtgcccatcagaactggcaagacatctcatttctgaactctaaagggcttcctatagggaaggcttgttttaaatagcattcagtaacttcagttgaactaaattgctctgttgcctgaataatatagcaaagagaaggagacttctgttataatattgtgtcagtagaaaaatgctttctgagattcaaacaattaattcataaaaagttttcagatcagaaatttaacaaataacttcctttcataaaaaaagtttatgtaaaataactttcataaataatgtttacttaaaagaacttttataaaatattcagatattagaaaattcttatatatagcatatacttaaaaatttatttttagaaatattttacctcaagacggaagtctatggtagcattttattacacgtatgaccacacatttcattgtcagcaatagacctttttttaacatttgggattctgatattcttgctttaactctggtttcctatatcatggccaaagagagagagagctgcccttagtctgttcatttgggacttcccttaaattagggcttggtaaactatggcctagcaggccaaattctgcctgccacttgtttttgtaaatacaattttattgaaacaccgacatgttaatttgtttagatattttccatggctgctttcacatgacaacatcagtagttatgacaggggccatatggcctgtaaagcctgaaatatttactatctggctctttactgaaaaactgtgtccaaccctgcccaaataaaattccatggtctgactgggtgaggtggctcatgcctgtaatcctaacactttgggaggccaaggcaggtggattgcctgaggtgaggggttcaagaccagcctggccaacatggcaaaaccccatccctagtaaaaatacaaaaattagccaggcatggtggcacatccctgtagtcccagctacttaggaggctaagataggagaatcgcttgaacccaggagatggaggatgcagtgagccaagatcgtaccactgcactccagcctgggtgacagagtgagactccatctcaaaaaataaataaataaataaataaataaaaataaaaaataggccgggtgcggtggcttacacctgtctgtatacccagcattttgggaggccaaagccagcagatcacaaggtcaggagttcgagaccagtctgtccaaggagttcaagaccagtctatccaacatggtgaaaccacttctctatttaaaaatacaaaaagtagccaggcacagtggagcgtacctgtagtcccagctactcgggaggctgaggcaggagaatcacttgaacccaggaggcagaggttgcagttagccgagattgcaccactgcactcctgcctgggcagtagagtgagactctctctcaaaaaataaaaaataggccaggcatggtggctcacgcctgtaattcccagcactttgggaagctgaggcaggcagatcacaaggtcaggaattcaagaccagtgtggacaaggagttcgagaccagcctggccaacatggtgaaaccctgtctctactaaaaacaaaaaaattagctggccgtgttggagtgcgcctgtagtcccagctactcgggaacctgaggcaggagaatcgcttggactcagaggttgcattgagccgagatcgtgccattgcactccagcctggcgacagagtgagattctgtctcaaaaataaggaaataaataaataaataaataaataaataaataaataaataaaattctatggtctagtcctctaagtatatccctagatatgtcccatgaaggctaaaggaatttcttgtcaatgcatgaatttcaagcccagagtcttgctgaatatgcaaaaaatattttcattcaatagcaaatgttaagcaattacattgctctatcatttgtctgtcttttatgaagaaatccatgggtaacatagtgaaaatacccagggaaaaatcactttataccatacggtaatgaatctgaatctataggaatcttaatacatatgagcacatgtccttagaggaaaaataaggatgttgctaaaggagaatctctttcacaatctaatggtatttttttgctgatacagattgtaaatattaaagtaacagttcactgtactaagtatgtatgtacacacatgtaatactgaagataataaaactggatgtttcaatggctaaattatttcaccatgtttgaacaacttcaaatggctggaaaagcaaataattcacaacactgaacttttgaactatcgatccttctcttattgcacctccttccccaaattcccttcttctagcagctcagaccaaaacacttgaggcatctctgcctcatctctttctcttaaactccacatcctatctgtgtggaactctaccttgataacgttaaaaaatccaaacacttcctactctgttgaattgtacttggctaattcagtcacgtttaggtctggtgaagattgcaatggcttcctaactcctctccttgctttcaccccactcccttttccttatcccactcccttctcaaaacaacaaggtgatctttgccacttccccacacaaagggaccagggacttttggagaaatagttgattcctcatttgaagcagagaaagtttgaggtgattcttgagtatcttattatttgaaagccagaaagtgtttgaagactaacgggaatatagcaaagtcacaggggcttgaagtagcttccattggccaaacagcttaacttgacaattaaaagaaaaaaaatacaacatgttaggaaataataaaaataacaactggaatgacagtagtaatacaaatatcaacattatcaaaaactcttaagtccacactgatcctaaataaaaggtggtaggagtgagatgagagaaagaacatcttcacagagtgttagtggacaaatgcattatatttcaccaaccaatgtaataattaacttagataagcattatcaatggatgctaaaaccactggccaacatggatgctaagttaaagatgctgagaaacagaatattcacgtgaactctgtgtcactccataaatttttaaaaattaattacaaagagaataaactatctttaaaagcgaaagatttaatgaacactaacctattcaacaaatttagcaggactcatgagataaactgctgctctatgcctcatgctatgatgcagtaggaagtacacaattacttatctcatgttcttgctgaaatgtccagtcaaaatttgatcaggaggaaataatcagacaaatccatccagattgtaggacattcaataagtaactagcttatgtcctgaaagacaaaaacagggggccatgggggagacatggagctatttgtccaggatagggatgacgagagaaacgacaagcaagtgtgatatgtgatcttgactggatttttgatttaaaatttttaaagaatattttaagacaatgagagaaatttgtggcctatatactagaagacattgtatcaaagttaatcttggaaggtgtgataatgttgtgcttatgagacaaatttccctattgttagatgactcgtgtatttagtagtaattgccattgtacatgacaaatttctttcaaatggctcaccacatagagtaggaaaaacaacatgaaattgaaataatatatatggaaaaataaaacaaatcaagtaaagtgccagtatttgaaaatacagacataaagaaatacagcggttcattttattcttttaacattctatagatttgaattaagtacgaaaacaaaagaaatacatacattacatataatatagcagattatgccacttatttgctcaaaatcttccaaaggatccccacctcagtcaaagataaagtcaattccactaaaaccaatgacaggtggttgatagaggtggggtgaacatgtgacaacaaaaggaggacattttggggagcaatggaacagttttgcaccctgagtgttgtggtatctccataaacctgtacatgccacaaaatccaaacaagtttacaccaaacaacaatgaaaagtcaatgtatgggaaatctcttggcgcctgaataaggtctgtatcttagtttattgaattgtaccaattccatttttctggtcttaatatatatggttacatatatattatcattgagggaagctgagtgaagagtatgtggggatgctgtacagttttacaaattctgtagtctaaatttatttcaaaatattattttttaaattacttgcaagagtttgcatgatctgccctagttacctctctgacctttgctactctcaagctcaccagttcttcttcacctgtggccaccttgctgctgcttgcagggacaggccatccttggggctctgtgttccctaaccctgaccacctcctatcacatcacagtctttttagccattatgtccatcatctgtctttttggctaaaatgaattttgtaataaaacaagaatctttattttgttgaaggatgatattgcctgaaatatgcttggaacatgctaggcgttcactaaataagtgttgaattaactaacaaatcttgaaatgtctgcactggaagtttttgtgtgaaaagtggggcatgccatatttcaagagaatactgttttttaaaaaaggtaaattgtattgtgtatatttgaggtttaccatatgatgttatgggatacatgtagatagtaaaatggttgctctactgaagcagattaacatatctgtcatctcacttagttacattttttaaacacagaagctaacatctacttatttaacaaaaatttctaatacaatataattttagtcactgtagtccttgtgtcttacattagatctttagatttgttcatattacctaatctgttactttgtattatttgacctacatctccccatttcctttctccccattccacccatgaaaactgctgttttattttctgtctattttttcagatgccactataagtgagatcatacaatatttttctttctgtgttttgcttatttcatgtagcataatgtccaccagctccttccacattgtcacaaatagcagcatcttctttttcaaaggctaagtaatgttcctgcctctggatgtgtgtgtgtgtttgtttataattttctttatcctttcttctgtcaacagacacttaggttgtttccattatcttggctattgtgagtaatgctgaaatgaacatgagagtacagatatctttacaaggctgtgattccatctccttttggtatatacccagaggagagattgttggatatgtatggaagttctattgttaatttctgtggaacctccatgctcttttccacaatggcttttccacagtgtacattttcacccacagtatactggggttctcttttctccccaccctagccaacatttattatctcttgtttttttgataatagccaatctattgggtatgaagtgatatctcatagtggttttaatttgcatttccctgatgattactgatgttgagcaccttttcatatatatgttagccatttttatgtcttctttggagatatgcctgttttggtcttttgcccatttttaaatcaggttatttatttttctgctattgagttgtagggttttttaatataaattttggatattaaccccttatcagttgtgtgatatatttttccagtctgcaggctgccctttgtttgcatttggttgcattttgtcagtggttttcttttctatgccaaagcttttagggtgtaagatttacctaaagctttaacaacaaaatttaacaatattcttcagcttgctctattgacagaacataatattactcctttctttgccttttgttttgcacacagtcaaaatcaccctctgtgctgacttccacaccagactgattcatgaatggctgctttttcccattgtttcctgttaggactctatggtcctccacagcatttccactgaaatctttgaggccgtcctgctatttctcaatacatagcagctgctaagctatcctgctgtcttccattatctgcacatttccttctgtggagttatattccaacaaaggttcctgacatgctggctgagcttgctcttcttacaatgccatttgattttcagtaaggtttgctagcagatgatgagatggcagaggaagccagttatggtatttgctattagactcagtcttcaagaggctgtaaggacttccttgtttgaaaatctgctaaaaattattttatattcttcagaattatttgattttattgtgacacttgtatattctttcttcttgatgctcttagaaaagtcactcgtgcctcagactgtctttatacctgcatttttttcccatcagaatgctgacctcctgccttgttctttgtatgttcagctcctttgaatacttcagccttcagttaaaagtcatctgcactgagagctgtttccttacccctggattgaaaatacacttttacttgttcttctccatgcggaccttgcttagaacttgttatttttcatgtatttttaagttgtgtgcattgtctcttttccaatggcatgcatgctctataagagcaaggggatctttgactccccactgtagcctgtcacccagcacagggtttgtatataataagtgctcaaaataaatatatcttaaataaatggatatttgacaaaagtaatttctggatgctattagagcatgtacccagaaaataattatttgaacccaaagtggccacaagtatcagatacgcactcatttataactctagtatattgtccttaacattgctctttgaaagccattttcagtcattttatattttcaagtagttttttaaaaagtgatactattagtttggtgcaaaagtcattgcggtttttgccatacttttaatggcaaaaaccgcaatgaattttgcaccaacctaatacctttgaccaacacacagacacccacacatacatatgaacacacacatttattttatagcattattagtaaaatattgatattatttaattggtttaccttttcgaatgcctacatccaaagataacacaaaatatgcaatagtttaagtcacaattttagttttcactggaaagaacccaaataatattataactactatcaaaaggaactctcgtattcatatctacatggcctatgtaatatcaactccaactgttcacagatcactgtcatcagtattgatagtaataaaaataaaaatatatcagaatatttactctcatgagaaactgtattagtttcccagggctgctataacaatttactacaaactggatgacttaaaacaacagaatatatttttaattgttctggaggctagaagtctggaatcaaaatattggtggggccatactccctctgaggattctagggaaaatgtttcctttgcctctttctagcttcagacagtggctggaaatccttggcattccctggcttgtagctatgtcactctcatttttgtctcagtcttcacaaggccttattcacagtgtgtgagcattttcctgaccactttatgaggacactaatcattagatttacagtctaccctaatcaatatgtcctcatcttaatgtaactaattatatctgcaaagacctttttgaagcacggtatttccccgacccggtcgcatgatgcgtgacaggggtgccttgtttactcagcccacctctctcaactcctaacaggagggagtgcgtaagtgaacacagcggtaactggagtcagaagcactggaaccggctggctgtttcggtgcctgcaggatcaaactctattcactcgcacccactgcgttccacccaccgtgagagggagtgcgcaggtgagtgggtgcaggagccacagcaagcccttttgggcgcctgcaggagctaactccgttcaggcccctcagcagcatccaagcaggatgcatgcaacttccgaagtccccgagggcatgttacagcgctctttttttttttttttttttttttttttaattatactttaagttctcggatacatgtgcagaaggtgcaggtttgttacataggtatacacgtgccatggtggtttgctgcacccatcaacccgtcatcttcattaggtatttctcctaatgctacctctcccctagtcccctgacaggccccatgcgtgatgattccctccctgtgtccatgtgttctctcacatgtgagagcatgtggtgtttggttttctgttcctgtgttagtttgctgagaatgataatttccagcttcatccatgtccctacattgctcttttcgctctgctgtctgcggatggcttaagtgttaacagctcagtaggccctttgcctttttgcgtgaggaggctgccctccaccagcaagggcaaaaggccagtgtgataggcttttgtatccacacttgtggctcccaagctcttgtacagcatccatgaaaaatgaggttgcacgaacgaattgaaggatggtaaatgcgggggattttatcgctggcgaaagtggctctcagcagtaacgggagctgaaaaggagatggggcaggtaggtaatcttcccctgaagtctggccatctcgggccagattcatttctgaagttacgccgtcaagctgtctctctgaagtcaatctgcttctctctgaagtccagccatagtccccaatgtccagttgcttctctctgccagctgagtgtggggtctttctaggcacaggatgggagtggggtgggccatgggtagtttaggaaaagacagcattcaagcaggaaaacagggatagaagttctaattttgggccgtggtttcaggctttttggcttgatggtggggtttcattgtggaccctcccttttcttcctagaattgctctgccctctgtccctatcactatttccaagtaaggttacattccgaagttttaggtggacatgaatttctatttcaggggaggggatgcattactcaacccagtagagtctgccctctggcctcaaaaatccacgtccatcccatgtgcaacacagcccaacattcccaaaagtcttaacccattcacgcatcaactctaagtccaaaatctcatttaaatatgtttggttcaaaaagcttcaaatcttatcatctgaatcaaggatggccaagactctgggtgtgatctatcctggggcaaaatgtcttttcatctgtaaatctgtgaaactcttaaatgagctatctgcttcctaaacacaatgctgggataagtataggataggcattctcattctcatagcgggaaactggaaggaataaaggagctgcttgtcacaagcaagtgtgaaacccagtagggaaaattccactgggtttcaaggcctgagaataatcctctgtggcttgatgttcagtcctatgaatctgcagattcctggtcagccctgtcctacgttctcttccccaccaactcctacctccctcgtaccccttgctcagtgaaatcgtactcatttttcagtcttagtttgactgttagttacgtattctaatgtagatgagttctctttttataaattatcatataaacgttcattcttatctttgcttactagaaattataaagttgagtaatttcacaaataaattaatccttgttcccccaagcaggattcaaaggagaacaggagaagcatatgtcttatttgctgttacatccccaaagcataggtctatgcttgccacatcctaggctctcaggaaatatttattgaatcaataaataagatggaattctgtcttaaaagaaaacagtaggagttttgtgccttttgagttaaaataatgtcatgggcaaaatacctgatttcatattgaagttccaaagagtcattaagaatattaatgaaatgaaaatgtactcttatgctttaaatatttttcattaatttttgtgggtatatagtaggtgaatatatttataggggatattagatgttttgatataactcttatgcttttaatgtagtaattttaagattccagacagaattgcagacatttaaaaattttaacatatcctttggaaattgattaaaaattaaaaattatgttcagcaacaatatagagagactctcccataggtgttttggcctaatataatttttgttattatcatcattttctactgtaagtgcatctctgacttataattgtaataaataaaaaatgcaacaaatcttctttccaaagctacatttcccaaaactggtgtcatagagcatagcatttatttagagatgcatcaagaaaaatggggaatccctgaccacataattttgggaaatgtcatattcaatatcctccttcaacaattaattttcatgaagttcgttaggtgatataaatagctctgcgtagttctacagaaaaaaagttattttctaaaaaatgttgctccttcaaaaacttttattttaatattttttgtaaatatcttgatacaccattattttataaaataattttggcaaaatatgtaatgcaaaatgtgatatggcttttattatttaaattaatttatattctcatttaggataaagcagtttaacaatgccttctttcaaataaatataatctgatttcttgttatttctgtttatttgctgaaattataatttcagagaaaagtatagcagaaccaattgcttaatttctgacccaagtgcagacatcaaggagtaagcaatgcatcactccttttgtcatgtggacattatgaaatttagtacattctcggtaactgtcaagtcctgagaatgagcactggttagatacctgggcaaccttctttttgtaccctcttcctccatgtcaagtttctctgcctttggggaatgtgatactaggaaaaaatttctgtaagatatacacaaggtaatttctatttctcatttctactttaaaaagttttaggatttgattgaaaatttgcttaggaacttgttgttactcaggattttccagtctggcggacactaccagaagatatataaacacaattaaattcctagcttagctctgagctctgtcttctggacttcaagataatccagagagacgcaatcctaccaagacactctaaactcattgaataataaaaatagcataaagtatgaacccatttaatattcataaaaattctatgaagtgggcatttgtattgatttcattttatagataaagaaactgaaacctacagttcaagtcactagtcctaggtcacacagttactaagtgaaacagatgagatttgaaaccaggtcagctggttccttactcttaattactacaccttacagccatcatgttcattggaaactattgttttattgaagccagcttagttcccaggtagctgaatttatcttcacattattagactttaaagagttctgtttcacattttagtgtgtcagtgttgaattgaggatttaaattcaattttagcataacacataaatcagtgaacttcaattactacagattttgactaaaagtcttctgatttttttaaagtaaatatttataaattaactctcaatttttctccaaccctaagaatataacttttcttacataagtagcatattcggtcatcattggtaattttaatgctttctttatgtttctttatcctttatgctgtatatttttatgttctcctttgatctctataattcttctgatatttctgttcggactgtaaacaattggttttattaaaaaataatcatttacaaaaacaattcaataacaaatgagtagacacacaaattagcagtgaaaaatatgatcacataccaaatacaaaataacattctcaaaacccattttaacgtgttcaaatacaattttcttcagaaatagaaattcaccaattcaaccttgaaagggctaaaacctctgaaagtcaatgacttaaaaaaaatttcaaatagtatttcattaaaaaaatgaaattgtctaatgttttctaccacttctcatattatgcttggatgcatttttcctcagagagcataagacaatttgcagagtataagcaaactgaatgaatagaaatcagattctttctaaggcagagctagaaaggaaataggataaaacatgtaacagaaggtgagtgaaaacaaatcaggagcagtgggtaaagtaagcttaccttgccaaatgttccattataaaagttatagtatcaatgatagaaactttaggaaatttaagatggcggacatccttacaattttctttgtaagtacatttaaaaaagatgtctgtgtacttcaattggaagggaatgagggttgactcaaagcatataattaattatccttggctattttacactgtggctaattcagatgttactctctcaggaagacagggagaaacttgatttattttgtctggaatcctattcttattaaaaaagaaaggcttaggcatctactgactgacacaagtcacagccctgccattccccctggaagccaggaagcagaatagcaaagaaagggtgtttctaaatgaacattaaaagcccttcaccatggaggaagctacattaaaggtaacgtcttggcaaggaaatattgctgtttagctatttttttttaaattaactttatgaaggctgtcctggtatgttcaaataacacaaagtcaatctttggtttatttctgtttaagctttggcttgcttttttaatcaaaaattttaaaacaataaaaaattaaaagcttagaataaatgaaggccaaactgacttaacgttttatactagaatattaacagttgctgaggtgatgctgagctcaattttgagaaaagaacaacagataaactgacaggataacattttattttaaaacagtgtgattccattaggctacaagtatgttttgttagtaattttaactgatttgaagctctctttgctattgctctcatttcacattgaccttcagtaaagtatgcaaattgttacaatgatgcaaaagataacgtgcagttcctaatagctaggatgggcttactgatataggttaagaaaaattatgaagttaattacttgtggtaggttgatgtaactcaatccatttttcctagggatgcatttaaatgccaaaagaaacaattcacttgccccagcccacacaagtcagtagtagcacagggtggtgtttgagagggattaaaattcacaaattctgacacttagtctactaaaccacatcagtttcaaactgccctcagtagatcaactttcttctttctggaaacatgtgcttcctaatgctattgctgatgaaagatatgtctgttcatgtggctaatcttcattgcttagaaacaataagaaaggttcgctcatcttaaagaagttcagtgcattctcagaaatttaaagggatacttcaagtttctaaaaactccaaattttattttcctttttcttatttcttgatatgtgtggtctatctggttttcatgtttctgtttttttttaagccaccaacaattttatcatataattaatgtgtttgaaatcaagaaaattgaattcacttttagtagtgtagacagttaccctattataaattatatctatgacatatttaaaaagaaaacttaactgctgattttttaggaaaaagaaatcttgtctatagcactttagctatagcagtaaatcagctgaggtattagaattttacaatgttctctgaggaaagtgaaatttattattggcttttatatactccattattttcacaaagtgctataaaataattttacaagtttttttaaaccttcctgtgttgtgataaatgatataatttttcttatttataagttaagaaaaaaaaaacaacctcaggtcaaagcaaggttgtgtattttatacaaggtcgtgtgtcttatacaaggtcataggataaacccatgggcattagttagaattttaaaagtaatatggtattatggcattactacttttacttttctattcttttaaacatcacaatctacttcgagtgttgcttttgtaaatctactgaccaataagatcttttaagcatttaatgtatatcatgtgcaagacccagttttaagtgccttacgtggggtaaactattgaaacctcaaaacaacttatgaagaatactgtttacacattttacagagagactgaggcacagagactttattatgacatgtccatatccaagaaagagtatagagcagtgacttggaacattagtttccaaaatgtgaattccagaccaatagcattgatatcatctgagaatatattaaaaatgcaaatccttggttcctaccccagactgagttaaaagcttgatgtacagggcatagagaatagttttttttataatttattattattattgtagacacagggtactgctttgttgctcaggctggtctcaaactcctggctttacgtgatcctcagtgatcctcctaccttggactcccagaatgctgtggttataggcatgagccacccagccagagtgacaacaatttttttttctttcttttttttttttatactttaagttttagggtacatgtgcacattgtgcaggttagttacacatgtatacatgtgccatgctggtgcgctgcacccactaacttgtcatctagcattaggtatatctcccaatgctatccctcccccctccccccaccccacaacagtccccagagtgtgatgttccccttcctgtgtccatgtgatctcattgttcaattcccacctatgacaaaaatttttttaacaaatgattttgatgcatgcccttgtctgagaactactagttcagaagatagagtctaaattctctgcctttgactcacaagattttcatttacagggtgtgtggcttcaaatcactggtctttcagggtctgagttgggttatctttagaataacactgggaatactagtagctcttcgatggggctgccaaaaggaccaaatgtgaaagcctacttcaggcaggtagtatatcttctgtgaataccaaatccaaaactcaattttattatttataagattgaaactaattattatataaaagattcattaatttaatgtattaaggcattctgcatggtacctgacacttagtaaatggttagaaactgatatcatgttattatttttattactactactatgattcatcattatcactgtcagtcattatttgagttgtggaaaactaggctattggtttacctatgacctttatactcagaaatccctttccagcctccttctgccaggacttccacgcactgtctactcatttgtgtctgtctgtctttggccagctgttagtccacctgttttagtcatgtagacagcttctcctgatctacagccagcctgatcctcacttctgtcttatttccttaaggagagatgcaataatgttttaaattgtgtagcctgagtatgaattcagtccaccataaataattaaatgcatgacctctcttattgagtgtttcttttcattgatgttcataaaacttaaacaaatacatgtgatcaatcttgtctgtgccccagagttgtaactttttgaatgaattcaatgtcaacttgcaaatattatttcttcaaaatttcctctgtatgttattttttcttctatttatttctgataaaaattgtctgtgctttttgattaaaaagcaaacaaaacacactgggctcctctagcaaattatttctcaagctacatataaagtaaactagagaaaagaaaaagttattaagaaaatcataaggaagaaaaaatatatttgctgtttattaaatcagagtagatcatcatagcggtcatcctcattgtattcacattaagtaagctgaaaaggaggaaggggagggattggtcttaataatacttttctttaatcaagttaaaaaaactgatatggaaagaataagccctccctactatttgtagctattgtacaaacaaaatatagattatactcaacatgttcttccttattaatattgttatatgttctgcttcagcattgagacaaaacatctgtgtattcttattcttcaggaaatgttaggtccaataatgttgaggaaggcataattttacctataaagtcactgtattaccttttgtataagcaagaaaccacaagaaaagccgaaaaaaagaaaacaaagcttagctagaaatggcaatgtaaagtggggtttgttaaaatgtgaagaaagtattataattcccttgcagagtacagcaaagttaggtatatttctgaatggtgttcatgataaatgtatttttctaatgtttttttaatggctgaaattcctaaggtttgctatgacatggaggcgtcaagaaacctgcagcaacttggctttctctcacctttagtgttcttgaaactgatcatgtctaatatgctttcgatctctggctttatattcaagtcttccatttaactggtagtatgtaaaacaaaacgtatactgtttttacctgcctctatttatctccatccataccgatagctgatggttgattgtaatatgttgaaatagaagaatagcaatagaaacagaaaaaggaggaggatgagaaggggaaggaaaagcagaaaagaagaaggaaaaagaaaaataccaggaagaaaaagaaattactagaaattaaaaatagaaaatgccatcaagcgagtcacttttatactgggccctcgaacaacatgggtttgaacttcacggtttcacttatacatagattttcttccaccactgtcacccttgagacagtaagaccaacccttccccttcctctttttcagcttacttaatgtgaatacaatgaggatgaccactatgatgatccactcccatttaataaatagcaaatatattttttcttccttatgattttcttaataactttgtcttttctctagtttactttattgtaataatatagtatataatacctataacatacaaatacgcattaatcgactctttaagttgtcagtaaggcttttggtcaacagtaggctattagtaaagtttttgaaaagtcaaaagttatgcatggattttcagctgcatggggaatcagtgaccctaattcctgcattcattgttcaagggtcaaccgtactaccattttttttgtaccaaatgtattaccatttttttttggctatgatccttaaaaatgaaaataaattctattctttttaaaaatttaaataaaaatattttataagtcatataatttggctaatatgtcacacagctgtggttgtattgatagattacaaaaaatttcatcagctttaaaccaaagccctctcttaaaaatgatgcagtgtatttcaactttgccttgttaaagtgtcaagaaattttaatccattaagagttgttaaaatgtggaaaataaggcatgtgctatgccagatttttaagtgcccatgtgtttgctcttagacaaagagttgtgttaagtagaatcgtatttctcatttttctagttgtatgtgataattgcactttaaactcctcaaattcacttctgtctgacgtggctttgatcttttacttggtccacattttacttactctttttctctttgtccatgttcatactcataaccaatcatgtttaaaagtaactatggaacacatggaaagttggaatattattgggataatgaaagaacttattttttacaacttgatgacataggatttaaagtaaacgtaaatctgggaggtgcttaatagaattaatgttctctgatggtcactgtaaaacacttaagaaaccatgtatctctggcttaaaataaattctgactacattatttattacaaaattataatctacttacattggttaagtgactattaaaggaagtgaatatttttcttatctaagcaagtagcttgtaggccaaaaatacatttggtttgatgggaagataaattttcaacattttaaagtaattttttaacgtttgtatgcattgtgagccaaaatatttgatttcttattccaactgctttaactctagccatgttcttttgaagacattactttctctgagaatcactttgcttatttgttaatggaatatggaaatgcttgtaaatacctaaaaaggaggtacaagtgacataaagtaaaaaaccttaaaaggcagtaggaatgtaagtcattgttattttctttgttgccatttctgtattctatctattcatgttatatctctcactgtttataccttagtttaaactttatattaatagaacagtagccaacttttctttttgcccatttccatcagtcttatttgcacaatctaacttcgaagagagtttttaataaatataattgatgtgaatggatgcttgtgaagtggaaactggagtagcaaaaaatatgccaagagtgagaagatactcagttgtagtgtttacagtaagttttctttatccatggtagttatattgtataaagttgctgtgactattgaattgctgctcctaggggaaatacaagtttagcttcctgagggcacctggttacaacattgtcatcaaatgatcaatacatagtcttattttatgtatgtttctgttttaaggcaccttatttaatatacagttgattcattaacattaaaatcatggccaatagcatgcaactactgccagaaaggatattttctaacatgtattttctctgtaaggcatattacagccttcttgcatttaggaacactggctgacattttaccactgtgctttcgggccattttatacagcaaaatcactaacaaaaagcacagaaatgtgaaaaatgaggcactaaatagacagttatttacagtgtgagagttgaaataagaaggcagagagttgccttatttgacctcagctgagaacatgcatgtcaggcaactcaagtttttgccattctgtcatgtctacaaatgactagaaagtgccacaagtattgacttttgggtcacaaataagttttagcaaatatgtgaatttgcaaatacaaagtccccaagtaaaagatcaactttgttattttctatttacccaccaccctcccactttgtaccagcctcaacaataattgatgttttgtatgctgtgctttaaatttattttcattttaaagattcaaaaaaaatcattccatctctgttatgtcagtactctagtattttttgtttttagcattatttaatactttatgaatattgcaaacactcaaacattaactgactgaactaagtaatttctaagcaataagcagtatatttagggaggagaagagtaagggaaatttatttaagtgtaatcattagactttgtctaatgatctgtgttaaattcttacattttctaatgagtaaggaataataccctcatctgaaagccatagatttatgtgaattaatagagaacagacaaatatgtttaaaagagatatcggttgtatcataattaaaatgacttatctagaagtgaaaatcaacactcttgatagagccatcagtttaatatagtaaattgaatgcctgccttgtaccttgggctgtcaaagttttccgcacttttggagaatggacagcgatttagaatcgtaaccaaggagggaagaaaaggcagattaaccaaaaaattttaagaagattggagcccaataatcatgcataatcttcaccaagccactcctcccagtacaaagataatataagtgaaattgtcatctttcctgtccatatgtatcaacaaatttcatattgtcatttcactagcatgacagatatgtcaggcatgtcatttttactttataattctagtgctgttaacatcctgctccatagacattaatactttcagaactttgctaatgatgaaactgaagctttgagtggttgtgacttgttcaaggtcaaatagatagtaagtagtttaattaaaattgaagttcaaggctgagtgattccaaagtccataatttttccgctacatcaggttttatatatatcaacccaaaattcctactattggatatgctatgagacagtccttgcgggagcaatgtcaattctacacactcctttccctggagattcatgttcttcagaaatcactgacagctcctaaaatcaagaagctatggtggaagaaagaaaactgtcggcaccagagccccgtgattttcctaatatcagcatcttcatgactcaggaaactggatttccctctacaactatacgttccctaaaccttcaaagtgtgtagctgggaaaatgtggattcgtagtcatactaataaagttcttaatttgtgagagctccaaaccctcacctataataagtgaggattaggtatcttatctctgtcttggacactaagaggttcaaatgagatattgtaagtgaaaatgcctttcaaaatgcaagtccataacccatttacaaatgtgctcactgccaccagattcttttccaacaccaaattttctcagaaatatgaaaattcttcaatattttccacaagtgatagcagacagggtgaaatagaaagtttgtgcattttatgtgcagctttcatatttggtttaagttttctgactctgtatcacggaaaaatcttggtttattttattcattgactcaatatttattgaaggcatactaaaagctacgaactttgctgagagctggtactataataatgaataaagcaaatctcttccctcagttaaagggaatgcaatgcaatgcaatacaatataaaccatatttttcataacccaggaaatatacttggccaaattttggggagttgcagaaggtgtctgaactagaaccagcagggtgaatagcagtcagtgaggcatagtacgggggagaaaaagcagaggtagaaacactcaggaaatagaaaaatggctgtgcttgcatttttaaaatagatgctctcaaggataggcatcttctaaaaatgtccatactctcaaatcatatacaggtaatttctcccccagaacatactctgattgctttatcaatgtcacaggatgtcatccataaaaatatgtcaaccttttaaagaagtggaagtatgaaaaggctcataacactttctcttaatccccttccctctcagataggatgtctatcaagcattgtactgtacagaatgaggatgcctctgcctgggtacttaaattattgatcaaacctgtcactagcaaattctttaaactggatacattttgattgagtaggaaggaatgtttaaatggatgcctgactgtgaagagaatggttttgcaaatgtctccacagtgctcctaattgaagttctgataatatagcattgcaagataacttgttctcctctatttttaatatggcaatttaaaatgtgcatatatattaaaaaacacaggagtagaaagcatcagagattgataatactcctttcctctcctcttagatgttatttgggaaaaaatatgaaatatgtttgactgagtgagaaaataagttttaccatgccttctgtattcaggagaaagatttattattctaatccgaatagccttctcaggaagtctaggttcccatagaagacaggaaattaagtgtttttctatagcactaaaagacacataatgtattaaagagaatatctaaaagtccgtctgttttgaagctatccagctgcagtattctcttgaaaagatcatagcaacttttctcttatagtttccaaagtgatgttatggatcaatttaacagttttcaatgagtatatcccttttaaaatgtcatcttataaagttcatgattaattgcatgaatatccatatgaaacagcattgcctctccttaatccacctccccaatgaaaagctaaatgcatatggactagccaaaactttagaagacatggtatcttcgtgtgtttgctactgaattaccaacttgcatgtcctaggaatagtttaatatgaaggcatacaatttctctgaaaactactttttcttatctctaaataatggtttcttcatctcaatgcaaataatattaaattaaaaatgcatactgtaattctgaattttaaagtgggagaaatatacgtttaaagaagtaatgatacctaaagtccaactataaagtaacagtatgagaaatcctttaagctcttgaatatatttctagctaacattaaaatggatatttcattcagtacaatattcactatatagccatatcatagacgactagatttgatatttgaaattttaaagtctaaattggcaattcaaagataaatcttctccacaaaactttagttcagaactagatagcaatagtaaaattgttctagaccactgaaaacatgattgttttaaataaagtgtttttatttatgcatttaaagatatgtcactggggtagcatactctggcctgcttttgttttataggtttataattcaaactctaaagcacccagtttaatcagaaaaatgatcccagtatattatatttttttgtcataatatgatgccctagtgttctattgctcttttctcaaaaatttccggaaactttattttccagtgactattccttttcccatttatgaaaattccctatgcattagctaatatgatttaaagcaattttgttctgttttctcctttttaaacatctttcacacaatgattctcttttggaccctccatggatggtgaatataatttcaatggggtgtttaactcttacttctcataccagagtcaggaggttgccttcagctgccttttcaaggaaagttcctgaggtttgtctcaaatgtatttgattttttttgacaaagatctgtgcttttacaagctttatgatgggtttatactttctgcaagttgcctttctaaaaacatgtgtaattccccagcagtcctttaaaatagagtcaaaatacttttcttttggagaagttttaccccaaaggctagtatgttatatatatttcctgctttacttttcattttaaaagatttattcttaatcccaggcatattgaaacattattcagacagggtatcatgtttgctgggtctctgtggcatactggcagcctgcatcttgccacaagggtagctagaagcaggtctctgccctgtaggtggctgaagccagagaagcttggctcttccaggtaggaaatcaacctgtcaagaagagtcatggaaacacgattagtttactaacttcattaaatgaaaacgtttgcaacacagggctccctttgctctcagtgtctgccgttgctaaacaatccagtgtttcatggggcgaatggaatgccatgtgtactcccagcaggaggacattccagaaggccatgggcttcctttacctggtgatcttgtggacttcatgcgcaatggcctattttgtgacgctttctcttctgtatttctcaataacccataaccacaggtacacaaattaggaataaaatgaaatagaggtcgctctgctattttcagatcttgataaacctgatttaagatttgtatatataagctatcaacttcttgagtaaagcatttctgacgactaggcccattgccccagaggtttgccttaatttcccaaaagaaatgtgctaaaatgagtgcaaattaacttccaaaaagaggatagatttcattactctaagtgcctcatgctgggagaaaggtgctgttgagctcatatttaagggtgattagaactgcatctttttaactcgaggattctcaagtatgcattcaacttacttgctggtagtttaaactgtggaaaatttgaaccaaatgtgtatatagtgtttttttcccctcacatttttaaatagcagactgtggaagtgtggatcatttaaattctaagagtagtcttttattttaaatttaaaattgttttgcaagtaaatagctaagtcaagtgaattaaaaattgttttgcaaacacatagctatgtcactgttccttagagttttttttaattaacatacatacacacccaggaaacctcatttaggtaggcagaaatatgttctcttaagtaatgagtttgaaagaaagtcttttcttttaatggaattgacacactctgtttaccattctagaaaaagttagagaaaaggtcggtggcctgtacttgttctacactttaatatttataatcattgaatacattatattcataataacttatgtttgccatcattaattaattttaaatttttgggtttttcaaacaaaatatatagctacctattgtgttattagctaagaaatatgtctaagaaatgttaaaaaatacatgatactaaaagttataagaaattacacattggtattcagtgatgtgagctagtctgcaagtttatttttaatgtaaaactttggctaattgattttttttctcataccagataaatatttcttcataaggccatctttttctagagtgggtcctgcaacacttatttggtgcaattctaaagtaaaggtagtacaaacatattatatatttgactactaatttatcttctcattaatttggttacagtcctccttgctaagtagtgaacaagccttaaagaaaaataacaataaataatatcaaagggttcagtattattatatgctgcattgggaaaagccactctaaatataacacaaaaagaaggtaattacttcaataataagaaatgatctttattaaacacattaagttgtgaactatattttattcattcagcttatgaactcaggggaaaatatatagagttattgatcacaatgtttcaacaattcttgtgtgcacctgtgtgtgtgtgtgtgtgtgtgtgtgtgtgtgtgcattcatgcacatgtcagagatgggaacacggtataatattacatcaaaatagctagctacagaattgatgtaatggcataaatattaaaattacagatatttatttcctgcaaaaatagatttattcagtaagggccatatttcataataacttttgaataccatttcatagaaaatactgatattttgagtggaagttggatggacttttcaataggattcaagaagtgagtaggtatagacagtctgtttacaaatctgtgcttcaggtatatatagagagtatctcagagttaatagtaatcaataaaaagcctccagaggttgaagtaaaaaaatggggttggggttaggcaaagtgtggcacagtcgtcacatctcctctgtctattatacagcttatacaaatcagagcacttggtttgtgacaagggatgtttctattctcattgattagtgctgagtgaactattctggagggaatgattgttttcagagagtcacgtgtggtataattgggttttagttgcattgagcaatgcatcaatgtagttacaagacatgcatttggtactcaaaggcatctgcactgtatttatgcatgtttcatgtatgtacacatccataaaatatatcaaggatgtaccacctaggaataaatatggcacaatcatacctattatgtgagaacacattaacaatactgactatattacaactatatcttgctatctatgagtagggtagattttgagttattttccaagaatttgaaacaaattattgtaaaacagctaaagtctgtgacgtaatcatgattctcgtgattagaattgtatattttgcttagaatagtagcttataataatactaggtattatttactaaataccatccatggtgttcacatattatctaaccatatgaatcttacaagatttttattatttatttatttatttatttatttatttatttattatgacagagtctcactctgtcacccaggctggagcgcagtggtgcgatcttggatcagtgcaacctctgcctcccaggttcaagtaattatcctgcctcagcctcttgagtagctgggactacaggcccacgccgccacgcccggctaatttcttttgtgttttagtagagacgggtttcactgtgttgcccaggctggtctcgaactcctgagctcaggcaaaccacctgccttggcctcctaaagtgctaggattacaggcatgggccaccacaccgggcctctcacaacatattatagctgttttacatatgagaaaatcagagagggtaagtatcttgcccaagaccaaaaaccactagcagatttctgagccaagatatgaatgcagctccctttgaaatggaaacctgctctaattctgctgcaggaggttttctccattattgatactgtgccctaaaatattaaccaaagatgcattatgtacaaatgtacagccagatactgtctgtagtccatccttcctttcaacaaatatttactgtttaatattcgtataaataatatatgcaatgcaaatattaaaataagtaattttatttaaaaagtaatgttttcaagatgttccactggagatacagctttgttctatagtacatgggcttcaaggagaaatttagaacatatttacattttacattttgcctttctgcaacaaatcttgtgtcccctgaaactctccagtgggaatagtgaacagggaaggtgccacactaaacatctctctcgattttatgcgcactgtaaaaaagcatacacatggctaattccaatcattgtacatatgtgttagaaaatggtaatatagttctttcaacacctatttttaacagtgtctagttattgggctgatgtgtcagtttcaatttatctgataaaattatgattatcaaagatgcagattatgtcaattatatattaaataattcactgatttacctgtgaaagtttattcgtgcagtttcattcagtagttttattaaacatctactatgagtcagacatacatctagagtcagataaaatggtgggtaaatataggcactatcttggcttttctgacatttctcatgcttgaactaaaacaaccacaaagtatccaactaataatttattcagagttatgatgaatgctataataatctactttctaaggtcactgagaagtgacatttaagctgatatcctacaaatatgtactgagcacatactatatgccagactttgttttgagtattgaggaaatagcagatatttattctccaatatagaatttatcatacttgttgattaatcataagtacttttttgggagaaatatgtaaaaagcataggtcatctgctatatacttttcatttgggagtttcttttcccaccttttttttgtagtttccacttccatcatcttcctacacatggaagagcaaacctccattatctattttcatggaaatttatagttcattgcctttaataacaggccataattttatttgattgcataccatgttttcccccgtatttttatttactttattgatattcttaaaagatttacaatcaattataagtaccaatttggggatttaaatgtaaaaagtgaataaatgtgaaaaatgaactgggttattgaatcatgcgtgatctgtagccaatagagtgtcttttctttatgagaaataaacagtctcctgcaccaaaactgaaatgtgttatgactttttcaatataataatttaaattactgtgagccatgatgattattttgatcatgttaactgaaacatgaataataggagccactgaaaggctttgcctttatttcgttgtattaatccttgtgttgtacaatctttgttgtactaatctttgtataaatatcactttaaaagttgacagtttctgtactttatttgatacaggagaagccaggcaaaataattatcatggatccaatcaatacaaataactactcttggaagtgcaggtttaaggagtttgcttttaggtgcagtaacagggcatgaacaagttttaactatcattatgggtaatggaaagaatttattgttgatgaattagaatcaacagcaaagtgaaaaaagtttaaactgattagtggtattaggttttttgaagattcaagcccttgtgtaactgaaacgtcatggaattctaagtaggtagcttcctgaaacagaggaaaaacataatgtttcattctttctgacatttatctggtgggggctggtgagggaatatggtgggaaatagagcacctgaacatagaaagtaacaaaatggagtaaactactaataatattataagggaagaaaaactgaattacgtatttttacttcgtagaaaacttctggctaattttctgacagaagaataaacaaccaattctaaaatgcgacaactcttttaatctcaatatgcatttcccaaccaatgatgacattttacatatgcattgccacatagtgaaatgagagcagaagcaaagtaactgaaggacaggccaaattaggtcaaaaagagaacccacttctatccagttttattttatcatattataactcttcagatacaaatcttattgcacagcacggtgaaacacaagagagaattgatgttctataaacatggaggtgctcactttgctgtttgtgtaaacttgaaaattcattctttcccttgtaaaaatgctctaaaatcaaacaaagaaaataattataattaaacaaatggaatatgttttgtcttctctttattttttaaaaacagaagttttccatatcaggtttataatcaacagtttttagttatgtattttagtggaatactaaacatgaatacagagacatttgtgcagtcacaaatgtttaaattcctactgccacaccataaaagactaggattttattaataaaatttactttatacacatgtataaaataatgatcagaaactgttatcaaagtaattccaaataaatgaagttagatttatatctaaagcccacatttgttgttataggaatgtgttctggattatgtaacacctattttcactttttaaagtccatactcatttacattaattaactacacatttggggtagttctgtaaattcatcttgctacgtttatgatagttttttaatagactcaggtagagtgactggagtgattagtgaattggaagctattgaaaaaaataaaccatttctggtgatgagactgcggataaaccaatctagaacattcagaaatatctaacttttttacaaagtcagttcaaacagtgaaatttttatctaccatcacctttttttttatcagttatataatcttaagtacttaactttataattttcatgttactgattttaaaaccttgagtttgatttctcctgattatttcctctatgtagaaaataacaatttcctgccatacaaatgattatttagaataaaatcaaaacgatattttaaaacaaaataaaattatattatttcccgtaatctatgcctccatcagaccccttcaatggcactttcttttgcatctaaagtgaaattcaacttattaccatagcctaaaaggccccaaatgaattgtcctctccttccttctcagaacttggctcctttgtctctcctctttacttaacttactccaaccacgttcttccactttaacatagaattagaacaattattaaaatgtgttagccgatgcggtggctcacgcctgtaattccagcactttgggaggctgaggagggtggatcacttgaggtcaggagtttgaaaccagcctggccaacagggtgaaacccatttctactaaaaatactaaaattagctgggcacggtggtgggagcctgtaatcctggctactcaggggctgaggcacgggaatcactaaacccagggggcagaggtgcagtgagccgagatcatgccactgcactccagcttgggcaacagagcgaaactctgtctcaaataaataaatacaataaaaaaataaaaatatgtcacatcactcctctttttgtttaatggctgacagttttaaaggtcattacatctgcctagaatagtctgtgcctcaagtgtctaatgatccatctctctcaatattttgggctcagagaagtcttcctggtttaccttcatttactctttcatttactcagtaaatattgggaaaacacttaggtgctaggcaattttctatgcaattggaatatagcattgaatgacagacaaaaatatctacactggtattatttataccctaacagaaaagagataataatacaacaaaataaatctattaggaggtaatcattactatgaagcaaagaaatgtatagaaagttctagggtttggggatgcaattttaaagaggaccctactaaaaaggtgacatttgattaaagtcctgaaagaattgagtgggcaaaccatgctgataaagggtgagcatgtcagctatttacaaatgagcaaaggccctggccggaagagttgttggtatatttcacgaatattaatgtttccaaaacaccaaagattctgtctaggtcctgttgctcaatgcacagaaagtcaatcactgagacaacaagtattgccagggaagtagtcattattttattatactcctggtgatgtcagcagaagacaattcctaaatctgttcctacctcccaactaaagttaggagtttatatagcaggaaaggaatgtagctaagtgtggggaattaaggaattaaggaggggtaaggaagaagcgttggtcaactggaagcaggtgatcaggcaatcatgatagatgaggtctctgctgccttaattgtctgcatatggtgatcttgttagttcagtcccttgatactgtctgggaggcctgagagtcagtttcctgaggaaggaactcagataaggcaaatgtaagtttcaaactttaaactaggaggatcaatttctacgtgtgtgtgtgtgtgtgtgtgtgtgtgtgtgtgtgtgtgtgtttccataaacatcagttctatgggacccttgggctggttccattaagaaagctagttttcctggtgctacgtgaagtagggagagaggagtagagcgtgggacaagtgagtaagagaagtgaggcagatcaggtagggccaagcagaagtacatggtgagacttctgataatgttctgtgtgaaatcagagccgttgtagcctttgaactgaggaggtccatcatctgattaatgtttcctctggctctgtgttggaattaaacggtacattggcaaaggcgaaagcagggagaccaattaggaaggttctccagtagttaattgagagattatggagtcttggactatcatggcagcagtgaaagtgatgagaatgggtaaaatactgagtatgttttgaaagtagagttgacatgttttctgctggtttagctataaaatgacacagaggagtcagaatagttccagaggttgtgttcttggcaatggaaaaatgtcatttactgtaaaaggaaaagactgctagtgtaacaggttttaggaagataaccaaattatatggtatgtttgaaagtcatttttaatccctgggcttgggtgaggaaatgaagaagtgtacataaacaaaacagaaataatgtgttgattcacttcaacatcaagaggtatgcatatcagcaagtaaaagcacttttccccccactcccactctcctacactcttattctctgcaacatgtccttgttttgttttcttagttgttcttatttctacctgaaaataccttattttttagactcactttatatcatctttttgcctccactggaatgtaagctttatgaaaacaggaacatgttctatcttttcatagaacctgactactggcaagtcctccaaaacacttttcaaatggattacttaattttccaacctatttttggttttaacaggaaaaacatttcaagctgcagaacaattacgaacagaaaaataataattagcatttattgaacgtcaagcacagttcttagtctttacatgtaataaatctaagccacagaacaaccctgattggttagcattatcattatcctgattttacggatgggagaattttacagatgggatcataggaatactaaataccttgccaaagtttatgtgaagaatggtcagagaattgaaattataaaccaaatcagtgtccttttggcattcaagtgagtgtccttttaccatcatgttgataattctcaatgaaaagaaatgataatgatggggtcaataaaagcgtgacatctacgaggtttggagattttcatgggctgactcagttaagggaaggtgtgttgtcagctaagaaaaagaaagaagcattaccatccagagtaactctagtattctgggaatatatattatacaggcaagaagttaattaaacctcccaccaaaatacccagggacaaaagaaagaaaataaggaagagtgagccaacatatttaaatacacttaatttagtattacattttttagaagaaaattttaacaaaaatcactgaggtcaacactcttatctacagatagagaaattgtggaaattagttcatgttacacaagtagatattgacccaaataagtgctgaattttacctcaactctcccttcttcccactcaagattctcccgtggtatgacattgaccttgtgttttctttagaagtagaagaaaacacatcaactgtccatcttttattttttctgacagctaaaaatatgtctgtatgtgttaatataagtcagattactgtttcagctacatagggttatgcctacctgacaggaaaacataccagaatttattttttttggaataaaaaaactagaaaataacctaatatgtgcatgctttctgataaaagatgattactcatcatcttttgtaagattctacaaaagaatgcaattacaaatttaaaaaaaacacctggtgaatgcttgcatataatagttaccatcatgcaaaacaatgtcacgtagtcaatgttggatattcaggctagagtacatatgaatttttaaagtacagtgctctctgtgagcaaaccatctttctaaatggatgtgtcacaccattacttggtaggacatgaatgattatagccttaaactggtaatatgccttcctgacacaaatatagagctatgatgctgtataatgttgacatttatagccacttctatagacttcacctcaaatctttgagtggatacagaatgtactgtatatctattttaaggtgcctgtatgtggacaagcacagcaaccattaagtgattaaaagtgttataggcttgagtattctattactgcatggttttcaggagccaatagagataccgacttgaaccaatacttctatgtgagtggaaaagggttgctatcacccagtaatgttctcagatgaaaaatccaagtaaatattcccatcattagtttcatagtaaatactgtttgtgtgagcctttgaacattattaggcatattaaactcaaaagcaccataatggttgcataaatgatattgcatttcttcagtgttacaagaaaaggaggcattgtggttgagaaaatggtcaggtaattaaagtgtaagcttaaaaatagaaagcatgtttatttaacctgagattgattaaaatgcttctaaacagttttaaaagttctttggccttaataaagaattctgaagatactttcaattcatatggataacaaaatatcatttatgtatacattaaatatactttgacaattaccatcgtaacagcttatattaacatggcacctactatgtgtcaaatttctatgtctttacctatactaatccaggtagtcgtcagaagaaccctatgaggtaaacactgttacctggattttacaagctaaggaactacaacagagagataagtgggcatgctcatggtcacagagctagaaagcaatctctatctaccattggtgataactgaaacgtacaggacttaacttttctgtatctgatttccttcagcgtggaggatctcagctagcagagagaagctgaggcttggttctgccttttactctttattcccactgacagtacaggatgctcattaagttgccttatggctggctaaatttgatattaaagttggtactcaacattggtactaaaaattaatggtttcagaattaactcctgggggtgttctatgaaaatgaaaaaaaattatatgtagtatattaaagtaattcatcctgtataatgggatcctggagtagacaggctgtgctaagcacatttatctgagagccttgagccaactgttaaatttctgtatctgaggtatatataatatctttatatatatcctgtctgtacacacatatattaataggtactgtattgttagaaattaaaattttatctaattttataagttcttcccagtgacaggtaataactcagaggttcaatatgtgcgtgcgtgtgtgcatgtgttcatgcaaggggtgacagagagagttgagactcacagagacacgcacaacaggaaagaaatgtgtggaggagctaaaaggctgcgattcctaccccttgccactctgccattcttcctttgtttccactcaggtttgattaatagaaagtggatccctttatactgcattttagtcagaggcctttctgttgagtgaagccattgtgggtaaagtttaggtttctgggttgtgaacatcaaagaaagcacagcctcagaggtacctaatgtaacagaccatgctgttttgccttcagtttaggatttatcctctgaatactcacctgtgttttatcaaagataatgtcaaataatacaaactgtgaggctgccaacagcttcttgttggacggttcttctgttgtggttctaagagttcctttctggaggttttatcaccttttcttcttatcattctaactacacacttctctctgaggttttatataagtgcagataagcaaaaattatatgttcctttacaaacgtatcaaagtaatggatgtttaattattttaaccaatttcatcatgaattcaataatcttttgagaatttctgccaaacttactctgatatattcctcgctcctctctgatgaatcaacgaatgaaaatactgttgaacatgtggtctcatcagaattgtgtggggaggaaaacatgcttttacacatgtagcatacatcatatggaaagaatgggtaccctctcctccaccaaaacacttgaaaacaatacaatagtaagttatgaaaaaggaattgtgacaagtgttaattaaaaattccttattaattattactttgtttttcatttttagcacaatttaaagctaagtgtcattatgtgtttggttaacagtaaaactgtatcttattgcaaaggaggttgaggcatatctataaataaggatcacaatctctagttaattttaggccctgattttcaaagctttagcactgctgatgaatttgtttttattgtcactgtgtgagttttcaggcacataaagttcagttaaagtcattgagcaggcagctctcttttgagcactcaactcttttttacagttgggtgtcttttataattgaaataaattattaaatccacaagccaagttgttagatgtaaggttattaatattttgtttgttatgtatttttaatgacagatttatttaagaaaagaacaatgaataccaagggtatattgagttgagtgacagatagctcggtttcttccctgccaggctcaaatcacttggatgactggattggtgccatttttctttatataccctttgtagtcagcataatgtttgactcatcactggaactctctaattaatgaatgaatgcagaaagggattcaggttcagttaaagcatttactcactctgtgaccttgagtaagtcactaaatctctttctcctctaatatcatcatatatattatggggttggtctagtttatctttggagttcctccaacttctcatgcagtttattggattttatgagtcagattatatatctaagaaataattatggaggctagaaaactactgtacatattttcatttttgtgttgtattatagagaaaaatgagtgtgtactatggtatgttatgcagtatacaaaattttcagtattttggatttcaaagtattatctagaaattatgtaatgtgacaaagaaaaagatagagacagatatatagagatatagataaagaacatttgcttatgttttaagaattaatggttggtttaggaaaaccttccataatcataaaaagatgaaaaaagataagagttatttacaggattcttgagtagtaaaatcaataagagagggcagatgtaagataacttatggtcaattgtaggcacttaaaactgaagacttactattaaattgctaactgagggccttgaagtgtgatgttgcatgagattgtgtgtaaggatcatttgctccactttatgagtctgtcactttaaagatcagaactgttaccctgtgatgctcacatttggtctggtttataggacatgtgccagctggctaggctaaatgaaaatgtctacttcttcaacaaacttgtaatctatgatccttactctacttttctaagaaagattactgtggatgtatggtagcatcaatgtctaggaaacagaggtgatgtacattacctggcaattaaattataataatataaagttgacaaattcacatgctccagtgcccaatgaaactttagtctctctgagaatagtaagaccaattattctatagttctaagaaaaatggaacaaagacactataattccttccagaaatctctgtagtaaagataaagatcattttactggaaagtaaggagggataattcacttataagaattacagttagcgccctgtatccatgggttctgcatccacagattcaaccaaccatgaatcaaaaaagatttttaaaaagaacaacagtaataatacagcaataaaaataacacaaattttaatatacagtataactactatttccatatcatttacattgtattaggtattttaagcaatctagagatgatttaaagtatacaagagaatgtgcggaggttgtatgcaaatactatggcattttatataagggactggacatccacgaattttggcatccacaggggtcctggaacgagttccctgtggaacccatcccttgcggatgactataatttagtaaaacttttacatggaatgtagaaagcatacctttattgaataaaatgccctccttgaaaagactttattaatccaaattttgattttccaatttgtaaatatgtaaagaataaaattcttaactctatttgatctatagaaagcattagcatatcaattcagaaccctatcttccccagtaaactctgcaaatcccccaatatttcatttattcgtttaactttgttcttttcctcttacacacacacatagaaaatgactactgaagtttattacaaatttcaaaagtctttgatttgtgtacatatttatgcacaaggccttatttataaaggtatgtttcatttcttttggataattatggaagactgggctggctaaatcatgtgacttttacacttctaacaaaatgtcgacatgttttccatagcatttgaaacattttgtatctctgcctgctgtgtatgagaactctagtttctttatatcttcaccacccctttgtattgtcagtctttttaattttttgccattctgataggtatgtaatggtatcccattgtggctttaatttgcatttccataaagctaatgatgttgagtgtcatttcgtgtgcttatattccatatgcatattttctttggtgaagagtctatttaaaggttttgtcctttttgagcggggagattatttttttaaactatggaattttgaaagttctttgtattttctaaacacaagtactttatcagattataaatcaaatgatttataaatacttttttcccagtctgtattttgcttttcattctcatattagaatcttttgaaaagcagaattttgaatgttgatgaggtccaacttatcaatttaacaaaaattattgtgcttttgctgttatacctttgcctattcaaagagtcggggaactttcttttaaggggccagataataaatagtttagactttgtgctccatacaccctctgtgatatagtttgtatctgtgtccccactcaaatctcatctcaaatcgtaatccccatgtgtcaggggacgaacttggtgggaggtgattgggtcatggggacaatttccccatgcgtttctcatgataatgagtgagttctcataagatctgatgatttaaaagagtgtggcacttccctccttgctctttctctcttttctgctgccatataagatgtgccttgcttttccttcgtctactgccacgattgtaagtttcctgaggcctccccagccttgtggaaatgtgagtcagttaaacctcttttctttataaattacccagtcttaggtagttctttatagcagtgtgaaaacagactaataccgtctgcctcaactaatcatctctgtagttgtagtgtgaaagcaatcacaaaaatatatttaaatgaatgagtatggctatgttctaataattaaaatttgaattttacataattttcatgtaatgaagtagtatactttttccattccactaatcacttaaagatctaaaaaaagattcttagttcatacataatagaaatacaggtagagggtaagatttgtcccattggccatgggtaggttgccaacttttctcctaacccaaagtgacaatgattttgtcttatgttttcttctacaaattttatagttttaggttttaacattgtctataatttatttttattaattttgttatgtgttccaaagtacgagtcttagttcatttttgcaaatgactatctaattgtttcaataccatctgttgaaataaccatcctttctctattaaattacctttgcacttttggagaaaatcatttgttcaaatattctcccccaataccattgagaattacagttaaaaatgcattactaaattgaagtagcccaatgctcttcacattttaaaatgctttttctctgtgttcttcatttttggtagtttcatttattccttgaactttgttcttttcctcttacacacacacacagaagatgactactgaagtttattataataatacacatagatgattgctatcctttctcaagctcatgaaaattttcctgtataatatttaatctgccaccatccaattcaatgtatttttcatatcaggcattttagtttttatctctagttttatttgggcctcctaaaatatattccttatttgtatttcagtatttggacatatagagcacagttatattcactgttctatgtccatgcctactaatgctaacatctatggcagttctgagttgattttgactgattggtttctctctctattatgagttgtatttccttgcatgccatgtaattatttttttggctgccaaacattgtgaattttatcttttgcatgcttcatatttttgtattcttattaatattcttgaacttttctatgggacacagttaaattattgaaaaacagtttgatccttgtgagttctgttttttacatttgttacatggattcagagaagtgtttaatcaaggtctgatcattcctcactcacacttgtatgtatacacataccttggaaatattgtggatttattccagactatagcaataaagctaatatagcaataaaatgagtcacacaaatgttttgctctcccagtgcatatgaaggttatgtttactctctaccatagtctattaagtgtgcaatagtggtatgtctaaaaaacagtgtacataccttagttaaaaatactttattactaaaaaatgctgatgatcatctcagccttagtgagttataatctttttgttcgtggaggatcttgcctcaatgttgatggctgctgactgatcaggatggtggttgctgaagggtggcacccttcagctgtggcaatttctcaaaagacaataaggttcactgcatctttcacgaaagatttctctgtagcatataatgccatttaacaacattttctccaccatagaacttctttcaaaattgtggtgaattctctcaaaccctgcttctggtttatcaactaagtttgtgtaatattctaaatcctttgttattatttcctttttttcctatattttgagacagactctctctttctctgtcactcaggttggagtgccgtggtgcaatctcagctcgctgcaacctctgccaccgggttcaagagattctcatgcctcagcctgtcaagtagctgggattgtaggcatgcaccaccacacccggctaatttttgtatttttagtagagatgagtttccctatgttggccaggctggtctcgaactcccaacctcaggtgatctgcctgcctctgcctcccaaagtgctgggattacaggcatgacccaccacacccgacctctttgttgtcatttcaacaacattcatagcatgttcaccaggagtagatttcatctcaaggaataatgttctttgctcatccataagaagcaactcctcatccactgaagttttatcataagattgtagcacttcagacacacattcatgctccacttcaaattctagttctgttgccatttccacaacataggcagttagttcttcctctgaagtcttaaatccctctatgtcatccataaggattggaatcaacttcttccaaactcttgttactgatgatattttgacatcttctcctgaatcacaaatgtttttaagggaatctagaatggtgaattttttccagaaggttttcccttttctttagccagatttgtcagaggaatcactatttatagcatctatagccttacaaaatatatttcttagacaataagacaggaaagtcaaaattactccttgattcatgggcttcagaatgaatgttatgttaacacgcatggaaaatctttgtatgtacatcttcctcagagttcttgggtgactaggtgcattgtcaatgagaagtaatattctgaaagaaatctttttttgagcaataggtctcaatagtgggcttgaaatattaagtaacccatgctgtaaacagatgtgctgtcatccaggctttgttgttccatttgtagagcacaggcagagtatatttagcaaaattattaagggcccttggattttcagaatggcaaatgtgtgttggtttcagcttaaagtcaccagctgttgcattagcttctactaagggagtcagcctgccctttgaaacttcaaagctaggtattgacttctcctctttagctgtgaaagtctcagatggtattttcttcaaatataagactattttgtctacattgaaaatttcttgttacgtgtagccatctttatcaattatcttagctagatctcctggataacttgcttcagtttttctatcatcagtacttgctgcttcaccttgcagttttatattatgcagatagcttctttctttaagtgtcatgaaccaacctctgctagctgtcaacatttcttctgcagctttctcacttctccaactttcatagaattgaagaatgttaggacactgctcaggattgggctttggctaaaaagaatgttgtgaatggtttgatcttctctgcagaccactacaacttctttcatatcagcaataaggttgttttatttttctatcattagtttgttcaatagattagtaccttcaatttccttcaagaactccttttcattcacaacttggctgtttgtcattaagaggcctatcttttagcttctgtgggcttttacactcttcctcactgagcttaatcattctagtttttgatttaaagtaagaggcatgcaatactttctttcacttgaacacttacaggccattgcagggttatgaattgggttaatttcaataatgtgtctcaggggatagggaggccagaggagaagcagagagataggaatactgctagtgaatggagcagacaatatttatcaattaaggttgccatcttttatgggcatggttcatgctatcccaaaacaattacaaaaaggaacatcaaagatctcggatcatagatcaccataaaaggtataatagtaatgaaatcatttataatattgtgagaattaccaaaatgtgacacagaaacatgaagtgagcagatgctgttggaaaaagtggtgcagataggcttatttgatgcaaggttgccacaaacctttggtttgcaaaaaactcagtatctgtacaataagctaagcacaataaaatgaaatatgttggccaggcatggtggctcacgcctgtaatcccagcactttgggaggccgaggtgggcagatcacttgaggtcaggggtttgagaccagcctggccaacatggcaaaaccccgtctctactaaaaatacagaaactagctgggcatgatggtgcatgcctgtaatcccggctactcaggaggttgaggcaagaggatcacttgaacctgggaggcggaggttgcagtgagatgagatcatgccactgtactccagcctggacaacaaagcaagacttcctctcaaaaaacaaaacaaacaaacaaacaaaaacatccacctaacgccccatgaatcttgaggttttctaatttggctggtgggaacaagcatttttccatgtcatgtgcgagcaccaaatcccatgcctctactacatttggatagttctttccctgacctcaggagatttggtcacacatgggttgattggcactctgctaaaaactgaaggggaacttttgcaaatggcctttctctctctctgtgcagctttcttctccctggtgttctctgcaaaaaaactctagtcatcttggtctccctggactttcatcttcatttcctaaaacccaagaattttctgagctctactttggttttctgtcctcctgtttcagcctagaaattcttacagcagtaaaatattgcaccatagggtcatccatttcccttttgttaaggatctctgttctttgttgcctgatatccagtgacttgaaaactgttgttttagatggagtttttatttcattttgtttcttattttttgttttggttgtttcttgtgagatggtaaattcagtctctgttactttttcctgaccaggattcaaggattaagttttgttatgtattaattcaattaaaggtattttttgtgtttttaaaaattatacattggagatgccaagacataaaatcctataaaatagttaagtgtgctgaaaattattttaacatggagtacatatatgggatatgtaaattaaatattataaaacaggttaaagtaatatatgattaactgtcaaattaaagatggtaaggaaaagaactcaaaataagaataatttattgataattatatgtttagagaccccttcatgggtctctactatcatcatgaagatgataatacaggaaaactcttgatagctggtatggaatattttcataaagtccttttatgcaggtaaatgacattatataaagatgtgttgtacaaaatgattaatgaagagattattttatgtcagaggacaataaaggattaaatgtttgaagacatatgtaaatatcagattttagaaactttaagtttgtctttttatataaaggcaatagtaaaccattaaaatttttggcattcatttgtaataagatggtgaatgccactttgaacaagaataatcaggaggaagtgacaaggaagcaaatactagacagactagaaagaaaactattatacttaatcaaggtggattaaatcattgtaacaaagatgaaaagaaaagacagagcagcattacattatataaatttccagtagttggtgactaattatatgcaagaatgagaatatgggaaatttttaagatgaatgaaattttaatagaaagagcataatgaaactatcaacagaaaaatgtaacatccatagcctataaaactaaaataaaagaacccaggaaaaagtaacggcatcatcataaaatataaaaaataaaaaaattatgaagtgtgcaataagtgccagcactattaagtctttacatggaatacttcatttaatcactacagcattattatcagcttatgtgattgtctttctgtaatttaaaagtaagaaaataagtattctatccaagatgataggaagtgatgggggcaggatttgaatttcaatatatccaacttcagaatccagtctcttattacagataattactaaaacgttataggcatagttttaaagaaaatgtattgggcaggagtttgtctaacactgtatatgaaataggaaaatatagttgatttgtgtgatatccagccttaaggaaaatttttgatagccgtaagtaacgactactctcacagttctgcctatcaacaatctaagatagtattgcaatgttctacatatttaagtgtcgattatattaatttttcatttgggcataataatattattttattttatttatcatgatttggccactaagccaaataaacaacaacaaaagaatttaaaaatattaatgctagtacttaccaggacttgattcacagtacatttatgtcttcgataattgggattacttaactttctttattatttagctactcagtaaatctaattgacaagaaactactaaagtctcaaatctcataatgcattttctttacacaatggattattatttttttaatcaggaagatagtattactccagttatatttgttttctgtaataaaagagttatagttagtgtcactataaactactcttacagcctatttagaattgtcaaaatatcaaacttatatgtaaagttatatattaatatgtaaagtatatgtttcaaacttatatacgtaaagtttgatatattgacaatgctacacacacagagacatacaacacacagacattcacaacacagacatacaaataaacacacaaacacacacacaaactaataagcagagagaaaatggggggactgaattacttagtacatgctatgttacagacaccatgctaaacatttttatttagattatctcatttattactttaaacaattatctttattgtctgaaatctgcccaatgttactcaggtaataagctttggagccagatttcagcctttgatgtctgacttcagagttcaagttcttaaccacaatgtcatacggctctgtactccaagatatactgagtcactatagtgtctgccatttattttaataaaggatatcctgtgtggtgaggccaatttttaaaaagggaacctctcaaataaaatgcacgcctgtttctccttaccatacagccatacctgttctctagagatctctgagtttctctttcctcaccttcatttctgagttacctgatttgtgagacatggttataaagcaaggtagctgatgtttccatgaaagtaccacagatgtcttcagcacttttgtctccctgaccactctaaattaaatgcaatagcaacaaattctgatttttgcttaaggtgatttcacttttcatagtgcttgtcaatgatctagagtcaaacctggtggctaaaagaaatgaccaaataagaaataccatttagggttaaaaatacatgagtcatggattttaagcaccaaggaagtattctcatgtggctcataaaatgtctctcatggcgatgcagaaaagaattttcaaaaatattttgagtgtagcaacattgtaggacgaatgtacagccttctcaatctttcattttaaagctgccacaataatttggatttatatataatgggaaaatttttgagaggaaaagctgataatgtcactttttagtaataaaatatatgtctactcctaaaagagagggcattttgtgagctcactctgagactaaacagagactagtacattactagacacagggggttaataaatgtctttcagtaataaaattggatttcatattaattgaactgaatcacatgacccctcaatttacatatttaagtattttcactcctcatgttggtggatgtttatgatgatttcagcaactattttcacagaataattttagttatctaaatcttaaatataaaatgttaggtcactggaaagtagtgtaaattgagagttaagcatacaatatcagaggatacttatttggagttgcaatcctgacctctttcacaaaattgcatgaatggaaatgtattctaattttttattctctaggaagctccacagaatagaacctgccattaaatgatagtccggaatattatgatatgggtgttgataaactctgtaaaagtcagtggatgatgtttaagaaaaaatggcagggacataggaaactgaaaccaatgtgatatggctattttttgaatactaaccttttaaactttgagtgtactcaagtaaagaagggaaaataaaataaaatgtggctacctcactgccttagaaaagttataaattcttcataccacggaaggaatcttgtcctatgcggacaatttatttcatggataaataaataaaataatgttttaaaatgtaaaacaaatttttatgttagaggatggcatagtgtcatcttaataattttatgtttaaatctatgaaattcaaaaaaagttgtcatctgtcattgaaatagcaacctccttcatattctaaaggcaatcatattcatattgtatcataattttacatttttagtagtaactaagatctatttatatggtgacatggttttccctacttacagttcctttcccttcattcataacctttttttgtgtgttttatacagtctgtctttatactttattctggttgatataaaagaccaaaaggtgttctaacattcaacttgctctgtgggaggtagaaaattcttttattttctatccatttgaggagtttgactctatcctaagtcagtagaagctgagagtaaggaactgaggaggtggaaatgattacagaattacagtcaggggcaaagtggtgaaagatattgtatgtgaatgaagaataccatatggtattgatttcatttgtatgtcatgactgcttatttttctaatacccttctctccacatgttttaagatatctttaaaaaatcttcaaaatgtctatattttctgaatttagaatccatagaatccttgcttgctaatactcttctaaagtttagctctatacaattgttattttatgtctcaagttctgaataacactagcattataaaacatcagtattatatggtccagtagcaatattcatttattgtattacaggattatgcatagtaacatagtaacacttgaacttattctttttttattttatttaatttttttgagacagggtctcactctgttgcccaggctggagtagagtggcataatcagggctcacagcaaccttgacgccctgagctcaagtgatccttctacttcagcttcccgggtacctgggattactggtatctgctaccacccctggctaagttttttctatttttttgtagagacagggtttcaccatgttgcccatgttggtcttgagctcctaggctcaagcagtccacccaccttggcctcccaatgtgctgggattacagacttgagctactgcacccagcctcttggctttagtttaaactgtatttcttgcgttttaaaataattttaattgatggtatttgccctccatactccttattgctttttctatttgctatttccataattattattttctgtctattgttcactgtcttcttcaaaagcttctatcccagcaccagttataaatataaatattatttatatattttctctttaattcaaaagaaagatcttaaaatgcaaaacctgatatctataaaaaggcaaaaaaaaaaaagaagaggaagaaaataaaggaggaaggaggatataaaatgagggaagaagagaaaaggaagggatagattattaaattagaataggttgtcacatatagttttattattcctacacatgagtcaaaaagatcgatttcttatacaaaaatatgaaagaggcaatttagtccacattaaaaaattgatttttttctatatcaattatccaggagcattttaaagaaataaccatgtcatgctgctttgattagtctctacaacatatttagaattttttaaaataaagcaactattttttatgacatgaagaaatggaattctcacaccagaaagaaagcaagtgactttagtacagagaacttcctccatacatacaaatagttcagatgactctttgtgcacctctgtgtttttatgtccaaagtgactaaggggagtttaaactggctatcccttcatgtatttctgccaaataatagtatgagctcattctgtgtgggttttgaaccagacttacttttcttttccttgctgattttcaaactattgaacatctttagaccattttcttctacactggcaaactgttgaaatctgtaactaagagaactcttagtctctgttgtatccccagcccccacttcgctactcacttggtgtggaaatttaaaggtccttgaatctttggaaccaactgtggttttccctccaacttttatcaccagcactttcaccagacagcatttcagcaacaaactccccacttcttttctagtccagtatgaactgtatttcagcctcgatttcagccattcttaccctctaccatttattcccaacgtagacatggtgatattatttgttaaaattagtcaattgttgtttctctccacttccctccaatggttttcccatttattcagaattaaagccaaaatccttacaggactttgactaccatatacaatttgacttttgagactcgttactcaccccatcagtcctaccactcgaggcacactagaccccttgatgttcctcaaatatatcctcacctttgggatttgccctggctgttcactaggccaggaacagtcttttccaggtgtctgtatgactaatatcctcagctcccttaaatgtttgatcagatcagtggtgagctgacttttattcaaaatattccattcacatatcccttctttatcttcccagtgtatttttcatttttcatgttaattattatatcatacaaacaatgtaatatgcatatttattatgttcatgatagtttgtctatttccttttcctctctcccttttcctgttttctgctcactgcatactacaacataaactccaaaagggagaggttctttcttctacttactgattaatcctaagcaccttgaaaagatcatggaccacaattgccattcaatacatatttaaggaatttataaatgcaagtatttccagaggtgtcattaggttaataagcattttattttgatgttggccttctttagccatgcaattaaaagattgttcatttcatggattatttttcaattttatttctgattatttaagactgtgttggcatagcaatttttatgtgatccatgaatatctcctgcattcggaattgttcctattgttaaggaattctccatagatacttgcaatactttccatattctcacaagttttttctttttgttttttaacctctttctattaaaatcatcttcctattctgaatacatatttcagtcttatagttttatacttttcaacatgatgagttatttatcatagcaaataaaaattatcatttaatgaaaaatgtaacggccaagaaaaatattattttgcatggcaaatcatgccatctgttagcaaaatacagaattgacaagctttcactctagttttattctgtgaagacttgcacatttaaagtttacaaatacaggcacttttttgcatccacctgtaaggtagaagaagttacattggattgatatttagaaaatcttaaattaaagttgcttagtgttactatattcttattatgtaatatgaatatgtcatacctccaaaaggtattctttaatatctcctttacctctaaaattcagtcattctatatttgggtttcttgattgtaaggggaaaaaacctataatatgttttctgaactagtgtgtgccaccaattttagtgttgaccccattaaccccttggctgcttccactttcacattatcgctttcccatgtttgactccagtctcccgactatgtgcgttcaaccagactacttggccctattttataatacagagaataaaattttgtgttaatcaacttccttgaatgttttccttatttttctaacatgttatcgatgaaacaccagcttaaatatcataccgaagtaatttttatggaaagttctatttcctagagtaggagaagtaaacagaaaagaaaaggactacatattatgtgcaatgatcataaatggagtcaataggtaagccttcccagatgtggctataaacgtctcatcgtcattgtcgtcatcatcatcatcattactgtccttatcattgccagtgctttctgattgcttactacattccaggcactgttctcagtaccttaaatttaataatgattagtttctaccacggtggtactggggagttaatatttcagtccattacacaaaagataaacctgaggcacaaagagattaggtaatttttgaaaacgtatatagcttgtaaataataacaccagaattctaactgaagtgtctggcttgaagcccatgttcttaattactacgcccatttttatttcatcttagagcaggaaatttaagtcacctcaagacaagataattaactctattgaaatcatcatgaaagaccaaagtagaaagcattagatgatgctatgaatattctgtggctacagtagaattaatgttaacagtggctttcagaaaatttaattttctattttaaccatcttaacaaactttctctaaaagtattaaaataaaattttgaataacaagttatagttgaatgtggcccaaccttctagaaacaaaggaatgggctgtacaatggcagtaaaattaatgatagaaatctcagctctgatacattaccagactctctggcttctccaggctggcttacctaagctcagtctagccatccattcatagcaaattgtgaataatgctgagaaaagccctgtggatttggatctgtttggtcagaaccgtgctgtggtttggctagcttgaaagcaaagagcagaattctgtctttcaatacttgtgaagtggatacttgccaactatgaagttggtccttcgaattggatataattctttgtagatgaagcacctttcatggtttctttggttagggataaagaaaaatgtctcagaattgaaaacacacattaacatagttctctgttattctcacatttcaaaaatcagacataaaattatcaaatttaaaagaacactaatttgacattaaaacatagatgaatatatgcataatgatataagttattactttttgctaggtttcaggaagtttgataaattcctattcctcatgtgcattgactatggtataggttttcaaagctagttctctaaaacaaaaatgttgaaaataaaatctagcataaccatggaaaccaagaaagcctaaaattgtcttgaatgttttcaagaaggaaacataaacttctttgtagccagcatccataactagttttggggaagccttaagattttcaagcgcagagtcttggctaaaaggattgagttgctaaacctaataaggaccaaataaatcaaaacccatgaaataaattaataaaaaaagacgaagtctgaagaaatacaaagtttaaaggcttaattattcagctggtagcattattcaactggttaagtgtgtggaaaaagtcaagaggctaaccacatacaaatattgtctaaatggtatatatatggttaccagaatagtaacagtgctaatgtttgttggattaggatcatctctctctcattttataatttgagacaaggtctctgctgctcaggctgaagtgcagtggcgcaatcacagctcactgcagcctcaacatcccaggcttctacctccacctcccaagtagctgggacagcaggcatgcaccaccatacctggctaatttttgtatttttttgcagagacagggtctgttcatgttgcccaggttggtcttgaactcctgggctcgaatgatctgcccacctgggcctcccaaagtgcttggattacagacatgagtcactgttccaggcctagatcatctcttttggattgtttaccttttttccatgtacttccaaagtttggtttaatatggtaagtttaaccatataagtggaataaaatgtagctgacagttgtgatttacgatagcatctagaaattattgctattgaaaattgactctttagagtgtaatcattaaacgcatagtgattgcctgaatcatctaatgaggtcttggtgattttttaatgttctttgccaattaagcaaccattaagtaatggttgagtgtgcattatatacttggctttgtgataagttgtgtgaaatatttaaaagaaggataaaatggtattaagtctcccttttcaaagaacaaactgtagaagagtacgaaaaaatcctacacatgaaaagtagtacataactgtgtataagtaaagctaagttgcatgatacaaacagtttgattatatgacattaattaatacatgtaaaataacacaaagataagagcaaaatagtttgagaagggttagcaaggtcaactgggaccatcagagatgaaaacataacaagaaattaaaaagggaagctggctataatagtgtgtgggtgggtggtagaggcaggagtgcaagaagaacatcaggaaccctggcataggaagcagctgattatgctgaagtgacggttatgctaagaattctgcttgcacaagttaggtagaaacaactaaaaaggggacacattatttatggactacagccaagggaatttttttttttttttagttttccaataatttgcaactacagattttgagtagagaaatgacattcaactcagcaaacattataaatcctcacctgggttatagttggttatagtcagtataagtggggtgttgagattttgaaatagtggaaaggtttgtgtaaaggaatctgggaataacaattttaatgaaactcggtaatcttttgtagataacattgaattaacgaagaagattcatactgaatgcatatataaaatggattagatgacaaaggcaatggattcaggaagatattcagtcttttcttagactacttttccattatgattgatcacttcttcctaactacagcatctgggaggcaaacagaggaagattctgagaagtgttctagaagttggacagtaaaatgagagagtggtgtcttagaagccaggattaggaaagctttaaagatgaagaaagtagtgaaagtatcaaatgttgcacagcagatcaagtaggctgagtgaagaaaaagagcctttggatttagcaactgggagattatttttgacagtatccaaatggtttcattgaattggtaggagttagagaatgaatgggtataagaaagtagaaagagaaagaataggatactctttccacaaatattttcaagacgaaaacttaattgttacatcagcattttgatacggagaaggggaataggagagaatattgttttgtttgcttcgtttaggaaagttgtatcttgagcctatttagaaacctctggaaaagagattaacaaatgtgagagacatcaccttttatggtgtctaacatgtgagaagtagagagggtatgggagagggaaggaataattctgagttttagcctctcaaagtcatgagatgttctattatttctgccttgcactttcaacttcctgccatgtacccacacaggcacacacgctcacatctaacagtacttttactagcctatcccatattggggcaccagagcactaagcgtagctagattaatctactttactgttgttattattattctaattcatttatttgataggcttcaaatagaaatatttttggtttcaggccaaacctatgttccctaggtcaatagtaatatgtcgaatttctaaacattcaagaaaaaaatgtttttagtaaataattaaatacaaatttaaagaagaccttaagagatctttgggcccattccttctttcttctcttttcacaataaaatgccaccccccaccccccacacacaaacattccatttcataatgccattctcatatcctgtggtttttattactacaagttacaaatcttgtgaattaaaacttggaagcaaactaaatgcatcacctcagaattaagattcttataccaagtcaggtctctgatggaaaactcacagggtgagctccacatgcctttaaactctctgttctctatagaaaacagtacaattgttaaaatgttcactgacttctctcagcagagtttttaatgagctggtacctgtatagccctttgagcagttcaggccagggttctttatatataaagcagacatataaaagtaaaaggcaagtgagtaaaaagcataatagtccatgtgagtactaattgtaagggataggaaaaagatacaatataatagctttaaaggaaaaatagaaattgaagaccttatcacaattatccttataatgcacagaataatgtcagactgctttggaaaattcattaattttttttaaagttagtattgatacgaatttttggggtatatcttctcaatgataagtaggttaactgaaaagcactttgatttaggagatgaagtctaatttaaattatgttaaccccttcctttcttattgtatacttagtttttacattttttcatagcctgggtcttacatcctccaaataccttacctattcacctctccaaaaaacagggacacagtctgttaagtaagtctaacagaatatagatattatatataccatgcaatttaatagatactctatatagatgtctatatagatattcataatatatattaattagaagtaaactcctaaaggtcaataaacaaagtgaattccctgataattcatcacctcatgacttgtcatctgtttaactataagagctagataatttaattggaatgcggatgttttatgacaaatatatgaagtatcagcaatagtaaaaaagcaaattttagtcttctgaagctgtcttagcctgtatttttttgaagcacagtgatttgttgcacagtctttgaagccaaaatgcctaggttcttatcctgactctgccatttcctaactagttactccacctttctgctatttggttttcttatctgtataatagtgttcatagtggtactgctataaaggtctgtaatgaagattaaataaaatgctggagcgatacctggcaaacagtaagcattttacaaatggttgcagttattatttaagaaattattttaaggacaaaaagtgtatacatatatgatgcccctccctatgttataaaattaaataaaatgcatttcagattatggattacaaagagaagaaatataaaatgaaagcatttaacgtcaacacatttccctttgttctcctaactatgaaacttgataaaagagtgctgacattttgaagaaatggactttttggtgaatattacaatttctttgttcttgcttttgacatttactatttcaaccaacaatctaagtgaaaccatgcaaactttggtgcctaaaatagggacaaaaggtggtggtgtgatttgagtaacagaggaggattttaaaattctgcattttgtttccatatatatcatgtacttagcctggaaagaaataaattataatcataattgagtcaagatattttcagaattttgagacatgctcaagtttaacattctctccagtgctagccaaaggacccaatggatttagaagattcatggtccaagccatcaactgtctcttaaaattcatgtttattattctggcttagtgaatagggattgtctttcttcagcaaatgccagctctggaattgtttattgagtgtctacatcattaaaacttccaagggactctttgacctcaagcgtatgtttccttggcacagacacttgtattttcaacacttcggagctggcaatataacttggaatattttgtatttaatgtctgaataatatcctgggatttgttgtccaatgtgaaatggccaagaatattgaagagtggctttgaggatgacacaagtaggtatgattttgttgaaaaggtgagaaaagaggggcacagaaaacaaaaacaaaatccttaaagaaaattaaataacaaataaaagacatagaggtagaagtatagaacctatatagtttatcaaatctttgcacctcagttttctatggtcagcacattactccctatgtatttcctggtttcacttctttcaggacttttggtcacatatatttataacctctgataataatataatcaaaatgtaatgtaaacaatattgctgaaggacttagtgcacttaaagattataataatgtttgtctttgatttttatttattaattccatgcatttcaagaaaactctgaagttggggaagacgttttttagagaaagcttaaaatgtgagagttcattcgcagttacgcaattctggttttttttttttgtagatttattaagattttctacatacacagtcatggtttatgaaataaagacagttttaattattcctttctgatcttatctttcttctttaaattgtgtgcattttgcctcagttttttccgtttttagcttgatatatttataagtattattttttcttattatattgatattttcattatacccgttatagtttcttttcttttcaatttttattttaagttcaaggatacatgtgcaggtttgttacataagtaaacttctatcatgggagtttgttgaacagattatttcatcacccaggtattaaccctaatatccattagttattttttctgatgccctccctcctcccacctaccatgctccagaaggccccagtgtgtgtggttcctcaccatgtgtccataccttctcatcattcagctcccacttataagtgagaatatgcggtgtttggttttctgttcctgtgttcgtttgctgaggataatggcttccagttccctccatgtccctgtaaaggacataatcttgttattttttatggctgcataatattccctggtatatatgtaccacatcttctttatctggtctgtaattaatgggcatttaggttgattccgggtctttgctattgtgaattgtgttgcagtgaacgtatgtgtgcatgtgtctttataataatattatttgtattcctttgggtatatacccagatattattattttccttgaatccgttttgtgcaataatagagttatgccaattattttattttacaatatgcatagtaatcttctttaatctttccactttcaaattatttttgtttctaaatttaaagtatctatcatttcttacagatagcatataattggatcttgatttttaaatttaatctgacaaattctgctatatgtttgaaaagtttcattccctcacatttaatttaaacagtacatttggctttaggtttgccatttgctatttgttttctgcttctctcaatgatgtttcgttcttctgtttttcctttaatcttttgtttttgttacactgttagtttaacaaaatgattagtaaatatgtaattttcaatcctccattgaccttcttgcattatctgttcatattttctctagtgatttcaatgtttatctgtaacttattacaatatacttcaagtgggcactaaattacttctggttaaatataggaaattttcataagtctatgtcctctgtaggttccatgctgttgtttccatatgtattatatcatatattttataaagccaaatatacagtcttatgtttactttaaagtagtcatgtgacttttaaacaatttgaaaagagatatattagtgaatggtaacaaaaagtgaataaaagcaaaaattatcacttccccattacacctgtcattccagcctctaagtactacatattgttgtttaaaactgtcagcagtaaaataaaaagaaatattctcttgttatcatggcaggtatatattttttataaagtaaactattcttttaagaatttaaaatttgatttttttagtgggaataacttagaagtaagttaattttaatattaatttgatgctgtatgtacacacacacatgaagaattaatgttgtgtaatacttttcatttgactaggcatctcaacatgcccttgtccatttggttatatttgaggtagctgctatcatggaatttttcacagaagtcaaatatgttttgagaggtcaatttcactatctcaaatcatatagtcaaatttcaaattttgtcaaatttagttgctatcttcaccataaaataatcagcacaaggtcaaattaatgtttgcccctatataaaagctacttttctattttctaaagtttctgatcagtattttaggttttgtttcttctcatagtgatgttagaggtatgtgactaacttttttatataaattatgaggatcacatgggggcaaataagatttttttttcaaacaaagatctttaatagtgtgggaatcaatgctaatgtgatacaaagcaatctatactgtattaatcaaagatccaaagcaccctgattataaagagtgaaagctcatgcaaataaattatgaaagaatacaaatgaagacacacttacatgactgcctcatttccagagcctggtgacagtcctgctgttctcagcatgctgcttcatgatgacctcatcagtaacataagatgcattcagctatctggcacctagatggcagcctacaaaatctaaacacagtgatttcaaatggaccataaagcctggctaaaatcttacaaattagtaatagaaatacctgttacatcatgacatcatttgggtacactcagcaaattattccctgatggaaattatttgaaaaaaatatatatgcagttatgcgttacttaacaacgggagtacattctaagaaatgcatccctgggtgattttgtcgttgtgcaaatatcatagaatgtacttacacaaacctagatagtatagcttaccacatactttggctttatggtgtagccttttgctcctaggctacaaatctgtacagcatgttatggcactgattagtgttaaggaaataataacacactggtattgtgtatctaaacatatctaaacatagaaaaggtatagtaaaaatatggcattataatcttatgggtccactgtcatgcacgctgtccatcattgactgaaacattgttatgtggtatgtgactgtatatattacatatatgtcatatatattttttatatatatggtttgtgtgtatacaatgtgtgtgaatgtgtgtatgcaaaatacttattccatttgttaaaatataatatcttataatgacagtgtatgcctacaaagatgaaggtgaatagaacagcagttaaggagcacggtttgtttctgaatcaactatagtatgtgatgagacgtggtgtaagtgctacagttcagagctcagggaacatgaacacttcagggcaccttcagggattaatgaaagctctttttgtcctgtggatgatagcgattcatacaaatgtgttaccattgatttggcttaaaaatcacatttaatcattttttaggagaatcttccctaaagctaaataaatatcactatcccttttgatttaggatgcttgaaatctgtgaagagaaatttcctttttaataaaaaaaaaaaaaaagcaatcttgtccacttaaccatctcagcttagcagttctgaaagggttctttttcttcaggcctcatgctggatttgccttgcagttagtttcatggagaaaaagcaacaatgctaaaattataggtgccagtaagtctaattgtgatagatgatgcatggtttcagaaaagggatttattcttatttcagaatgtcaaatttagttgacattattccttgagaatggaaagttaggacctggatcccctgaatcatctctaaagtattataagaaaaatctgttccctgaggtacttatcagtcaagggacagcctgagtgtggtgacccacatgtagagtcagggagaatggatgaatcataaaaaggtccacttgaaatgcctttttaaatacttaatataaatgtaaaaggcactccttgaaaaaataacgcaaaaaataagttgccataacccacagcttgcctgggacagaatatgaaaaagaaagcgttcatcagtgctgtttcaaatactatagctggcacgaaagtaggcacaggaggagaaaatcaccctgaattataaatgttgtgtgctattttcatggcaccaggtgggaatgttaacacttaatcagtctctctggcactatttcccatccatattgccagctttatcaccatgaaagatgctttgatcctcttctgtggtgtcaaaaacaacaggccacagcatcaatgacattccaatcagtggggcatcactgcgcattagtttctatcagatatgacgtttcactaacgcattttgacaacatctggtacaatacagaggtctttcagagtatacactgtatatatatgtgtgtgtgtgtgtgtgtgtgtgtgtaatatatatatatatatatatatatatatatatatagaaaagggtatatacctttttcctatgccctaaaaaggagattaatcacaaagcacttctcttttactgttgtagattttgaaagcaggaggaaaagttctcttttaaatatgctacagttttctctttggtgatacttaatgctctcttatggaaaatgaaattcttagatttctaacatactggagagttaccttatgttaaaacaatgcctttgaaaataggcattgttaagatttgcacggaagtatcagttgtgaaatataactgttgtgtaatggcaaaatctttcttttagtaagtacctcctttgtatcagacactttatgaatggtcatttcaatgttcacaaccactctttgagggagatatttttgtactcagtataaatatatgaaaataagttcagagaggctgaataacctttctaagatcacttagaaagtgtccaaactctgatgctccctgagatccaacttaccgtaccatatccatcctactgccactcaaggctgccctcctttttaaaatctacttaaccaaacgttaaattattctataattagacaaatagaaatttttggccataattaaaggaaaaatgttgcaacatgatatcaaatgatggttatagaaaatcagattaaaatagttcaaaacatctcaacaattagatttttctcttggtttgtcatttcttttattgtttactgataaactcactaggtttatcagctagcaggaagaaagacaacaggacttttcctattgatgtggagcagatgcaagatagatctggagcacaggaaaatttcagatctggatgtgtttaaatctggccctgcactgccaataggaagagcatgacattactggcaaatgggggtggagagggatatgtgtaaatagagggataaagcaaagtagcaaaatattataaaatgaactcacaacatactccctgattccattaaggccagtcttaatctctatctataccatgataagctgtatcttgccatatattgacctgaaaagttagacctatgatatattgtaggtaaaaaacaaataatcatttttgcagtataacatcaaagaaatgttaaaccttcctcatttcctgccccaaatgtacacattttaaaaagtaatgcaatatatttatattaatatattctatccattcaatatataaaagttagcctagacacttttatggaatatttttacaataaaaaagttagaaagagaacattttgtattagatcaaaaataattcaaagaaatgaggtaatgcattcttttgtatcacttctacataagcaatagtctttgaggtttctaagtggcttaaaaagagatttgataagttaaaatattgtcttttctcattttatagccagagaaaaatagtacttgtctggaatatatataatattgcacacggggttaattaggttaggaatgaattaatttgtaacaatttccgttatttgacaggcatcaataatatagcagcatattacatgcgttccagacatcagcatacttccatgacccagtcagattcaatttggaaaaaccttggatcatatgaatattttattattgatttttgtaacatcatattttacaatcagttctggtcataaaagaccataataacttgaagagatattttagaaagccatattgttgatgaatggaaagtatgctttctgcagtgaaaagaaaacttactgtctttttcctgagacaaaatgtcaaggtataatttgtactttattaacagctatcaaggaagttcattttctgagcaattttttcatcctttgatttgatattttgggtgtggggcatgggggtatgatgatagtttgtatttcttggttgtcctggctactttcaaattcttttcatttcagactattttctgttgaatgatttgacttctcctaaaaatctttccggtatcctggccctcaatcatttgcacataataatccaataaagtatcaaagtttgcagtaaatggtcagacggccggccagcttgatacagaaaggttatgttgatggtacccatgtttaaatgcatttcatttccaaacacatgcttacattcagcagaaacctaattgtagaacttttgcttatggagatgctaagcataatctattgaccacgtataaaaatacaataatgacatctctaaagaatggtagagtaaatcacaagacttgatattagttatgagttttcttatactgtctgtatttgaaaatgtgtaatacttgacacaaatactgtgttagttacatttaaacaattttgtgaaatcagaacacacacacatccttccccagaggagtgcaaatattgatgttctgtaggctcaaagaatgattgctcaaatccacatttccttggttttcttacttaccatatgttattcagaatattttgctcttagttatgcttttgatgaaatcattgatctctactatcagtattcaccatttgtcattttctgaatctccttgccagtatcacttatcttttctccaggttccaaaatgtaagcaattttctgatattctggtctaaatgccattttcttcttttactcctttcttttctactatagaacctaataacttctggggagaaagattgagagtaagagagaggagggagaagagaagtaggagcagagacttatatcatgccatgacatgtatactgagtattatcagtgcacaccaatgccccacacatgtatgcatgtatgtatgcatgaagtttatttgtgtcaatgaataataattaccaattttgtattaggcagtattaggatatccgatacacaaggatatataggacataattcttctcactgaatttacagtgtaatagggccaaagccccgaagagagctaatgacaatacactatactaaaatagaagcatgcacagatgttaatattacaaacaggagagctgcgtagtcaccagagagccagaaagagtggtgaaaaaactgaagctcatagaagctcagcacaatgactatacccatcaaaaccctatctagaggaagggccctctcttatggctcaatttattctgtcaggagagagccttttatcgtttgtgcaaaaactgggggcctcagatgacctaaactgatgccataaaatgttaaaatagctcctctctcttttaatttctaagctattatgtgaattccctataattaaaaattattagtggttttcagtagaggctcatggtgtaacagcttgatcttaatgtgctttctataactaatctggaaacttttaaaactcgtgggcttgtttttaataagtaatggtatatattttatataatgctatatacaataacagaacaaagtggtatttataaatgccttacaggtacctacaggcaaaacaagtatgtatttaagcatgagttttttcagaatgttcacaattctgagcacaagacaatttctgatattgaaaaaaatagcataattctaagaagaatgacttattctttagtcattgctagtcaaaactagtcttactagtaatatatagaagaaagatatacatacttgcaagaacaaagaattcaaaaagaaaataataaaataatgggggaaaccacatgtaagtgccagctcctacagttatcttccatgacacccaagcctttcacttcctctggtgcagcagcatttcagtggcctccagctgggtcagaatagtgttcatctcgtgctattctctagtgtcccaaaggtgtttaattttcaagttacagttgacacagaggaatagaattcagcaaatgcaagaggaacttgagataagaaactaaaggtgactacagggatattatcttcgctttaggggaaacatattctccaatgtaatcattgagccatcttgtgtcatcttctaatcctgggagatgagtgctaaatagatgaagaactctatttactctaggatatgagattttaaatgaaacaatcccatggactttttttttaagccatgaggctacatggcaagattttttaaatctttgtttacacttaattatatgcctatttaggatcttgattaacaaaaattagatattagattgccagcaatgaatgtagatgtaaaacaccacaaaaatatttgaaagtcttttataactcctgaaaaattgttactgaaatattcaaaatgttactattcaccaaaattaccctattcatgtgatgagtatgtaatgatctatctctctcagtagttgctgtgtattcctctgtaatgtgaaattgagaagattcctaagacagaatcaatatcatcttggctactgaaaagtcactcctgtgtgtatagtaggtgatagaggaagaaatgatgggctatgtatattttatgagagactgcctttttttttctctctctctataacaaagttcacaccactggcttgttgtatgacactgttcctggttttcagtatattcacacatgtatgcggagtaaaatatagtcaaaagtacatgcatcccttgttaaactgacccaggaacaatttgttagcttttttttaaggttctatgctgcgagcataatggaagcagcatgtgagttgaagaaggaaggtcttttggcaagtccttctccaccatccattggctttgagatctgggactagttcttaatgtaagacactagccagctaaacagtgccgatcagaagtaatatacagatctgctgcctcctagtctgaagctattccttttcctacatgaaaaatgccattcaataaggaagctgtgcctatatacttcaagctcatttaaaataacttctgctctaagaaatgttctgataccactccattaagtcagttctgaaataccttgggtacagcacttcctttaaatgtctgctattcctttagaagcaccacaatattctccttctcatttgctgattacttgtgagtctaagaaatgtttaacttattaccaagtgcgagcaaatagaaaaaggttggaaagaaactgaaaggagcatggcagagccttataaaccagtggggacaaaagagcatatttagaattataaataaaggtactgtatataaaattgaatcctaaaatatgaatttaataaatgccttaatagcaacagattgaatgttgtattacttttgaagaataacaagaaaaagaaaatttggttaaaataacattctataaatagcattaagcttcttgataaaaagtcatttacaaaactgagctgctgcttctagtatcatggtatttagatgtataaagatgttgtcttccattactttaattctataataccttatgcagcatggaaatgaattatcttatttctgagcttgcatttggtataaagttaactttagaagtttggtagaattgtgtgaattctggtacagattattcaaatgagtctacttcagtggaaaaatccatggaaaaatagtaactgcacacacacacaaacacacacacacacacagaggggggttggagagagagagagagagaaaacagtatatacttatcgcattcaagagagtttcctatttggcaccatggaattattcaagtatccattgagtctttggaaataatgctatgatcacctaaaagagcctgccaattattgccatatgtgaatgtggtttttataatctggatacttatgccctaggatttggactaatagctctaacctttgacttctcattaactgctagaaaaactatgagacagaggagacattggtcagtgtcaacatgatataaatttggacaagtggctgaaagttgagaggattagtatcaccttagcgatggtactgtacttactgagaaaaaagactgggaaaactaaagtatttgaaagtcatacatgtttggaaactatgtaaatgaaggctccttccaaaagtgaggacgagatgtagagggaaggcagccaggtttggaagtgtttgctagtgcatgtggcagcctaagaaataaaaatttataattgccagtattgggagtgggaagagtgtacctatataaaaaagcaaagcagctttgagctacaaagtcaaaggtaatcatttcaattacccctgaggagatccattcagctttggtgcttttaccagcaagtacaaagatttcagagcatggtaaacgtattagatatatgtgatcagatggcctggcatatacaccaagaaccaaaagcaaaaattgctttgacttgtctaatttgttaagttatctagacatagtttatctatggaaatctctaggctcataaagtagggtgtggcaaaggacttgccatatatctattaataacatacttggaaaagaaggtgctcttttgtgatatatctttgtgaattatatttaaaaagtataattttaacagaaaaggatgttggtataatattccaagaaaaagcaaatgtccaatacatctccaaaagtagaagactaagtaaaggcaaatgtggtttaatattgcttaaatatattgacacatctacctatgttgcagattttaaaaatgtttatacacaatatgtaagcatttatttatataaatgtgtgtcaatacttactaatttctaatatgctaatgtgtattagagaatatttatactcacatgtaattcctacaaaatcctattataaagttttcactatccccattttacagacaaactaaagcgtgaggaggctttgtaacttgttcagttacatatatagtaactggcagagccaagatttgaacctgagcattctgaacctgggctcttaacaattaaaatgtgcagatcaaaataatatctcctattgatttaccagcattgaggatgcactttaaattgttggtccaatagtcatgacatgatttttgttggtatgatcataattttttcttttctattttgttataaatagtatttattagccaacaacaacaaaaagcttatattggagttcttaaaacacaggctttctatttttgaagacaagtatctggttcataaagaaatcaaaaccagtattctggtttaataagtactatattctaagacaatgaatcgctcaactcagtaaagatagtttatttttcttacgtatcagtaacgtgaaagatttctccagcaatattttattgaattatttttacatagaaattatgtatttctagatcactttggcttctctagaaatccatatttttgctaaccaacttcatttagtgtcaataaacagaagcctatgtgacaaagaaaactaaatgtggcatttttcataacatgaaaatattggaatccatttttttttgcagtacaaatactataaataccacacgatttactacagcaaatgctaacttggcatttcctattggctaactcaatgtaacacatccaaattataactcctgtgcctttgctcatatagccattccttctgtaactcaaaaaataggaatagttcccaactgctcaatgtggaactttagatgtcagtctttttttttttttttttttttttaatttttgagacaacatctcactctgtcacccaggctggagtacagtgatgcaatcttggctcaccgcaacctccacttcccaggttgaagcgattctcatgcttcagcctcccaagtagctgggattacagatgtgtgcaaacatgccgtgctatttttttttgtatttttagtagagacgaggtttccccatgttggccaggctggtctcatcctcctgaactcaagtgatccacctgcctaggcctccaggcgctgtggctcacgcttgtgctgggattaaagacatgacccacagctcccagctagtttatttttttattttttttattttttattttttttaactagtttatccagatttattttttctacttctattgctatatcattggcaaaaattacatatatttaaggtatacaatgtgacaatttcttatacatacacactgtgaaatgattacaaaaacatatctatcactacacataattaccaacttttagatgtcatcctatttttttataatttcaagttttattttagattcagagcatacatgttcaggtttgttatatggctatattgtgtgatgctgagatttcggatatgaatgatcccatcaccaagatagtgagcataatacccacttaatttttaaacccttacccacctccctctttccttgccattggtccccaatgtctattgtagccatctttatatttgcgagtacccagtatttagctctcagttataagtgagaatgtgcactatttggttttctgttcctgcctaattcacttcgcataatggcctccagttgcatccatgttgctgcaaaggacatgatttccttctttcttatggttgcgtggtgtcccactgtgtatatgtactatattttatttatccaccactgatgggcacctcggttgattccatgtctttctatagagaatagtattgtgatgaacataagagttcatgtgtctttttggaagaatgatttattttatactctcttccactttgcactctgcatcatctaaaatcttcatatcatctacataatgtatctcaaataaatacatttctttctatgtccataatcacttctctacctatgtcttatgatttcttatttagattatttcagtagtttcccatctgttccattcttgactcagtttaatacattttcccgatagaagcaagcataatctctttgaaatgtaaatctgattatggtgtacctcatgcgtgaaacctttcaataacccctgataacacttaatgtagaaaaacaagccaccttaatataagcctgaagacatggcatggcctaattggcctgcatgtgccaccaaattaatctgaggccctcatatcatttcttttccagctatactctttttctttacctttcatttactctccagttctttcctgcctcaagacttttaccctagaattctctgccttctactttattttttccttttacatatcatgtgaatactgtagtactttgtacatatcacagaaaatgatagatctcttttaaaggttagacactgtacataccataaatattattcaactggaaattcacttactccatttcttttctatgccaacttaaatttttatttaataaaaaaagtttccttagtaaatgtaactcatattttcctttatttttgtgatattttctttaatataattaagatttatatacagttaagatattatacatattaagaatttttaaaaatgaaatctttaatataaccaaagattatattaaagaatacaaaattaaaatataattaaagattttgttttaaataaatgcttataggacactgggaagtcctttttttctggttttaaaatgtgattatgatgatcattaattatatatattattatatgttatgtacatattacatatattatacagagttgtcccttggtatcaatgaaggattggttccaggacccctgaggataccaaaatccatggatgctcaagtcccttgtatataatagtgttgtatttgcaaatagcctattgcatgcttccatatactttatctctagattacttgtaatacctaatacaatgtaaatgctaataagtggttgttatactatattatttagggaacaatggcaagaaaaagatctgtacatgttcaatacaagtacaaccatcttttttttgagacaagatcttgctctcttgcccaggctggagtgcagtaatgcaatcatgactcactgaagccttgagtcccctggtctcaggtggtcctcccacatcagcctcctgagtagctaggactacaggcaagtgccaccacaccctgctaatttttgtattttttgtagagatggggtttcaccatgttgcccaggctggtctggaactccagagctcaagagatccacctgtctcagcctcctaaagtgctaagatttcaggagtgagccactgcacctggcccttgactagccagttttttttttttaaattgatctgtggttgattgaatccatagatgcagaacccataaatacagaggccaactgcatttctgtatttagcacctaatgaaacacataaatatctttacaaatttgtccatcctctttctgtttttttaattcggaagcttcttgatggattcatagcatgagactgattatttaaagggaaattagacctactaagatatatgtgtttggttggaccaagtaattgggcataggacatgtgataatggagaattgctgtggagagatgaaagaggcctccattcttccctgaaagtttttcggttgccttatataagccagtcattctagtacatggtaagaaataaaggtaaataaaagaaagatgcccatgaagtgcacttaccttatctatcacactgcagtaacataataggagtggagttttaaacacatgtagaatgtgctttctacatgtgttttatgaaaacatgattatactgtcagtgtttagagtgacaagattgccttacaagatatatcaattttcaactgaatatagcacactgttttagaaagaagattttcaggtagttgaaatttttatctggcctgtaaacacacagatgatgaaatgttaaggcagttagaaatgactgctagaatatgagttcaaatgattttatagaatacttccatgaacttgcctagtcataaaaattttcttttcagatatatccccacactatgtatcatcaaataaactgtaagcgctaagaaaccaagacttactcagaaggaaagtggtacagactctatcatgtgttatactgagggcacgttaggtgtactattagatgtgtttttccagttctaattgacaaaagtgttattggtttgtaaatactttatttaattgtgccaaatgtataatcaaattggtaggtgcagttgggggacagtatggaaagtttttttaggcatcttttctgaagtgcatcaatatacccctgaaagtcttgagaactgtgctttttttttgtttgtttgttttgtttttctctgtattgctttcagatacatggtacggacacatagtagggcgttatatctgtaaatgccataaactgtttctgatcaaaactcaaagaacttgggaggctgaggcgcatggatcacttgaggtgagaaatttgagaccagcctggccaacatggtggaaccccatctccactaaaaatacaaaaataagctgcgcatggtggctgtcacctgtaatcccagctatttaggaggctgaggcaggagaatcacttaaacccgggaggcagaggttgcagtcagccgagatcatgccacggtactccagcctgggtgatagagtgggactccatctcaaaaaaagaaaaaaagaaaaaaacagaaaaaactcaaataatttatgcaatctcactttattactttattctgtcagacgttaagcacactccactaattttggaacataaaatgctttattttttccctctacccaataaagttccgtgtttcgactaataacatgtagtagacagtccattacatgggaagcaggcagatccccccacaaaataattcagcccacaaataccttttcagcaggtttgcataaattaagcattctctactcctaataaagtttctttgcatcagagccagtcacttgactagacctctaagatattgttgaagaaaactactgtgaaactaacagtcactggaaagagataaggtaatcaatttccctgtgtgccttggaagatgtctctatcttcatagtcacccttccattaaattggttacattatttttacagtgcaggattgcatgttaatgctacattagttgttcttttacagttttacatgaataagaagaaattggatgcaaacacagaatacctatgtcttggaagccctcaaacataagtttcatttctgtttacaacacttaaatcttgggataaacagccaatgcacttaatacctttaagccctaaccttctcctcaggaaaaagagataataccagtctcacataattgttatgaatatggaattaaaacacaggtgcaatgctaggcatggagtaggtttcagtaaatgctgctttttacattacctgtaggtatgaactgttctctccaggtacatcgttctggaaaaggtgatgtaaacattgtagttcaatgtgcctgggttttcaaaggcaacaaaatgtgtgccgctgtctaagatgtaacaatctcagggaactaactccctttcccaccctcttcccaatccctcacctttttaggtctcatttttttgcatgttataaaaaggacacaattatcctgaatgagtatctcaaggcaatcaatgaaattctaaaaagtaactccaaagggttaatggaatatgtaattatctctactaagaaatagggtgatggtttaaattcatatgtaaacatacacacataccctcggcgtgtccattttaacacacacaaacacaacaattctctctcctccttctccttcccactccccgctccgcccccaccatcctctccacacttctagggtagcaacactgaatacagatggccaagtctgaggttatgtgacatttccagataaagtgaacaaaaatggcagagattcttctattgttcttccttatggtccacattcctaatgtgtcccagttatttatactatgagtgttttatatttgccaactataagcaatccatcttaatatttccaatacgctattttctcatcttttctcccattcttcctgtcctctaaaaggacaggaagagagaatttcttcctcttaaatggatttaatcattgtattccttttattgcaattcatcttccaagttgaaagtaaagttttagcataacatagtgaagaaaaaaaatggttatctctatatttataaattaaccattttaaagaatgtaaacctgttatagtgcatcttgaagttttgggatattttattttcataacaccattaaatactactatatattgctgtggtatctgcccatgagattgttccatatgcttgagaagtttcttcccaccttcactgggagaggggaatatttttgtgtttctgacatacaaatgtcagtgaatatacaaatctgaaactttatagaggcaagtttttaaaaatatttttattcttagaaaaatattttttattaaataagatagaactcattttatgtgaaaatcaaatatataaatgtttctatacaattacaaatatttatgtctttatagtttcaaaaaagaggattcttttaagatatttaaaaaactcattcagtcaagttttgttgatcccctaagcacttatttatcatggtgtttatgttttccttgagaaatccattcttatctatttagggaataaatttcaggataccttaagtagaaaccccctttccatcttagaacaaatacttaccataaacataaaaataaataaaaaacagaccctaaaattacactaactcttactttatttttctgttacctgataaatgtctgtctgccatgaaatcactcaaagcaaatattgaatacttttaaatgataaacttctcctagttggtaatattatgtgataataaaaatccaatgtataaattatatatcataggttttttttaaatccattggctttttaacaataatattatcacataagtcatagtaataaatttcgaaaaataaagtgggatggaaagctgataggatgatatgaaatattaaggtgtgaatttgaaagctgagttaattcctcagaatagaaatgtatgttaatttaaaataaatttatctaaacagtaaagccaatttaaaggacttataataaaatgcaatgatgtcaccatttttcaaagttccagtttgtcatcttttatttgcagagtggataatcaacaatataactaagagagcaaataattgcacattgtattttgcagcatccacagaaatttgtcgtttatccctctaaattttccgctctgttttcatttaaaatcctggatttaaaaaagtgctatcttctgtatacatcttaccaagtggggatgcaattacttaatctggaaagtgtgaaaattcatgttagtggactatcaaaattttctgtcaattataaatttcctccatgttgcatgtttttgaagggaaaaaagcaagaagaaaaaggaagctcttagatcagtgaaatggaagtaagaacaaataaaaactgtggtgagtggatgtttgtgcatctgtatgtgtgtgtgtagacagagtgagagacagatatggatatgcagatgtttgccccacatagagtgtgcaagtgtgcaatgtatttacatacgttacatgtacataactgcacgcacatgcacccaaacctcaaattatacaaacacacatattctttgactaagatattttgattttttattgtgtatgtgcaataattttacttctaagaaccttttcgtttttaagtttatgaaataagtgatcaagttaatgtttgatgaataagaaagtacaaacaacaacaaaattatatatacatttttatcctgcctttttcctgtaaaaatattatgagcatctttccatgtgagacactaataccattatacaaatgtatgagaatagcataacttatttataaaaatgtgtgaacatagcataatttatttagctgcttttctaatttaggtcatcacactttttttctaatttgccaattttataaatagtgttgctcatataactttgtgtagatgaacatacctaggacctaagtgttcttcctacattcatgtacaatattgatcctttagaaattacagcatctaggttttcatcatttctatctcagactccttctctgggtggcattggacactccaaaattcaatttatggtggtaattctgttcatctaaaattaaattataaaggtggatatttgattggtaaccaaacctcatgttctagttatgattccaaatcagcctgggaaatgctaatttatagtaaagagtattcagatgtagtagtgatttagcatctccaaaactcctttctaggagttttcctatacattccaatgctgttctgatatttaacaaaacaaacaaacaagcaaacaaaacacttcagaaaagcttttcagcactattctgaaaagcttctccaggctgtctgctaatatatcctgagtatagagttgagctttatgcattttgacattcaccttaataacatcttcataaataagactttctatcccattctcgctctggcccttcccacataatcgtctgctcattacatgcatattctgttaattgatctcattctctgagcactgatcatgaagaacggaaaacccaactagtgctactcttaggacatacagttccttgaaagtggacagccaaaaagctggcaaaacaccaccatcctcaggaccagaagctgttttaacattctctttgtggcgaatgtacattggacatattttagtgttactggcacctgtcttactaaatctgatgcaataacaacaaacacaataaagccttgttactaagctatctttgagccatactggattgtgattgattttgctgtgtttaatggtgtggtggcattttgccttaggccttttttatagaacagtggaaggaacagaagaaggaaacacttgatcactttgtaaatgctgcacattgcaggcagagtttaatgactgaacgtagccacttccagtgtattgaaatgcctgggccttgcctcaacgcattgtacctctattcagatggcaaagaatagagttcctgtaacattgtggagtgcagctcattttgggcataaacagttgctgtgaccttgtacaggcaaatagaccctgtcaggcctggaattgcagggccaggaaatcatctgtttagtcagtgctggttctagtcattagtttgtgtttatggctgggaattgctaatatagccctgtgtggagggagctaacgtctgaatactaaaagagacctatttaccaacagctttatttttttaatttaaagtcaattcaaattgaaatgagccttttaacccttaattaggaccatgtttcttctaaaagtcaaccacattagtcaaccggagacaaaattcactttgcaattgaaaggctgccttctttctttcaacagtagccaccatggtttactaagtgcatttgtttccctttcactatggtaactttacccattccctgtatcagcatagttcaaagtcatcaattacaactgtgacaaaaatgtgttttgtgctttgggaatgaggccaagattctatctggaagctcttccataatgattattcattgtataggtagtgctcataatactccctgtttcatacttgtttccatattatttttcagagctggcagtttgctattttacccccatatgggcccacagtgtttagttcctgttttattgtttccccttcataaatatgaaatcagcaggttcccaaaatatttctaattcatccactacaaattggtattattttggcttccttctattatcttactcatatttttagtatttcttaatagaaaattaacattttgcaaaggccttatctaatttgtttcactgtggcccattctgggtgttttttaaaataagttttggtgtttgctcgataatgcacaagcatgccgtcactaactcggcacttaaacttgaagagctgaagactagattagcaagaaaagggtaaataaaacctaactgcaggctgggcagggtggctcatgcctgtaatcccagaagtttgggaggttgaggcggggagatcactaaggtcaggagttcgagaccagcctgaccagtatggtgaaaccccatctttactaaaaatacaaaaattagttggtgtggtggcatgcgactgtagtcccagctacctgggaggctgagataggagaactgcttgaaccaaggaggcagagcttgcagcaagccaagatcacgctgctaattccagcctgggttacagagcagagcaagactccatctcaaaaagaaaaaaaaaaataaaaaacctcactgcagactaacagaaggcaaatgtgctctcttttcagttgtctttttaatactgtgcttatttttcttgtcattaaaagagaaaatatcttatatttttaaaattagaaataattttgattgatgttatcaaatttgatttttatgtctattcattcccataaaattcacaaacttccaaacattcttcacaatgtaaaatgtgggaaggggatgactatcataacatatagttttattatgttattggttatgatgaaagtataacagggaattatttgtttggcagtcaatgtatatcattcagtccatttgactataaaaccaatatgccctttgaatatacactactctgctagaggaaagcactgcaaaatccatcatttctttttcaagtatatttgttctcagccaggaaagaatttcatttccttgttctgttgccatatggcattttataatttcaatggctaattttaatccttaaagcagtgatgaacatgaagttaatttgttcttttatctccacttagaaagtgttactaatcctacagatttgggcatacagggtattaacattttaaagtgtctaggctaagaagagtctttagagataacttagttaacatctgtcattttttaaatgaggaaattgaagtcctgataagacaactggttgcaaataattcactcactttaaaaattcatctcattcactgctaggtgctggatggtgtgccagatatagggtgcacaaaatgaataggaaataactcctgtctctgtatggctcaggctctaatctgggaatacgtaattacttagggtagaaccttagagttatttatagaagaggaagtcactgtctcaaacacctcattaaagtttgaagatacctgatcagtaaatctaagccaacacctatttaataggaaaagctagatcaaaacatgccatttcccgcttcctagtccagtgcttttcctctaacatgctgaagacaacttgaagtattgggataaaaagaagaaatttcaggaaattgcttagtgaagataacatataagtgacatataaaaacgtatcttgcaactccaattctcaggtgagaagatccatttataaaataaccatgatatgaaactgatctcctttttaaaagctgggattttgacttttattactataagacacaataaatggttgttttcatttctttgggctgctatatcaaaataccataagctggttagtttataaacaatggaaatttatttctccctgttctgaaggctgggaagtccaagatcaaggggccagcatattcggtgtctggtgaagacttatttccgggttcataggtgacacctgctagctgggtcctcagatgatagaagggacaaggcagttctctgggacctcttttataagggcactaatctcattcatgaggactctgccttcatgatctaaacctccccaagatcccacctcctaaaaccaacatattgttcattagatttcaacatatatattttagggaaacacaatcattcacatcatagcaagtgtctaggtcattttaggaaatcgatacatgtttgataaaagtgaaggaatgaattcaaacattatgtgaacaaatacaattcgtagcaaatccaggatgatatctagtaaggcttgagaaggtgctgccttccattttaattgttatcaacttagactcatggatcatcttacttgaatatatcaatataatgttaaagataagagttcctgccacaattaactagtttaaaaatcttcttacaaaatgggagaaagcatctctggagccacataaaaaggtggcaatttgcttccacttgaaagattttaaactattcaatcactctttggttttgctatcctggggttaagatccatgaataatttttccacgtgtttgactgacaagaacatttactactggattacctgagggaagacgtaaatcagaattgtgtcattttggcagcagctttttgatatgtgtgtatctgccttagttaagtattgatttaatagctggtctccactacagacaaccttgactgtatagctggggctttgtattttaaaatttgtctctggataaatcttttttccacccttcttgtctaatctcttttttctttggtattctctaataagttgactgggacttattttcattaacaaaaggaaagaaagcacattaatacatctactttttatttcctacttttattctcttatatgtgcaacctccttcagcctataaaaatgcttaaatgagagaaatgtgtagattgttactcactagttttacattcaaggaaggaaaggagatgttttcaatatacaatcattgtctttgctactataagcaaagataacacacacacacattcacacacaaacatagatgctccttaaagtctttaatactcaggatgattttttgaaggataaagaagacatgacagacagacaggtaattgagcacaagttgatttactgcaagggagagagattgcttattgatgatataaatttaaaaattggcttgttagagaaaaatacatttatagagattgtttctttataaaataataattttatacattctccactcatattctcaaattcattgaacagttttggtggagaattgagatactacttggacaagaaatggaaaatttacttatatgcctcccaaatacagcatgtcactgtcgtcctactcgtgaaattgaaaaattcccactgcccttccaactaaaaggacacttactcatccgcccataccaatgttagacatcaaatagatagcaaatcctagagaaaggctgggtgcagtagcccaagcctgtaaccccagcactttgggaagctgaagggggagaaactcttaaggccaggaattcaatactagccaggtaatatagtgagacctcatctctactaaaagttttaaaaattagccaagcatggtagaatgcacctgttgacccaggctgaggtgggaggattgcttgagcccaggaggtggaggctgtagtgagctgtcatcatgcctctgcactccaacctggacagtagggtgagaagagcaagaccctggctcaaaaaaagaaaaaaaaaaaaagaaaaacaaaaatcctaaatcctagagaaagacatgtacgagagagcattagcctttctgtgatgttttctcacttggaatagatgacaaagtcttgcaatttttaattaaataaaagtttaaatgactatgtttcaatttcatatcaacagtttagaattggtagaaaaataatttgtgttttaaggaagtaatttgctttcaatgattgatttttataaaattaaaagaaagattccttccctgttcaaactataccattgaatttctttgttatcttgggcatgctgtcctttccattggtgcttcaattgtacagtctataaaatacacagactgatacctacaccgataatttcaatagaactttgataagatttaattgagatggtacatataaaagtcctaccaaagaagtaaagacatctacaaaaattaaaatgttattatagaatctagcattttactctgcatatagttgacattaaatgactatctattcattcgtggttaaagcctatcagctagttatcaggtgtcagatgttgcaatgtctgtccctaaactgtgtgtcacttaactttctggacttcagtgacctcagatgtaaaacacacatacagatcaatgtgatttctaaggatcttttagctccattaggctattattctatttaattagcacatctcaactgaatttcctattcatctagtcactcaggtatgccgtctgctacaagtaaaagaaacctaggccacagtgacttaaacaaacagggtattgtctttctgacattataagaaatcttgagattggtggttcctggatcaagtacagaaaacacatcatgctgaatttcttggcctttcactcatgatcacatgtaagctgctgcaattccagccataatgtccataatcaaggctggaataacttggcttcaagttgtatttgtacatcttgttagaaaacaaaaaggtatcacaaatattttaatcggacttctgtgtacatttctttgcccacctttttgtccataactttggccgttcatctctagcttcactggtctaaggaaggaaggatttggctggcttcatctgtgagcaaaatcaggattctgctggcaagaagggagcagagtttgggtattgagtaccaacactacttgccataaaattctatgtaacagtttgtatttttcatgttgatttatttgtatattgaattatgcttcatactggccacttctactatctatgtatgatctttctcaaatggcgctccttctgtggagtctcttccaaccaccaatcacaatgaagtgattgctcagcatgatttgtattaaatgcccgctgcccattttctattgcaagggccctttgggcatgggcagaattagggacatttttgcctttttgggaatcaaagagcccaaacaagaatagatgtttgacaaatatttatttatttatttatttgttgagacggagtctcgctctgtcgcccaggccggactgcagtggcgctatctgggctcactgcaagctccgcctccctggttcccgccattctcctgcctcagcctcccgagtagctgggaccacaggcgcccaccactgtgcccggctaatatttgtatttttagtagggacggggtttcaccgtgttagccaagatggtctcgatctcctgacttttatggtttttacaacatttgttatacaggtattcactaaacactcagtcactttttgtttctattacagatggctatactatacgatacttgaaaagagagtcacataatcacttcctaggtactgcacaaattatcaagattattgatagtatcttgaaggtagctacagttaataaacctaaaagttaagaatgctactcaaactagtcactagactttatccaattatgactaaataataaccctgagataataacagtaaaggatacgtaggcacatatacatacagcttcataaatatttgtcggcctgtggcggtgactcacgcctgtaatcccaggactttgggaggccgaggcgggcggatcacaaggtcaggaggtcgagaccagcctgaccaacatggtgaaactctgtctctactaaaaatacaaaaattagctaggcctggtggcgcacgcctgtaatcccagctacctgggaggctgaggcaggagaatagcttgaatctggaaggcagagattgcagtgagccgagattgtgccactgcactcaagcctaggtgacagagtgagactccatctcaaaaaaaaaaaaaaaaaaaagaaagaaagaaaaattataattgttagggcagtagaattgactatatgtaatggatctcagtgtgacaccaaaagttgttcaatacattggaaattggtcctacagcagccattcttggtaggaactagaaaacagtaagactagattaatgattgctatcattttaagttattccagtagtttattttggcagtgtatttcccttgtcttattttaagaaactttcagtaagaagatagtctaccatggatatattgtatttcttttcagaaacatatttagtgattataaatattgatttgttcacacaggttttactttaatgcaaataatcttctcttcacaatatgaagttaatataagaaaattctagaatgtaatgaccatctatagggcctattctgtatataagttctgtaaatcatcaagtctatttaagttctgtaaatcatcaagtccaaatgtggcactgaaattgagctttagaagttttagaaattattgacttccaaggatcatcttgaatctaaaatttacatcccaaattccttctcaaatgaattactagagacttcttggaattttcactatgattttagttctcaatgtaattataaaaatgcatcaaaagaagtaatgcagcattttgaattttctatcagacaaaatgaaaataatatagtagaggcagttttaggcatatctctgtaaaacagtacatagatgctgaaccctaaattataagctgaaatcaatgttcgataaccagttcaataggcttacaaaaaccattttatgcagagatatggccagaaattaaaaagataacacagttattaaaagagctctcatctagtaacagttcataagtgtattagtttaaataggaactgtatatccctctgtatttcagatatagacaaaggaatatatttaaatctttattttaggccattgccataggaagtaaggaaaagtactgtcaagccagaaaaaaatattgtagctcatgaaaattatttatcaagaatcttaaaaatatacgtgaagccatgatctcttctttcagttgcttacactttgtgggacgaagttgtacccacagagcaattagaaaactagtcaatgttaatatactgcttgctgcagtgcagatagtatacacattgcatcatgttttaaaaagggaattactacatggtgacatggttttgctttattttctccacaaatagtccaatgccaagtaaagctgtgaaaacacaagctggaaatttcatcatacactagtgccaaaataatctaaatcttgtgtgtgtgtttttcttcttaacatttggtgcaaattcaagcatttatgtagaaaaactacagtaggctctgtcatttgcttctgtaaattcttggaggaaaaaacttgatttttatttataataaattcatattcgaacttacttaaatctgttttacatattttcaaaaaaattatcacagacttttaaaagagagtcattttgtttgtagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgtgagtagttttgctgcaacccatgcctccatgtttgttttgttttcttcttgttactgtgctgtttgtttttgttttaaagcatttggcccatttccttctgttgcccgtgtgcaaattgaaagctttctctgcttcactccccatgcttggctcaccacaaatgcaacatttatcacacaaaatgaattaaattttaaagcacttcctgcaacacaaccccctgaaagagagaacattttctgtgtcttgtttagatcctgcattacatatgacaggataggggaggttatagacaggggatttatgtttttacatttctattccctcttgctgtatgttggtcataggtcatagggaaaaaggactaagagttataaaactaatactaaagttttcataactattcacaagggttttgaacatagtgatgagttactttgttagaatttgtgaatgtatccttacctttgagttaaaactccgccattcacagcttggggaagacagtgttcttgaatccatgtgtctataatatcatggatcctctaaggatgaactgaaagttgataataaagaaaggatagttatttacctcattcagttccattgtaaattatctatttcccttgtagtagaaaacagaagtgaggctcattaatctttgttgaactactttgcaggacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctggtgagtacatactagatgcttcttactcttatcatatcacgtctgagtaatggttttgactctgggtggaaaactgggcggaaggaaaaaaagattttatagaaccccaggattttgccttctaacacatttaaacagttatggcacattaaataatttaattcttcaagtgagaataaaccatatttgttaggtgatttttaaactagtttatacccattgtttcccaatttgaaatccttaaatatttgaggctctcagatagtagtagaggggctccttgggggaaacatttttatatttcagagaacttaggcaatgaatcttagctttaaaaaaagttatgcaggatatgaaaaattgtaaatatcttcagcttagttaaaattaggtattcctttgttatttcatacttctaagaagttctgtgtattataactgatagttataaatctctgattgcttaataataactatgtagattacttatggattttacttgtgggattttaattgtgaatctctcaaacatataaatggattatatattacatagaaataatgcccctttgagatataacaatcatttttcaatattgataactgataaatgagtaataaacagttttcttttgtattcaaaatgtcttgtacaaagctaaactgataggtatttgttgtgcttaaattattgctacaaaatgtcagaattaggtatacatcccaagaagctcaattcagagatattattgtcttatttttacacatacacacacacacacacacacacacacacacacacacaaacattggagccaaagggagagggaagagagagacaagatgccactctgattctccagagaactaccgattctccagttctctcccaggtggggtcacctctgagctggttgtcaagattgagtataaactcggcttctgctcttcatttggcttacattatggacatccctctggtccctagtgggaatcaccccttgctctgagaatatcagaatgtgtcctggatgctctaggcaaaaggaaaccagaggtgactaaattatcttatcacctaggtcttctagtagccaaatcatgagccaaaaaaactcaccacattctgtttccatcacctggcttactcagaaaggttagttcaactagtaaagacacagagtaagtgtcatctacaaaagcaagtatgcatcaatatgactctgctggttgttaacattttcatctatttatctactggttaaatgtagttctagctgttcctgcaggttattacagaaatgcctctctactggttaatttctcaaatacactgagtagtcccctaagctcagtatgtcaggtccatctccattctccccatcattcagcaaccaaagggataaatctttgcataagaggggtatacagagcctttggctagcacccgtctttcttgaggggcccctgtcttccccatgccaatggatagatattttaaatataagccatggcagagtccatccatattcaaatatgtatctttctgattctaaatttctctttcgtttccactttgcttctggtctcatatattgatgaaaatcttatatttttacattcctcatgatgataagtaaacttaatttgtggaaaatacatgaattttaaatgaagtgcactgaatcattactttaatcttgctcactgtatctataatttctcccacttggagctagatcccagaccaaccagtatatgctttgctttgcttccgttaatggtatttatactttgtaactaatgatatttaaaagtttataacttaggtttatttaactgtcttctatgggaaaaaatgagtactgcaatactgttgctatatattgcatgattatggcttctcatcttcagctaacacaggaattttaacaaattatgatcatgtggcaaatggttttccggagcgctatatttcaagctgatttactaccttgtttaaaattgtagcatcaatctgtgttacaattatctcttaagtcaaacagaattgtataaaaacaaacaagagctccttatttcctatcttatcattcccctctggctttctgacaatgcatttatcaggaaactaatagttccaaatatacacagtaaatgaatctaggcaaagtggcaaccaagatcaggccaagacattaaaaaataaatgagattgatgctttggccctcccagttacaaatcacagtttaagacagattcagcaaaggtgatagaagttacttaccctagtctctctcccatttaaaaaaaatcactaatgtgtttataatatgcaccaccaggcattttatatatttatttcaggatgtctgtatcattttgtgtgcctggggagatagaggtctttgttctatcttcaaatctccagggtaagatatataagcatgattagaagcaatgccttttctgaagggagtgtttctttgttttcctttatttttgttcttgtgaaggttaatggactggtagccttgaaaaataagctccctaccactggaaggatatggctgtgacagatatgatgccagggtgcttaaaatcctcctagcctctatctttgacgtggatataaaggggaagcatgaatgtgtcccttttaatttagtttgtgagatcgagtttgttgattcttctcttgatgacattgtaaaagcattgtgatgatcaaatgataaggcaccttttaaattgtagaagattatgttgtaaattcggatattagttctcagctctcaatactttcacaaagtatgtcagtgagataagaaagtaggccaccatataaagattgtatctgtgaatccatcagtcaagtaaagaaagaattgcagattacaaaacaaaaatcttcaaacttataacgacataaattgctgctttttgttttctttcacagaatgagtatattcatctttttttttcttctggacaaaaacaatcattccactagtggaatatgcatatctgttcattcttaactgccattatagaatctgccgctttccactattctatagcatataatgatctcagactagaataaggagcactaatagagaatgtatgtggccttggggtttggaggtccacctctactcttattttactacttggatgaactgatatctgagaagctttttcaacatttcatcaagacagcaaagttctgagtaaattgacatttcctccctttaccagtttaccctattggaattcagcatgtgtatgtacaatttctatcaaaaaattggattcattcacatgtgtgaaaatattgcaatagtgtgcattatgcctatataccttcacccagatttctcctagattaataatttattccacgtgctttatccgtcccacccccatctctctttctatgtaaatgttacttatttctgaaccacttgcagatattatgaccttttcctcctgaacacttcagtgacaatttcttttttttttttcttttttttttttatactttaagttttagggtacatgtgcacattgtgcaggttagttacatatgtatacatgtgccgtgctggtgcgctgcacccactaactcgtcatctagcattaggtatatctcccaatgctatctctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagatattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagctcctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgggttcattgtagattctggatattagccctttgtcagatgagtaggttgcgaaaattttctcccattttgtaggttgcctgttcactctgatggtagtttcttttgctgtgcagaagctctttattttaattagatcccatttgtcaattgtggcttttgttgccattgcttttggtgtttagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttgccagcaccatttattaaatagggaatcctttccccattgcttgtttttctcaggtttgtcaaagatcagatagttgtaggtacgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgagggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcactcatgatttggctgtttgtctgttgttggtgtataagaatgcttgtgatttttgcacattgattttgtatcctgagactttgctgaagttgcttatcagcttaaggagattttgggctgagacaatggggttttctagatatacaatcatgtagtctgcaaacagggacaatttgacttcctcttttcctaattgaataccctttatttccttctcctgcctaattgccctggccagaacttccaacactatgttgaataagagtggtgagagagggcatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagagttgttgaattttgtcaaaggctttttctgcatctattgagataatcatgtggtttttgtctttggctctatttatatgctggattacatttattgatttgtgtatattggaccagccttgcatcccagggatgaagcccacttgatcatggtggataagctttttgatgtgctgctggattcgatttgccagtattttattgaggatttttgcatcaatgttcatcaaggatattggtctaaaattctcttttttggttgtatctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattgatctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctctcaaaaaaccagctcctggattcattgattttttgaatggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgtcgtgtctttgttcttgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcttccatccttttattttgagcctatgtgtgtctctgcccatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcagctggtaccagttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttgagaatgttgaatattggcccccactctcttctggcttgtagggtttctgccgagagatccgctgttagtctgatgggcttccctttgagggtaacctgacctttctctctggctgcccttaacattttttccttcatttcaactttggtgaatctgataattatgtgtcttggagttgctcttctcgaggagtatctttgtggcattctctgtatttcctgaatgtgaacgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccatcactgataccctttcttccagttgatcacatcgtctcctgaggcttctgcattcttcacgtagttctcaagccttggttttcagcttcatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccattgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctgtctgtttgttagttttccttctaacagacaggaccctcagctgcaggtctgttggaataccctgccttgtgaggtgtcagtgtgcccctgctgggggatgcttcccagttaggctgctcgggggtcaggggtcagggacccacttgaggaggcagtctgccggttctcagatctccagctgcgtgttgggagaaccactgctctcttcaaagctgtcaaacagggacatttaagtctgcagaggttactgctgtctttttgtttgtctttgccctgcccccagaggtggagcctacagtggcaggcaggactccttgaactgtggtgggctccacccagttcgagcttccccgctgctttgtttacctaagcaagcctgggcaatggcgggcgcccctcccccagcctcgctgctgccttgcagtttgatctcagactgctgtgctagcaatcagcgagattccgtgggcgtaggaccctctgagccaggtgtgggatatagtctcgtggtgcgctgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctgagtctccatatattccagtgacaatttcttaaaaacaataatgcttttacatagtctcaatatatttattaaaatcaagacattagcattgttctatactataatctcatctgaagatactagtcaacttttgttcattgtttcactcatatccaaatggcaaaaacaaattgatgttctgtttacctccagtttctatttataataataacatatactgatataatatagttcccatccataaaaataaataagtaattttctgtaaattcaaggcagatgcaaaaaaaaaaaaaaaagtggagaaggaagaagaccaacacttattgataggactttccaggtgctggatatgatgcagggaatttcagagttgccattccattcaaaaatgatcagcaaattatgatatttaaaagagagaacgtgacttcattttatgtagattttcgatagaaggtgcactaatttatgtaaaggaaaagatctttgaggctgttagctataatgaaggaattcctatcctctgctttagacagaatgacctctattatctacttaatttgatgatcaaagacaacctccttcttttccccttagataaacgccttcctttcttctggctgaaaattgccatccattacatgaagggattaaactggaaatccaataattatttttgtttttaatttattttttggcattctgggactataattcaaaatgttgtcactaatataattttaaacaattaattatttttgacctttaagaccacctatggactcacttactataaaaaacgtttataggctttctcgttcatggttttatggccttttatttcacagaataaagcaatagtatccattcgttaagaaaagtaaatatctttaataaatgttaaataaacaagatatacttaaaaaaagaactgtaaaatattagagccctttgactaaatttagaatccacactaggctaggtgtggtggctcatgtctgtaattccagcactttgggaggccgaagcgggtggatcacttgaggtcaggaattcaagaccagcctggtcaacatggtgaaaccctgtctctacaaaaatacaaaaattagccaggcatgatggcaggtgcctgtaattccagctacacgggaggctgaggcaggagaattgcttgaacccaggaggcggaggttgcagtgagctgagatggcaccattgcactccagcctgggcgacagagcaagactctgtctcaaaaaaaaaaaaaaaaaaaaaggaaaaagaaagaaagaaagaatccacagtatttttttgcatttgataaagaaaatatttctaagttttctgtagtttcattctggaatatgtttcctctagccaccttatttttcttttggaacttagtgtatgtagatatgacaaagaaataactcatgttgaagatatcagtcaggcttcagcatttctgaagaagcaaacattttaaaataaaggtagaataaatgcttagctgaatctgccattaaactatggccacctattggtatagtccctatagaactgtatgttgccgtgtaattatactccttggaagtaaattaaacaccaaaaggatctacatgaattctttcagaacatgaaggtagacatttttcagcgccaatgtagcgaatcggaaactgtaaacataatgaaaatcacctaacaaaataatgaacatcatatgactttagtaatgttctatgatgcatccttctctttgtttcattttatgattaatgaaacctaaaaatcaaagtcttaacattttgtttatctcaacaaacaaatgacgtctgaatttggccctgagagtataagtggttatatacattatgattttcacagtacatcatgcttgactggcaattcagcttcttcctgttttgaaatcaaggcagatacctgtgcatctgggaatgtcactgtgcagtgatgtgtcatagtgtggccaagccttccacatcatttaacacattaatgatgcctctcagccatcacaccctggtatggaggcacattgcgtaactgtagaatgagcaataagctgtagcaaaagcaaaaaccatatattgtcctgacagttattcaaaacccttatatgagcttagaggccataacaaaatggaacatgagctaaggaagacagttggagagcttcatgaatctaaactgaattttcattccgtcttcatttctggttttatatacgactctaattaatggagaagacatgtacgtggaagggtatgattacaactttcattcaagagttttcactagaaaaagaatattaataaccagttagaggagtaaatatagtgttaactaaagcacatggaaattaagaaagaattagacttttgatgctaacttgttgtatgttaactatattcccccaagggcaaaaaatatttaattcacagaaagttttctcatccttattttccaaggagaacatttttagtctcaaatcacaataaaatcatattttatactttaaatgtgttctacctccctaaagttaactgaaatatagtccttaggatataatagcatcgtatgtgagtaattgagaaatttaataaatgcaagtatttagaaagaaagaaaatgttctgtttccaaaagcagatatattactaccactggcaaaactctttcataataaattcttaattatatttcagcatctcccaaagtgttatctcagtgtgaataaccatcatacagctcagcattctgactttataatcctatcaatatagtaccagtgttcaaatagaaaaaaaaaatacatccctttcttaagtgactttatagatatctatcaggaaattattgcaataagtatccaaattacaaagactatgactatgaggtatggcacccctataagcaggggccctgacattctataccattcgcaccaaagtaaaagaatgccaaggccaaagaggtgagaagttcatattttctgctcctttttattattattaattgctgacctaactcttcttgacatgattagcactgcactccagtcctttatgtaattatcttattcaatcttacaacaattttatatggctataagtgaataagtgtcttgtccatggccgcacaactccagagcccctatctacatattctttttcctatgggttgcaaaggagaggctttgcacaaaatctaagtaaggctgaagaaagaaatatataaagatggttattttattatagtaaaatcttgactgcctggtacacaggtggtgtgatttcttctttgaaatcaaaatttcacatgattgtatttactcttaatcaatgctaattcaaaagcaccctcttgacaattcatcatccagaaataacctcttactcctttcccttttcatttcaattggaaaaaaaataattataacaaattgacaaaaaaaaaaaatctgtctctggtcacaagtttttcctaggaaatagctttaaaggcaaggccatgtgcctgagtaagaagagttctggaatgtgtgtccaaagaggtaaatattcatcttgatcccactccaattgggcctcagagtaggtcagaactattgctttatctttctgtgaaatgtaacatttggactagaccatttctaagtttctttccaattatatattctaggaaactaagttaatgcacattgtatcatgtacttaagaaaaaataatccactgtttataagtgaagcaaatatgccttgggaaaaaaaggtatttgaaaaacaaagtggaacaggacagtagcaaaagtccaattgtaaattcaggtactgtcacttaataatgaagtgactattttttgtatttttaaatttggtttgtttatgcattcatttgcaattttgtttagaaatgaatttaagggagttattggactaaacttactggcatctttgtatcctttttgattattggtacagtaagtcctacacatagattgttgtgaggagtaaataaaatgagagagcatttgtgactgggaaagggcttgaataagttgtgctctgtctccataatgatcatgcagatcttcccgtgtctgggggaaatagaaactcttttttttttaattaaaaatgtgaataaatatatatatattttttattttattattattatactttaagttttagggtacatgtgaacaatgtgcagattagttacatatgtatacatgtgtcatgctggtgtgctgcacccattaactcttcatttagcattaggtacttctcctaaagctatcccttccccctccccccaccccacaacagtccccagagtgtgatgttccccttcctgtgtccatgtgttctcattgttcaattctcacctatgagtgagaatatacagtgtttggttttttgttcttgcgatagtttactgagaatgatgatttccaatttcatccatgtccctacagaggacatgaactcatcattttttatggctgcatagtattccatggtgtatatgtgccacattttcttaatctagtctatcattgttggacatttgggttggttccaagtctttgctattgtgaatagtgctgcaataaacataggtgtgcatgtgtctttatagcagcatgatttatagtcctttgggtatatacccagtaatggaatggctgggtcaaatggtatttctagttctagatccctgaagaatcgccacactgacttccacaatgtttggactagtttacagtcccaccaacagtgtaaaagtgttcctatttctccacatcctctccagcacctgttgtttcctgactttttaatgattgccattctagtaagatcaaattctgatacatttctttggtgtgattggcttaggccccaagtttttttcaaaatcgcaattcatatctataatgcgtgacaatcctcaatgtaataggtcattctcgtgttgttcgttgcacacatatacatatgtatatataatgtatgtatatccattgattctgtgccatcactgaggtgccctacataggatgtaatggaaatgactgattgaaagttatatatattggcctatatctcttagttgggctagaacaagaaccaaaggcacacataaaataagaaattgataagactaataaaaggacaaccaacactttgggcagccgaggcgggcagatcaggaagtcaggagatcaaaaccatcatgggaaacatggtgaaaccctgtctctactgaaaatacaaaaattagctgggtgtggtcgttggttgtgcatctgtaatcccagctactcggaaggctgaggcaggagaatactttgaacctgggaggtgtaggttgcagtgagccgagactgcaccactgcactccagcctggtgaaagagtgagaccctgtctcaaaaaaaaaaaaaaaaaaaaaaaaaaaaaagcacaatcaagcaaagatatcggcaaagagtaaagaaaagagacggtgatacgggaagaaaccaggtggcaacaaatgttctaataatcattctggataaagagttagaagaatacactttaccaaggcccaggttgtgacaggagacaaagattttacaactacttaggaaatgctcactttttaatttttaatcactagactgttagtggttgactttttctacaagtttattttaatagattcactgtaattccaagatgagaatgtcagatgaccccaaaattaattgtgcataccatagatattttaaagaaagaaaatttttgcatctttacttttatttgtttagcttatcacgctatttgaatatactttgtgggcaaagttcgtctatctttgtccacctaaggagggcaattgggtatatatcctctaaaatgaagtacatgttatggatatttatacagattttcaacatatcaaagaataacattctctatttctgtttcaagtagtaaagcttgttttatttctcttctattgaaatgatttcaaaaggtttttcatagttgatatctgggatacattgcctactgttccattaactcccagttaaaataaaacaactaggctaagaacatagcatgcttttctcttggtttgaattgatatagtaaaaaacttcagtttaatttgacatttttatatctgaaaagtttgaaaaaaatcccatccatcttccctgaggtatgtttccattctaagctgcttttacaaattcttattattgcagatataagatagatgtccttattaaaatcctaatataaaatggctagaagaagaactaggttttacaactattcatatgtgtatgtgtttatatttgtatattcatgtgcgtgtgtatatatgtacatgtataaattaggaatgtaaagatctagaaataataaagttatagaaagtatatggagtctaacagatatgaaagaagagagacttttttttactaaaatatttgaacaggatagtctttttcttaaccatctcatctgttaaataagggttatggctacattgagatattgtgaagtcaagaaaaaagcatatataataccttgtgtggtgctggctgcttattaagtgatcaatacttggtagttaatatctttcataaacatttggaacatttagcagtaaatgtggtctaaaaaaaaacccatttagataactccaggttttctttggcaataaataacacactcaattacttgcctttttctgttcccaaagcattgactaagcccttagtatgagccagttactatactggatctactgggataaaatgatgattaagatgtagtcactactttcaaggagctctcaatttaggacatcttaaaggtttcatgaatacagcatgaagttgattggtttggccaagaaaagacaggcaaagccagctgccaagagaattcaaaaagcatcaacagctcaatgaagccccccagtgaaagagattggtcttgaattcacagattatatgacattaagtataatagttttatctttttttcattactaaagcagaggaaaaaaagaaaaacctactgattacacatgatgctaaaaaactcgcatgctgtcccaaagtttttcactaaagagaaggaaagtaaatgaaatgctttaagttatgtacaaattcgatgataattgcatgtgtattttaatgatctctcaaatgcatgtatctggtttatgaaagcacatagaatatgtgaacttataacaatgggacaagagcaaatgtttaaagttgtgcagtaaaactcaccacattaatctgacttatttgtctatctgtccatttacttacctatttgattaagcttattgttattagtttggaattaaatattctagttaaatagacagttaccacataaagtatataaaactagaatgcattaaaatataatcaacagtaattagtatgaaagtgactccttatttcagataaagacaatgtctaaagtttagaaatgtttagaataatcattttaattatgaattataattgttttgaagatacctggccagaatttgacactaacataatagtaagtcaggttttactagtttgctaatatttgttaagacatacatgtttacaaaccttgcctatttgtgaaagttaaaagatattgctttctctgtatgaaaagtaaaaacgattaaaatgagtttcaaaaaagatataaaggaaaaatccactattttatctatgttaatctacatgcacactttgttgagaagtaagaatttagctgtcttgttgggtagtacttaaggagattttataatttatgtacatttcacatgtaatactggtatttacacactatttgctgtattttttagcactgtatgatgttttttaaattgtgatacattttcagataatatatattcctctactatcagtagccatttcttctttagatgaactggcaaacattatatattgtgtgtgtgtgtgtatatacgttatatattgtgtgtgtgtatatatatatacatacatatatacacatatatacacatatatacacatatatacacacatatatatacatatatatacatatatacacatatatatacatatatatacatatatatatacatatatatatatgcatatctttggattgttgcagtggcctgagggaattgttgcccacattcaaaatcagaatatttattatttaaactaacaaccaatactgtactgtactgtactgggcattttcgagatatcatttaagccttaaatcaaccctgtaatggagacattattacccttatttttagaagaaacttatcaagagtttgccagtcctatttatctaactcaagttgctagggagaatttgaacctagatctttccagtgcaccaataatttccaaatttcagtaaacaacttactgcttttaggaattttgcttcatccatatgccaccaggactcctacaacataatgtgcttaaatcaagcctctcttttttttggttttgttttgctctgaaatgtgaaaacagtttgctcctataaatagaaaactaatgttacttgccaaaaatttatgactaattagataataattgcttgtccacataacacctaaaattctttcaccaaacaccatgagtaaacttggagcactatgagtaatctgctgattcctatcaacactacctcactggcaattgcttataaggatcactaaaccacaggccatcccatttcagctaactgcaactctatgcttttagttatttcagtcaaagctgttggagtcatttggcgcttctctttctctcaaactgtatatctacatcagcatagtctatacaacatgccttcaacatatcacaagaatctcaccacttcttacaagatccattgctaccaccctagtagcatcatcttccccagattatcgaaaatgctcccaactgcatttcttttttcacccttgccttgagaacacatggacacagggaggggaacatgaaaaacaagcctcttataactatactcatgtttattattatttattttattgcataaattagcaatgtttgcagttttttaaattatgtcataactaatcaaatttcctgtgtaatttcaaatatttaattcacttctcatgtattatttccaaggtgactggcattactttttaattgaccaatgacaaaatttaacactcacttctcatatgaacagataggtttgtttaaaaaatggcttaggcaggaattgctagtgaacatgtgcccttaaatgctaactcacaattatggcaacttactgagtcaatggtttgggcacttggcaagtctttcttcagttaacatcttgcatataaaatattcattttcagaattttacctagagtgcacatatggtttttcaactcaaaagactacactaaaacaattggaaaaaagatgccattagtgttgcccaaggtacagagaaggccttcttgtatcctttgcctttctttggaaataaagacctatgaattcctaatctatactttttgttaagatccctttttaaagggtgtcatgtgtagcctaagatatagcttgaaagttgatatgagtggtgctttgtgacagaaccacagatgttcagtacatgatatatttattttttaccccagtggcccttataaaaagggctagaaaatcagcttataacaagccaactaatgacatgatatagagaggcccctggttcaatgactgttagtacagctgtgtcccattacatattagatacctagaacatacttgcattctgaatggcatttatcttttgaatttcaaacattcctaccataaataaggattttatgcttttcacaaatgtttcacagtttagtctagggaatactgaaaggttgcttttacttaatgaaatttaccctttaaagtttcctggagctaagacgaacattttctgagcgctcacctcaacagacctgcctcactctcctctatgcccattctctgctatccccttagcctggagaggtgataataacttgagtttcacaaaaccaacagtgtggggaccacatgagagctggcttttgatcatggtttaataattccctctttgttacttctccctaataagaggtatctgagtctaacatagaattgctacacttgtgctgtgggaaaagcaatatttttatatgtattttgtttgcaaaatgcacactatgtctaaaaattactttaagtgaaaatattttcacaaccccctcaaggtcctgattataatttgaaggtaataaagactcatacttctaaagtagagtagtatgacaccttaagaaatgttatgtgagatgacctcacttctgaaataatgtttcagaattgtttcgttttaaataagtgtgatggtccatctcatcttcttcaagcgcaagtagctgctattaatccagaagatcttcatttctttttgggttgaacatatctgctatcttgaggaatgaaccatgaaaaagaaggaaagtcatttcttgtgattcaggcaggaactcagtcattttccttttgtccttcaaataattgttgaaatggtgggagattagcctagatagtgactgctgcagtaacaactgctgcctagaagtgagctttattccacctccatgtaaagaaagcagctgtctttctattgcagttggcgccaggcagctgcttttactttctgtatttctttatagagcccttcgtcttaaatgcagtcacctgcacacagcctacactttttttagtcacaaaggctgcaacaagaaagcttcatatgactcctgtaatgagcaatgcagaaagtaatatggaaagatgttccttgagcattgtataaggagtgtactgggtggacgttgggagatggggcaagggagaaggagtttaacatgtgtgattgggtgtttgtgaaaagcaccagattgtcagatggcaggatgtgtacaacatgggatgagtggcaggaaaggctccagtggtcagttcttgtcctgcacaaaaaattcacagcacaatgagaaccaaagatatctccaataaatgaagttttacttcttcccagttaaaagaaaatattctcattgaccaaggttatatttactaactcaaactaagattatagtctggtgtatgtttcaatctcctctttcctcctagagttttactaaagaagatttatgcaaacccaaactgtgataagatttgtaagatgattgactgtggcaccaaagaaaattactcttatcatttcatcttatataaagctaggtatctatctactctctttttaaacataggttttggtttcatgcatagatttgcaaagtcatttttcaattatattagtccacatattaatgaagtttctccagagaagcagaaccaatagactgtgtgtatctatctatccattgagagagagatagagagggggcagggaaagaatacaccaatagactgtgtgtatttatctgtctattgagagagagatagcgagggggcaggagacagagagagagtgagagagagagagtttaaggaataggctcatgtgattgtggaggctgccaaatccacagactgcagggtaagctgataggctggaaacctagggaacagctgacattgcagcttgagtctgaatgcactctgaagctaggattcccttggtcttaagggttctctattttttctcttaaggccttcaacggactgaatgaggcccacacacattattggagtacaatctgctttactcaaaagtgtgccgatttaaatgttaatatcatctgaaaaacaccttcacagtgaccccagactggtgtttgaccaaatatctgagtaccatggcatagctaagttgacatataaatttaaccatcatagtcagtggtgtgtgtgcgtgtgtgtgtgtgtgtgcatgcacatgattgctgtttctcttttgagttaatttctagactatatttttaaaagaaatgtcaagataaattgatataaagaaaatactaatcttttaatttcacccactgaccatattggaattctcttttaatggatcttcattcttccttgagagtctttttttaggtttttcttggaagacaatgcccagtgcatcagaaagtgtcccctcccctattcctatctcaaatatattcagtttgaaaatctcacttggatgaccacttatcaatagcaatgtaaactgacaaactgctttgtggaaaaggcacactataggttttttttattggtaaatattttcatgtcaacattacccttttggagatcaccttcttatgtgccttctgtgcatagaatttcaggaatagtgtcaggcctaataagacagtcttcactacactgtttccctttaccgacctttgagagtcatccctattttcaggacagtgctgtggctgctattagcaccacttgagggcttgttaatcatctttgggtactgctattgatgaaaactctcagctcagtgatttttgaaaccagaattgcttaaaatatcattcagaggcctttcagaacaccagtatttacctactccaagccaatcctacagatgcagagtctctgaaaataagcatagggatccctagtagcacatgcatttttaaatcactctacagatgaatctggtcaacaagcacttgggaagttcttaggaagaaaaactctttcccagttgcaaggctgcagacaggcagaaaatttatagctccttcacattacagtttgtgcttccatgaactgcctggcctgaggccatgcaaattgaacttgcagaaagagaagttggataaacccttgttaaaaaaccagatatatttatactaatattatcttggcctcaaaaaggcaacacttgtttttctagattttatgcaaatttaagatattgtcattatcttctcaatatcctctaaatgtctttaattctaaagaattatgttaaacctgctgaagagtaatgctgagatggccaatcagtgtaatacagagattgtacttaaaactgttcattaactaatactgagttatcttttcttctgcattttcatcactccttgctacttttcaaagatttccttaatatttgttttataaagtgactttacttcctaacaatgaaatttaattattcaacttaattccaacaatatttgttgcatactgttatgtgaccaacactgtgctgtatgttgtggtgagagataatgataattgatacctactttctaccctcgatgaatttataattacctcaacatttatttaactaaatatagtttgtgcaaagaaaacacaccataataaagaaaaagaatgattattctctgtctgagaatagagaaaggttttcttgaagaggtggggtttgaggtggacaataaaaggtaaagaagggtttaacaggagccagcatgttgaagactggaaaaaggaataaagaggttgggaagataattgtcccctcagatatagcctttcagctgaggcagagtagaggggaagactgaaagggcaatggtggatggaatggtggcttaaggtctacaatcttttggggggattttgttagtccgctggagtggacacacacttacatttccaaacatatttagtcatagatacaaaacataatgcaaataaaggggctacaggcataagagcagatacaacatagcttttcaccttggtttgattttccacagggcaacacttgactgtctgtgcagcaagggccctgccagacttggaaacatagactaatgttgctgcaccattgcttgttagtactcagttctgtgtcaagaattccagaaaaaataacaccaagaaattgtgttcatcaatttaagggactattcacacacattgacttccttttggttcctgaacctacttagcatcaacaataccaacaagtagagaggaatagaggacaaagcggtatgactgtcctcatgtccttgaatagggtctctgcctccactttcccttgaaacagaaagcccatttccctgcagagcctgccatgcaatttcttcacctgggcagaaatgcatgggtattttttcttcattttataggtagcggtgcttgtgtatgatatagatggtttgggatgggatggtttagcagaaatgcttcttgatttttgtgtagaaaagtgacacaatcaggcctatgacttagaaaaataaatgaagatgcaaggaaaacaaaccagttgacacactaatgatagcccaaatgagagattataaaggtctgaaataaacctggggaaatgagggagatgacctttcagagattaaaaccagaataattaaaaccatgaccagttctgtgtcatgcatttgggaaaaaaacagaaccaatacattcatcagtttaagggaatatttacacatattgagttccttttggttccagaaccaactcagcatcaacaataccaacaggcagaggggaatagaggataaattgaccagaattgaataaaggagcaaggggggagttgtagctcactcaaacatgagaataatttaaacacatgtggaagaaaggatgataataccattgatcaagatcaaaaacatgaacgcataataagataatatacagcattttagaattgatgaaattaaggcaaaaaacaggtattctatgcgggtggttgtacaaagtaagcaattgaccactaagatctgattcttgagaaagatcttaaatataatttgtatatttgaaagccatgaaagttgaagagaaaaagtgtagataatagagcatggaatttaattttaaaatagcatcaaggaaaagatcttgagaacagcaatggatacctgctgagtatagacggagtcagctttggaatcaaagcccagactttaactgggaaacagttatctacaaagtcatttatgaaatcttactctgtttttgccctctcacttagtcctcctcaaggaatataagcctaatgagggtggggaattgttgttcactttgttcattagtatgtattttgttcattttgttcattagatgtgtttcctcagcaactaaaatgtattggatatttttaaaaattctatcaaatgaagatgtagccagttagcatgtcccatagattccaccagcacaaactctcttctatttctataacattcttcctatcttcacttgatattactaacttcaggttctcatcaaccctcatcttgattattacagtagccactagtctgcagttgcgtttccacctcatctgttttacaaagtaccttaatccaagtgctttactgtgacttacaaagctctccatgaactgtttaaagactacctgccaattaatacctttccactttatgctccatgaatacattttcttgtaaacttgcataaactcgctacaggttcatgccttttaaaatctatttatatacacgtatggaaatttcaactatttcccttctttacctgttcatttctcatctctcaaaagtcagttcttgagtcacttcctgcaggatgtttcccatttcttcactagagtgagctggcctcccgtgtacccacataggaatcagtttctagctctgtcactgctcttataggtgaagtgactcctcaaaggcagggacctagctttatccatgtttgctgaactcttgataaaatcattgtcagattaatcacattagcatatagtttcaatcacataacttagctcctttaaatagtggcttccattacagaggagaaaaaaacaaaaacaaaaaaaaacttcttagcctcgaaattaagattcctcttatgtggcatcacacaaatttccaatcataatttcctttactccttgttacaaagatagatatatctccttcctattctccaggatattttgaaaatttggtaaccttcacctaaaatacaattattctatatgcatgtgtttaaaattttttaattctgcaagactcagactaagtgccagcactttgttaatttttctctaattcttctcagctggaaatagttgtccttttatcacaactcccatagggctacagaatcgtttatctgtatttctcttatggtgctcctctgttctaatttgtattagaatgctacttcatatgcatttaatctttcttactgcactctaggttccttgagggcgtgaccaaggcatggctcacatttgtctccttcatagtggctaacttgggccttatccaataggcatttttatatacattttaagtgagagagctgtaagaagaagaagagctgagcagaagatttcagtcctagtggtttcatataattagatcagaatactaaagtgtgtgctgttggtagttgtggaggtatggggttttttaaaaaaattattattttaagagaaaactgagtgaaatttgggggcagaatttagatcataagtgttagagtacattatttaaagcaatcttcattaattaaaaaaagacaaagcagaactataaggtagtatattagttagggcactccagaaaaacagaaccagtgggttatgtagagatatgtaagaggagatttatgatgggaatttgtttgcataattatggaggccagaaagttccacaatctgttgcctgggagctagagaaatagaaaagactgatacaattcagtctgaggccaaaggcttatgaaccaggggagtcaatagtataacttccagtatgaagtccaaggcctgaaaactggagggtctgatattgtaattcttagaattagcagacccaagaagctggatcttcaatatctgaggtcaggaaaagatagatttcccagctcatgaagagagagcaagttcactgccctctgccttgttctatttaggccttcaatgggttggatgatgcccacccaccttagtgagggtagatcttctttactcaatccatctattaaaatgcccgtatcttctagaaacacccccatagattcacccagaaaaaacaaaaaacaaaaaacaaaaaacgcttcaccagcagtatgagcatcccttagcccagtcaaattgacacataaaattaaccttcatagttagcaaccattaattttccagtttttcaatgtggaaaactgaggcaaggatgtgaagtaagatgcctagttcacactggtgttgctgactcacaatttgaactcaagtaatctgacagctgtgcccacattcttagtcatcgttttctctgctattgaagcgtgtcatggaagggaagaagaatatgaattagcaactcaatgacaagagagactgggtttcttgagaactcaaggaatggtaagaaggaatggaaacaacaaaaaaagagcccgcatcaccaagtcaatcctaagccaaaagaacaaagctggagccatcaggctacctgacttcaaaatatactacaaggctatagtaaccaaaacagcatggtactggtaccaaaacagagatatagatcaatggaacagaacagagccctcagaaataatgccacgtatctacaactatctgatctttgacaaacctgagaaaaacaagcaatggggaaaggattccctatttaataaatggtgctgggaaaactggctagccatatgtagaaagctgaaactggatcccttccttacacaactaatttatacaaaaattaattcaagatggattaaagacttaaatgttagacctaaaaccataaaaaccctagaagaaaacctaggcattaccattcaggacataggcatgggcaaggacttcatgtctaaatcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggaaaaggacatgaacagacacttctcaaaagaagacatttatgcagccaaaaaacacatgaaaaaatgctcaccatcactggccatcagagaaatgcaaatcaaaaccacaatcagataccatctcacaccaattagaatggcaatcattaaaaagtcaggaaacagcaggtgctggagaggatgtggagaaataggaacacttttacaatgttggtgggactgtaaactagttcaaccattgtggaagtcagtgtggcgattcctcagggatctagaactagaaataccatttgacccagccattccattactgggtatatacccaaaggactataagtcatgctgctataaagacacatgcacacctatgtttattgcaacaatattcaccatagcaaagacttggaatcaacccaaatgtccaacaatgatagactggattaagaaaatgtggcacatatacaccatggaatactatgcagccataaaaaatgatgagttcatgtcctttttagggacatggatgaaattggaaatcatcattctcagtaaactatcgcaaggacaaaaaaccaaacaccgcatgttctcactcataggtgggaattgaacaatgagaacacatggacacaggaaggggaacatcatactctggggactgttgtggggtgggaggaggggggagggatagcattaggagatatacttaatgctaaatgacgagttgattggtgcagcacaccagcatggcacatgtatacatatgtaactaacctgcacattgtacacatgtaccctaaaacttaaagtataataataattaaaaaaataacaaaatacattagttgtatatagacaaaaaaataaaataaaataaaaaaagaaggaatgcaaacaacaaagtagaaatgaataaggaagtctctttctctcaacattgagaaaaacaggaagaaagtataggagaaactaaaaagtcaaattacctgaaacaggttgtgaagtgaattgggcaaagtgttaagaagttgctaagacttgaaataaaacagtacagtagcccctcaaactggtactgcagtttttcatcttttctgtgcacctagacaaaacatctacattttggtaatggatataaagtaagaaaataaaagaactaccaaggaatttttaaagtgaatatggaaattttattatatctgctcttaaatggtatgaaaataaatatttcaaggtagtcaggttctctgggaaatcagctttgtatagtcattatagatttgtgtttaaaaaattctttatattagttattcatatatttgtttgtttgttttcattccagtgattatttttatttaaacttgtttttggctgatgattttgagacattataatttgtaccaatgactacagttaccataaaattctacttgagcacatttaaacaaaaacatcttttatctgttctcatatctttaagtttccctggaagattactctctttactcatttaatgaacatgcccttaactatcgtcgacattttggtacctattgtgcaggaatcttttcattctgggtccacttctatcaggtaaactgaagaagagatgatacaaggtaagatagataaaagataagataagaaatgataggacaagataatgtgtgggctggtttatttgtattccttataaggagatttgtagagtttctctctcaaagtactgactgtcagccagggccacctccagttcagtaatacacaactgtaccgtgtggcacatttagattgtttaagggaagtctgttaatgggaagagttttgctagtttgtcttcctctacttggtttattgtacaaggcacagtgatacacatacacacacacacacacacacaacacacacacacatatgtgtatgactgagattgacaagtagcaaagttttaagactggataatttattatatggaaatctttcatatcctagtcaacactgcttgcctatattgaagagaaacagtttctaaatgactcaacatttgaagagttactagaataagtctggagtgggctttactctcaaaccagttgtttctgtagggcaattctctatgattaacttccagcctagggagttatctaaaagctttcttcaattaaaaaaaaaaataaaaccattttagcagagagagggaggaaagaaaaaaaatgtcaccacaagtttaagtttctgcataactgatcatcaatctggtctgaaacattccgataaaattggcattgacatttgcccatcttggaatctatggattgatccatctgaaggttttggaaccagtcagcctcagtgggatgtactgacaagaaggtagggtatctcaagacaggacatcctaggacaactcatagcttcactagtcatgacctagtattgaagaggcttcatatacaaatttaaggcttaaagactttatagtgtgatggagactattggttacttctagcagcaaccccctcaccctcatacttaggttcaagcctttatattccaagatatttttaaaaacacagcagcttttattcatatatagcacagactttttattccttctaattgaaaaaaaaaaactttgcaatttgcaattggcatatgtgccacttctaggaatgctcttaaccacttcatcagacttggcactgtctggatgttggttttgattgccaacctatgaaagagaaaggaaatcacaaaagagaaaattaacaagtgagcacagttccaaaatttgttcgacaaatgtgttttaaatcaaatgaatcatcctttggcacaagctattcactttatagtcattcatttgaacagcttagtctctgtctcctacagactgtggttaacattattcttgatgaatgagacagttaccttaaaacataaataaaacaaatagaataacttaacatctgactctcaaaggaaggtatgttatcttaccttgcactagtaatatattttaaataaaagtattcagaaaatcagctaaaaccacaaaagaaccaaggatatgtctacatagaactgctgcatgaaaaaagtagtttgatcaaatacatatatcttgattaagaaaatatgtgacccttccaaatattttatcagttttcttttctagtctttcactccataaaagtagtttccattcttattatttttacttactaatttaattaaaagtctctggcacaaaatagttttcacgccatagagtattgtacttattgctgaaatcaacattttaaaattaatttcaagtctttgcaagggcaaagacttacaaaagtaaataattatgtaaatcttaacctgtaagataatctttttttcttgttgttttttgtcatcccatttaatctttacttttaaagaaattatattgctaatttaaaatttcctccagccactttttgaactgaatccttaggcaagataacaaccttttaaatgtgtagaacattttttcttatttatgtaggctttatatagataactttgcatatatttctgcatcattttccaacatccatcttacctcacaaaacaaaaccctggtgtaataattgtgaaatggcaatgttatttcagaaaattcttttagcagcaaatgggaacttagagagtcagaaacagaaaagatttctgtgtaagcccactggtctcattcctatgtgacaggtgtctctgttggtgaagtctgctagtcagtgggaaaccaggatatcatcaccctgctgtgaatgagtctctcccagagggaactcacttatctgcctctgtctctgactcctactagactctaattctcactcaccatgagaattgacaggaaagatctattcagagatgtatttcacttcactttccatcctggatcaggcttctatttgtgggtttgttcaacatattatattaacatagaactaaattgcattttataaggctttgagatgtagaggataaggtcgatgtcattacatggttttattcattctaagtactagaatttaactctaagggtcaaatagagtccatttggtctgattactatgagataggtgctattcaatactatatataataaatatcagcttttattaagacaacaaaaggatttgttaaaaatgagtttccgaactaaaatttcaaatatgtacaattatacactctccacacacacacatactcagaaatatagtcatatataaaatgttcagtaagatattttcttgttgcttgggaattggcaactagaataaaaaagtcaggcaaaaatacaccaagtataccacatacaaaagagaactgcaaacagttggagccagacacatcttgaggcatttttaagaggaattaaatgggtccttgccatgtagatttttgcagaatcatctgaaaacgtcatgagtgcctacagaaagctagcacacaatagtaaaagtcagtattagtcaagaaaacagtggaagtcaacaaatacagtgcaaatgtgtgcacagctaagtataacctctattttccaccatctctccacagtcctccaacattggaaaagggaaggaagatgtaaatgagctgacttttttcctcttccacccatgaaattgctgttttatactgttatacactgggcattaataaccaaaagtgaagagcaggctatgagatattacagcaatttcatcaaagaacaagaacttgaggttcaacagatcagagggtctctgttctctgtatttcactttttagaaaaatcccattggtctggtctgcattaggatgtctgctgcttgtttgagggccaattgtcatgatacatctcagctatttcttggtcatttggaatgaccaagtaatgaagtagctcttattttctaacctgagaatgccacattccgagcacataacagaataaaaaactaaatttttggttcagaatagccacccaacttagagtagacagaaaaatagagacttcattgaaaaaaagtaatgccactaaacctctatataacaccacaaactatccttcattccactatagcaactgtaggtcctgttaatcaaataattttcaatattatctgtatcacagcttacaactcaatttcacaattcaagaataagtttgaggcatcgacgttgctggggtagagatatatttgtgtatgtgtgtgtgttagctctgtgtattcatatgcttgtatgtttgtgtgtttttttagttttcctaaactttgtcccactcaaagccaaaactacccagtgacacacaatgagccattaactaaaatagacttaaactgttaaagtgtcttgaaaacccaaataaagctttatatggtctcggctgtcaccaatattcctaagtatttacaatgatgcaaggtctcttagtttgaattctcccagaagtaggcattgagatgagaatttgaatataggttgtttatttgggaatgatccctgaaaacacaggcaggggagcataaaaatgaaacaaggaaaggaaggcagccactgaagaataagtattaatcattttaccctgtgggaaactggagcttaatcctgttgctgaagagtgggagcccgtttggaatacttgcttcagagttatcccacactagataagaggaagctgggatatttatacatgaactcttcatcagtcattgactgagagctgttccaaagatgagaggtaattgaagagtataattttttatccccaagacttccagcctaaagtgcatgaatagaagtgactctgataacaaaagaagccctcagtcatacagattaagtagctgacatcttgaaattggaaagttgcccatatagtaaattccaaagggatattgtacagacacaaacaaaataggcccattaggtatcctggaagagctgtagtacttcaaatccttcagtggttaactgagatgatgataggttccatatgcatttgagggaacataggttatcagagggaaatttgtaaagaaatccaactctagcaatgagaatgtttcagatctccataaaggcaggcgacacatctgcctttttacactactttaaccttcacaccttacatggcacctggcatacagtaagcacagaaaatcttcttgaatgaaatcattttatgatatttactttaataatttttactaaactgataagcaaaggtaagcaaaaaggaacacataaagagatattccatacattattaattttaaaaagaccctagaaccataataaggagcactataagactaattaggatgctttattgaattaaatgcaaaattgtctttgaaacaattttcaaacaattccagaattttttagattacttcgggaattaaataaaagaatacatgaatctaatatataatgattagtaattgagctttatgtaggatgtgtgtatataaatatatatatatacacacaactaaaagtgtatatttataatatgtatacatattttagatattgtatgtacatataagtatgtcctccaagttgtacctttaaaattagtacaatcagattttgctttcctcagttttctttccttctatatcaactgtgaataaatgattttctaactggtgtagggtttctgatgattcatatggtttaaataatttatgttttaatttcatcaaatatttgtgcccatatttttgtgatttttatattcatatttaaaaatataaacaaagtctcctctatactgcatgtcttccacctatatttggattaaaatgtgttgataagatttcaaagactaaagaaaggttgatactaagccttgagatgccagttttcacagcagccactcttgggatagtttgtcatcagcgttatttgccatttccttaaatgaacattggtagttagcaatttgtagttcataagggccttttaatttgtcttcgaaaagtggctttgaacatatgttattttgttaaattatagatgttaactgaataaattctttggttgcatgttttctttctacaatcacttgattgtttcctataaaaccctgctgactttttaaggaacgtgttggaaaatttttctcacaactttccttctgtgcctgtagtttttggagttgcttccctcattataaatgtaattgccaggggttttgtcacaggaatatgatcttttttagttcaaaactttcattctgcttatgtagattgttttttcttatctgatttcatgtcccattgtgttactaaaatctagtggtgaattacctaaagcacttcccaacctgtctctatacattcttttagtgaatgaagagaatacgaacattatattatgtgtaattgcctgtgcatcagatgctttatattgaacacaaatgttatggaagattcatttcatatgtacccatttgcaaactttacatattgtttagaaccaacatctggtcttactgaactcttatttcaggatctccttttagagattaaaccaacccattaaagccaaaaatccatttaacagttattcctaaggttaacaaagagtaaaaataccacactttagccatccaggaaggtaaggtataacatagattcatagatgcatgtatgaaaaccaactgtgaaccactctagaatgtaaagggtaacgaaacccactcgtatttggaaaatagactaccagactttgtaaacttcaagtttgctttgcctctagcatttttccctcattttttttcctagctaggtgcattttgaaggaaatttaacttgaaaagcatgtttctaaagctaaaccacagactgtgcgatgtgaataataatgattcttggcttattgtttttcaattccagaagaaatctgacagaccaggccagcaacactttataatgcttatataatagtttcatacagatctttttttcaacaaatggctctgaaaattagaaaaaaaatatggaacacatagaaaaatgttcaaaatcattcaaagacatgtaattagtttaactaccccttaattctggtaaaccacatgtactactttttactccaggttattcttttttaaaactaagtgtattggcaagaacagaaaaccaaacaccgcatggtctcactcataagtgagagctgaacaatgagaacacttggacacagggagaggaacatcacacactggggcctgtcacagggtgggggactaggggagggatagtattaggagaaatacctaatatagatgatgggttgatgggttcagcaaaccaccatagcacgtgtatacctatgcaacaaagggggacgttctacacatgtatcctagaacttaaagtataataaaaaattttttaagtgtattgggatatattcacatctcatgaaatccattcatttcaagtggacaattcaataatttttagttactttattgactcatgccggcatccccagaaatcagttttacaatgattttacaactaactaataatgatgataaactcatcattgcatttttaactatttttcgtgtcaattctaacttaagaatcattacatgtaatttagttttttacaaaaaatctcatcatgaaaaggcttaagtttacttcacaagcttggaaataatgtttagaatctttccacacattaggtaaaatgtagtatctccctgtaaaactgaagtcttcacacctgtgtttgagaacacttgctctatataggctaatgacaattttctgtaaactactgaggttaacaattagaagtgcaggaacctaaatacatacattggattgaaagccaaatccttgaaagaaacaagtattgctgtatttgtatctgcatgatttcctttttagctttacttatgaaatccaaaaattgagcagcttaaggctattttttctaatgtgttgaaattgtaaaggcgtgtataaacatcaatcagttaatcagttctcaaaattctgagatcaattatgtgaaatattcataatggcaaaaataagtattgatgcaatttacttatttggatggacttaagaaatagaatcgctccaaaatttatggctagctgaaaagttacttgacaaaaattcttcagataaattaatcctgtgtgctggaactaaacaggtcaggccacaagcatcatggaaattaagcagcaggtaatctgtctctgcaatttcccctttgctttctgctcagatttttaaaaatttctgtttgtgaggtataaagttatttattgccactcaatgtttgcatttcttaatcaagtaatatggggcagagaaagagtaaatttgtttgggataaaaagagactgagaagtattagtaaacccaagcatagacaatgcaaattttacagccaaaatagaaattctgcaggcatgattgcttttggaaactgtaagtctctgctggtgttcactttgtttgtataaatatgcaaacagacccaaattagcatattccccacctgcacccttcagaaagctaaactagaaactattaatacacacaatctctttttgtagtacttaatttgttaacattttaattgaaatttgataatgggtttaggatatatacttggaggagaagtagagtagatattaggattccagttataattgtcaagtgcatttcactttttcgtattatatttttaggtgattgcttctaagttagaaaacaaagactgtgctctttaagagtacgcctatgttacaaataagtttctggtatcgtggtaacatggaactagggcttctcagaaagatttcatggtaatcaaaatgttttacattgtatacaatgaccaaccaaaattattcttattttctgaaatactatattgtcccattttttcaagccaaatgagtatttttatgtgtgagtaaattggatagctctgagctaatttccaaaatctgatttccaaatgtttgaattgacttcataagttttctgttatgggaggtctgggattttgcccccttaaaggaagggatcaacctacacaactttcaataggacctctctttctgcttcaattagtctctattgcactttgggtggggttgtcaggcatatacaagccatatgggccaggcatatataggccatatgttaagcaatattttttttctgtttccacgcacatggtgaataatattttgatgcaatgcatacgtctatgttgtccaccatattaaaaaaattttgaagagagataattccttttgaaaactcatgagtcatataacaatgtagagttaagcaatggtgactcactcaggcatgtgatatgtataaggacagttgtcatttctgtaggagtaaatcaatttctttctcactcgcctcagaaggtatttatgtgagaatgaagttataatggagccacagttgaatccatacacatatatatatgcatgcgtctgtgtgtttttgtgtatgtttcaaatttggctcctcaattaaagttagcagtttattatttgtcacacagaccccaaaaacaacagggtttgtgtatgacgcctttgataactctggtctggtgtaacaatgccctcattttcttttcttacttatacgaatgaaaggagccagccaagactaaacaacattgtttattttgggcctcaacagtaccaaccaagaggaggtagtgctagaaaaggggtttagcttataatttagtataaccatctaattaataatgtaagctgactaaaatcagaggcgctaatcagcagagacacaaagcaacatatagtaaacttgtaagtgtactataaactgtgactctttaaacagcataataggtagtagctttttttttttttttttaatgaagttttgctctgttgcccaagctggggggcagtggcgcaatcttggctcaccgcaacctccgcctcctgggttcaagcaattcgcctgcctcagcctcccaagtagctgggattacaggtgcctgccaccactcccggctaatagtagtagctttttaaccaaagctgctataggctgtttgtttgtttctttttttgagacagagtctcgctctcttgcccaggctggagtgcaatggcgccatctcggctcactgcaagctccacctcctggtttcccgccattctcttgcctcagcctccagagtagctgggactgcaggcacccgccaccacgcctggctaattttttgtatttttagtagagacggggtttcactgtgttagccaggatgatctcgatctcctgacctcgtgatccgcctgcctcggcctcccagagtgctgggattacaggcctgagccaccgcgcccggcctataggctggttttaaacctgtgtataagttaaacatcaaagagtgcatcatagacgtctttcactatctgaatgtttctgtcccctccacatttatacattgaaacccaatcatcagcgtggtatgatggctcatgcctgtaatcccagcacttcaggaggccgaggtgggcagatcacttgaggccaggagttcaagaccagcctggccaatatggcgaaacccatcactactcaaaatacaaaaattagcccggcatggtggcacatgcctgcaattccatctactggggaggctgaagcacgagaatcacttgaacctgggaggcagaggttgcaatgagccaagattatatcacagcactccagcctgggtgacggagtgagactttgtctcaaaaagaaaaaaaaaaattaggacatgagcccttggaaagatgatgattaggtcatgagattagagccatcagaaatgggattagtgctcttataatgaaggctccatagagctaccttgtccttccatcttgtgaagacacaatgatgctagaatgcgcaatctatgaatcgggaaatagactctcaccagacaccaaatctgctggcaccttcatcttgaacttgccagtctccacagctgtaagaaacatccattgtttataagctgttcagtttgtagtattgttatagcagcccaaatagattaagacaagaactctgggtttaaagagtgagaaaaaaaattacagcaagattgtatacatgccaaatagccagctatttctttagatagcttattacctctctgtcaagcagaggtcttttgcttgcttgaaaaaagttctagattatatttctctactgcaattgttttgaaatgcatgttttattgtaactcaggtatggtgcggccaacagatcaggagaaggttgccactaaaaaatagagactatggctgggggtggtggctcacacatgtaatcttggcactttgagaggcaaagctgggtggattacctgaggtcaagatttcattaccagcctggccaacatggtgaagccttgtctctagtagaaatacaaaaattagccaggcatggtggtgggaacctgtaatcccagctacttgggaggctgaggcaggagaatcacttgaaccaaggaagtggaggctgctatgagctaagatcgcaccattgcactccaacctgggcaacagagcaaaaattccatctcaaaaaaaaaaaaaaaaagagaatattccatgtcacataatgccacaaagagaagcaccagggtcagtcaggaggcagagggagcaagggaaaagcatggatgggagcatttattgtggtttcatgagaaaggcaagacagggtaaacagagtcggggttggtttgcttgaataatttcagttagctctgaggtatagggactgtctctagcagtctggtacctgaccctgacaggattaggacagaagaatattgcttgctggaagttaagagccagaaagaggaggtgtttcagaggaaaggctctggattggttagtttgcacatgaaggcatgttcctggactaacatttgctatctctaagaattgaagaattgactagccctagaagagacaatttcttcccagtcagtgaggcctcagatgccagagcatcaggaatacaaaaagaagaaaatattcagagtaacttcatatattgatatactgatatctactaatataaaccatatgttttacttcttttaatattgagtaaaacatacaatgaattattctattcataaatttgaaagttaatggcctttcacaaatatatatcctccaatcaagatatagattatttctaattactgtagagtgttctctgctgttcacttccactctatagttgtagtttgctaataaaagattaagaccagcacatattttgtttagtgtctgaatataacataacataatatataatggcatttcgttttactcctttctatcctatgcttgggcacagcacatgagccaaacaacccaagaatagcctttccgaatagttttcctaccattatctgttagaatggagggtgggcaaatatcaatcctttcttgaactaaagatatatttaagttacatctctcaacttttgcctctaattaaaagtgaccaaaaccttttttgagaagctccacagagaatcctgcaagcatccacctgccctgtgctggaactgccctggctgttctagccctgaatgaccctcactcagaacagatttatgacctcagcagtgctttaagacaaacaaattaataagaaacaaaacttcacagtgtggtcagcctacttcttcttctttttttttttttttttttttttttttgagacggagtctcactctgtagcccaggctggagtgcagtggcgcgatctcggctcactgcaagctccacctcccgggttcacgtcattctcctgcctcagcctcccgagtagctgggactacaggtgcccgccaccacgcccggctaattttttgtatttttagtagagatggggtttcactatgttagccaggattgtctcgatctcctgacctcgagatctgcccacctcggccccccaaagtgctgggattacaggcgtgagccaccgcacctagccagtcagccaatttctaatctgaaatttgttctgcattgatttcagcttgattttatagaatcattcaaaaccacatgttcatcagccatatactttcaatagttgtccctcctcgatctttggagccatctatactgagataaatgtgatttattgttcagactaaaaagttgtataagatactatctaatttttttctaaggtttcatatttagtccttccaattttgattatcaactgtagttttaaagtttctactttgtcgtcttaattttgtggaaaccagtgaattaagacaacaagcagaagatattgcctaaagcaatcctgcattggttggggactcgggctattaaaattccatcaaagttaatgttcttacccaagattaacaaagccagtagatagacatatttttcacttgcaaatctaagctatattttctggaaagtgaaagacagaaacttaactgaatttaggaattttgcaaaattgtttttcgctctctgggaataaagatttgatcttctccttgtggattgtttacattttctctgaaatgtatttttctaaaacgtttaggctctaacaaacagaagtgtgaagcatgtatttttcatacataaaattaagaatattgccttttaaaaattcacacaattaaatgcatatctgtctaagcattttgagggtatcttatgtttcaggtacaattgatgaaaaaaagaaagaatgtcatagatgcggttgaatttcagttgtctcatgttaaaagaccaccagatccgttagcagcttcatatgatatatgtaaagaataagcactaggctgaaagatgcacataaatacacacatacacaaatatttagatgaataaccatcattctcatcaccttgtataacaatgtatggatgtcccaggatagggatcactagatgcttaaactgcagatgtattatatgtactcacagccctctaaaggacctaaagagataaaaatattgtagaacatcccagaaaagagataagaatattgtagaacatcccagcaatccaaggatcatttttctaaaacatactgattttatacacacacatacataaatacaaatattatacatacatatctcctctaagagtcacagtattttatgataggtttgctaatatactgcattttctaaaaggatttcattatgaaaaaaaattatttgctctatatgtattatttcctaccaacataatttcttattttagagataatcaacttcagcttcaagtggacaataagagttttaaatatagctgtttatcaatattaacctcttatatggtttgactctgtgtcccacccaaatctcaactggaattatagttcccacaatccccacatgttatgggacggacccagtgggaggtaattgaatcatgggggctgttaccctcatgctgttctcatcatagtgagttctcgcaagatctgatagttttataaggatcttttctcccttttgcttggcacttctacttcctgctgccatgtgaaggacatgtttgcttcaacttctgccatgattgtaaatttcctgaggcctccctagtcctgaagaactgtgagttgattaacccactttcctttataaattacccagtgttgagtagttctttatagcagtgtgagagaagactaatatagtaaattggtaccacagagagtggggtgctgctataaggatacccaaaaatgtggaagcaacttaggaactgggaaacaggctaaggttagaacaatttggaaaactcagaagaagacaggaaaatatgggatagtttagaatttccaagagacttgggaggcttagaagacagaaagatgtgggaaagtgtggaacttcctagagacttgttaaatggctttgaccaaaatattgatagtgatataaacaatgatgaccaggctgaggtggtctcagatggagatgaggaacttgttggcagccggaataaagtgcttcttttaatagcttggcaaagagactggtggcattttgcccctgccctcgagatcagcagaactctaaacttgtgagagataatttaaggtatctggtggaacaatttttttagtagcacaacattcaagaggaagcagagcattaaagttaggaaaatttgcagcctgataatggagtagaaaagaaaaactcattttggtgggggagaaattcaagctggctgcataaatttgcataagtaataaggagccaaatattaattgccaagacaatcgggaaaacatctccagggcatgtcagatatctttttgacaggccaggaggtcaaggagggaaaaatggttttgagggccagtccaaggaccccctgctgtgtgcagcattgagacttgttgtcctgtgtcccagctgctccagctgtggctaaaagaggccaaggtatagcttgggccatggcttaagatggtgcaagacccaagccttggcagcttcttcctagtgttgagcctgcaggtgcactgaggtttgggaacctccacctatatttcagaggatatttggaaatgcctggatgtccagtcagaagtttgctgcaggggcagagccctcatagagacctctgcaagggcagtgcagtagggaaatgtggggtccccagtggggcactgcctagtgaagctgtgagaagaaggccactatcctctagaccccagaatggtggatccactgacagcttgcgttggatgcacctggaaaagccacaaacactcaacaccagcccatgaaagtaaatgggaggagtgctgtaccctggaaaacccaaggctgtgggagcccatctcttgcatcagcatgacttggatatgagacatggagtcaaaagagattatttcagagctttaagatttaattattgccttgtttgattttggacttgcatgggcctggagtccctttgttttggccaacttatttcatttggaataggtgtatttagccaatggccgtaccctcatcgtatctgggaagtaagtgacttgcttttgattttacaggctcataggcagaaaggacttgacttgtctcagatgagactttggatttgaatttttgggttaatgctggaatgagttaagactttggggaccattggaagggcatgattatgttttaaaatgtgaagacatgagatttgggaggtgtcaggggtggaatgacatggtttggctctgtgtccccacccaaatctcatcttgtattataattcccataatccccatgtgtcctaggagggaaccatgggtgggaggtaattaaatcatggggacagttacactcatgccattctcatgatagtgagtgagttctcatgctatctgatagttttgtaagggcttccctgccacttcactctgcacttctccttgctgcagccatgtgaagaaggaagtgtttgcttccccttctatcatgattgtaagtttcttgaggcctcctcacccctgagtaactatgtcaattaagcctctttcatttataaattacccagtcttgggcagtgctttatagcagcgtgagaatgaactgatataacctctttcacactgaagcattatatttagaaatctatgattatcccctagattttcagaaccatatcacatatatcatatgtatgaagattgctctaattctgtgaggatactgggagatattaaaaagaagaagacttttatatttttataacaaggaatatgttgattaattgttaaaatgaaatataagatttcattttggtgaatttatgcaataaatgactatgaaatgcatacttcatttgtcattacttttttaaaattttttatttctccacgctgagaaaaggataagattataaattataacaaaattctccagtctttaaaactactttagatctttaaaattcaatgattaaaattttggagttttagtctttagaaaagactaaatcttgtgtatactgttatcaaaaaatcgggggaggaaattctggtcaaaatttattttcagtgtattatgtcttagaatatttttctcccagcacaattaattctattgagaaaattacttttctttttactatagaaattgaataacataagtttatagagagtagtctctcttctaagcacattttcattgccattttgattttaatttttttattttaatatcacgggctaaatagaacttatttttcagaggaaccagccagaaaatatgctgtatactttattccaaggctaaccaaattccatggtagatttatgcaaagccggcactatgctaggcacctaagattctgagggacatacagtctagtgggaagacatactgtaagcaaatgatgtaattacaacacaatgcagtcagataaataatgggagaaggagcaactatactgtaagagggcagaggaaggacctgatcaactattgcctaagggactcaggagaaactttatgagggaattatattagcaaaggattttggagactaatgagtagtagaagcagttttccaggtggaaaagagagagatctagtgttgcagacagggagtacagcatacacaaacaactgaaaaaaagaattgtctttagaattttagctttgtatggagagcaataaatgacaaagctggtatgtatgttgcagtcttgtgaggagcactaaataataatgaaatgaatttcaaattttgtatcctactgtagtccaaagtttcccaactctttgtgatcctaagagttatctgctatcatcttcttaaaaatacagatctccagaccgttctgttggagcttattatttgcttaacattttagaaaacctagatttgaaattatgtgattttgaaagagaggggaatcaatgtttcatttgctttataaaatactaaatcatcaaaatgtatagaaagttgaaattctgaaaatattaagctgaaagtcatagaatccaatgcagttggtaaatggcaagggtttgaactaatccacggctggaaaagtagaaaagtgatcagttttcagaaagttgagctgattggcaagctgaattattggtgagaaaaaatataaactataactctgagattttgaactggatacactgcaaattgataaggttttgtagctaaaatagaaaatcagaacaccaggtttggggaaatcagtgtaggaatggtgagttgaagaacattaagcaatgaatgattatgctaaatcaaacccaagagagtttctagatttaacagaagtgttcacttctgaaaaaactgagaaggaaatgttcctcagtaggcattgtaatgaatggtaaagaaaaataagagactaatgcttttaaagtcatgtctgattcaaaagaaaaatctttcaaccattcactgcatatattttcccatggagacaatttttaaaagctttggctcacttagaaaagaaatcctgagccctttttgttattactttaacttgtccaatctctaaatcacagagatacctcagaggttcattagaaattcccaaatctagaaagaggaaggtcccaataaaaacaaataaaccaaaccagatcctttatgggttgaattttgaagttttcacttcctgattttaaggaagggtcatattttagaggcagaataatggcaaatatagattttaaaacaccatagttaaaacaaagaatcccttccatgtctgtcaccagatctggcagacacatgtatcaagtgtaattctaacacaaattgtgaatgacgcaagtctcatccctaaccagatcccttcacaaggagacactttctagccaacatttttgctttaccattgtaatttgtttttctattattttattgagtgtagtcaatgactcaggttacaatgtgcaaaaatcttccttctgtacttcaaatagatgaagaaacaatcttttagaaaaagttcttctctacttctcggctgaggttcaattattaactttttttaaatttttttgagactgagtctcactctgtcgccctgactgaagtgtggtggtgtcatcttggctcattgtaacctccacctccaggattcaagtgattctcctgcctcagcctcccaagtagctgggattacagtcacacaccaccacaaccagctaatttttgaattttagtagagatggggttttgccatattggtcaagctggtctcgacctcctgacctcatgatttgcccacctcagcctcccaaagtgctgggattacagatgtgagccaccatgcctggccaattattaactgttaagagtggtactttggccgggtgtggtggctcatgcctgtaatgctagcactttgggaggccaaggcaaacagatcacttgaggtcaggagttcaaaaccatcctggtcatcatgatgaaaccccatctctaccaaaaatacaaaaaattagctaggcatggtggccttcgcctgtaatcccagctactcgggaggttgaggcaggagaattgcttgaacccgggaggcaaaggttgcagtgagccaagatcgtgccaccgcactccagcctgggcaacagagcgagactccgtttccaaaaaaaaaaaaaaaaaaagtggtactttgcatctctccgttatatatgtcaactagtcattgcatgttgctgattcaagaggctgtcattgcagtggcctggacttagggaagaaaacactgtgagcaagtcaacccttggtttccagaaagttatgtcttcttggaagagaaattgaaaagcattttttttttttttttgagacagagttttactcttgttttccaggctggagtgcaatgacatgcaatctctgctcacttgcaacctccgcctcccgggttcatctgattctcctgcctcagcctcccgagtagctgggattatgggtgcccagcactacatctggctcgtttttttgtatttttagtagagccgggtttcatgttggccaggctggtctcgaactcctgactgcaggtgatccatctgcctcagccttccaaagtgctgggattagaggcacgagccactgcacctggcctgaaaagcacttttatatcagcttttataaaacacatattactagatatatagggtgaaaatatctgtctagtcctatgtcatgatcgaagaaacatttgaaagaagaatagattgaaagcatcatgcaattccactgacacacagttaagagtttctttagtactggcggtgtttggaagttttcagtaccgctgtgtaagtccggagaagcttcatggagaatggtcagctgtgtgatgcataagccacccctccctcttagtcttaactatttttttctcctttatttgtatttttttcttttcttttcttttcttttcttttctttcttttctttttttttttttttttgagatggagtctcgctctgtcacccaggctgggtgcagtggcgtgatctcgactcgatgcaagcctgcaagctctgcctcccaggttcacgccattctcctgcctcagcctcccgaatagctgggactataggtgcccgccaccatgcccagctaattttttgtatttttttttttagtagagatggggtttcaccgtgttagccaggatggtctccatctcctgacctcatgatccgcccgcctcggcctcccaaagtgctgggattacaggcgtgagccaccgcgcccggcctatttgtattctcttaagaaatatttcatttaaaatataatcaataccactttacaaagtatattatgtctcctttctttatagttttacaaagggcacatatatcagctgtatccagaatagcaaaaattaaagatcaaatattaatattatttctctctcttaaataccaatacaacaaaaatgtattttacataccagacattattttaaatttgctaaaaattattacctttatacggttttaaattttctttttaccagtttcttcatttgtttttctacaaaactatttgctaacttgcgtcaatgcctgcaccagtttctcagcatcctattctgtcatcaacttctttctcttaataggggaaccatttcagtaatctatcaattagtttgtgtaagaggcagaaaattaaaaatccggaggggcgcagtggctcactcctgtaatcccagaatttagggaggctgaggcagttggatcaactgagatcaggagttcgagaccagccttgccaacatgcgaaaccctgtctctactaaaaatacgaaaattagctgggtgtggtggcacgcatctgtaatcccagctacttgggaggctgaggcagtagagtctcttgaacccgagaagtggaggtgcagtgagccgagattgcaccactgcactccagcctggacaacaagagtgaaactccatcgaaaaaaaaaaaacctaggctatcaggtcatttactggcaattgcgattttagcatctataccagcatttttgccaaaaaatccctgagatttctcttccttcttaattttgcctgtagctctcagcatttttccagtcttaaggaagttgaaagttttttttttccattttgtttaaccattaacttccattctctcaaattgcaaatttaaaaaacagaagaatgaaaagaaaataaatctgtcatacagtgtacactgcaatatcatgaatttttgtacagaaaaacactgatttaaagaatttctatgaatttgcaaattagtaatttgaacaaatcactctttgatatctgaaaattaatgaaaagcataatttgtatcactttctcattaatattctaaattgtgtcacagcacataaaaaaatcgataaattatacctcaaaacatgaattaaaaagtattctagaaaactttttaaaagcattgatacaatggagtgcccagagaatttgtctctttctccattatgttttattatgtccacattatttatcaggggaaagaaaaacaattcctattaattatttattaatattaaaatattgatgagtattaaaaagtaccgggcttccagctggtgtactgagttgaacttttctgaaatgcagccagcacaaggggcgtgtattaaaagagcagaacaaatgacttattaggggtccaaaagcagcaatcagaaaaggttcatttaacatagcgatggcacaagcttcaagcaattgcctctacttaagtaagtgtggaattacaaaagcctatttattacagtccaacagggtcctgcagcttgctcaaagagctttgaagaaattcaacagttataaagtcctgctcagtgcagaagcagtaaaatttggacagacccccaaaacagcccacaaagctttcatgaaaaagttaatacaatcctcatcgcaattgttctttgaaatgaattgttttctcacttttctttttttaaaggagagatgctgtacctggttattttcaaaacttctttgaaaatgaattttaaccactaggaaaaaatgaaagtttcatggtggtatcaaattaaatgtaggacctcatgtgttccaacattaagcttcttgaaatgctcttgaaaccaacattaaatgtgactccgttaatggacttacttcagcagaaaaattagtagatttcctcattgtagaaaatgcaaaatttgagtccaaagacactggggctgaaatttttttattagtgattggataatgatttgatttttctaagtattaaagtaagcaaaaataaatttttttttaaaaaatccacatatccatttatttataattcagcaatacatttataaatatagaatatgtttatgaagcttcaactaaagtataagaaaaataacttatcttttgcttggaatcaattttagagagcaaattgcagggttgtgggggtgaagccaatttagggactaaaatagaggattattgaatagatgaagaattgataatgaaaggtaaatgatgttaatttgtatgaaaagatattaattcctaatgggagcaaaaagttggtaagaaaatgaatttactttttcatcagaaaagcaacacctacatttttccttggcaaaagattaagtcaggccaagtgtggtggttcatgcctgtaattctagcactttgggaggcctaccggggagaatcacttgagcccaggagttcaggatcagcctgggcaacatgacaaaactttgtctctacaaataataaaaaattagctgattgtggtggcacaagcctgtagtctcagccagtaggattgctttagcctgggaggtggaggctgcagtaagccgagatcacatcactacactctagcctggaaaacaagggcaaaaccctgtcttaaagaaagaaaaaaataataaaagattaagtcatcattcccaggccaatccatgcttcaattagaaggtgttcctatgagatctcacaaataataaaacccagttgatgggaaatattgcagtagattctattttttggtgtacagttttctctgaagtggcacaaggcaagcatcatgaaagtttctattataggtgaagaataaaaatgaaaagtgtttatagataggaaagtttgaatgagaggtcggatgcaaaaatcatcatgtgataatcatagaaacatcaacaaatacagaacttctgctaacttgtgggaaatacaaatacatgaggttcttatggtccttgatttgagaaaaatctatataaaaataagtgctttaacaatgaaaacaattcaacagttaatgtatctaaagattcctgagtttttgtttgttgtgtgtttgtagtttattttgctgcattccattaaggcagggtgccactgaactccagtgagacatttcgattggcgagtgaaccaagattgagatttgaaagcagaagtactttgatgatagtatgcatttttccttttaatggaagggtttgaagaaggaaatcacttaaaatatttttaatcttcagttagaaatgaatttgaccctatgatatctgatccaaacagatggggtttttattcatattccatactttcgataatgcttagcaaaacatagcaaatgtagaatcaccatcaaataagacatttcaaaacatgtctaggtaattgtaacacatatagcagtcatttccttggtacctctcattaagtatttttttaagaaataaaactgtacaaaagaagattgttgttccttttctttgtagtcaagagatgtttgtcagaagtcaaggcctactgtaatatgtcctaaatcatatctattttacaatatactaaatattattattacctatggataccatgggactccttgtgcataatggattccagtcctcttgcagagctgcatatgaaaatgttatcaatgagctgaagaatctggcattaataactttgcaacattataacaaataggtagtcctgatgttttgttctttttttaatacatcaaatatatttcattgcttacattatagtagcagattgaaaacatctgctcacttgccactagtccaccagcagcagagaatctcagcacattttccctaggcctgcatgtaccagggctataatccagctgttgagtctggatatggggccagattaatattcaagagccttggaaatggaaatagtgctttcttgccaaaaaactggaacaatgatagactccatttgcatgttcccttctccctctgttcttattcgccaccctttctaacccattaatttgcttccttccaccttcccctcccatcctctctttacagctccatcacctgtcctgacgattaagaaagatcggacctccagaaatagcatctctttgtcctggcaagaacctgaacatcctaatgggatcatattggactacgaggtcaaatactatgaaaaggtggggaaacaatgtttaagggttgggctgtgtaggcaagaagctgtttcctcatgagctgtgctcttgcaaagaaaccagtgacattcctggtaaatggtagagcactgtttagaactgtggccctgtgacccctttgatttattggtagaggaaggtttagaaagaatcttgttgaataccccctattctacagcaataaacaacatcaaagatgccactgccaacttaatccagttacttatggcaatagcatgacatttatctccctttacaccaagacccctactctaccaactattttattgtggtttcttagtctatttgtgaactgtttttttagttcattgcctcaagcatcatttcctgaccttcaaatttacatgcatttcattcaatacaaatagcaacattgtgctagtaagaaaaatattgtattatttaactgatgatgaaaagattttcttgaccctgtagaaggaaatttaaaaggttggggatagatggataaatttgcgtgacataaagttgtggcttggtaatgcaattattaaaaaaaataggcacatggttatttttaccccaaatttaaaaattattaaaaaatagttatgtggttattttgccctgagtggagtggcgagtattccatcattctaaataactcattttttttctggttgtaaatgatagtaaagtttaaagacaagatatgtttaaaccttagaatcacagctagttagtttcacaactactaacatgaacactacatatttgtgtatctacttcagtttataaagtgtgttaaaatgaattaaatgcaaattgtgcatttatatagcagtttatatttacagaacatttctgtggacattacttaagtctgagctgtataacaaccttatggaagtagcaaagtaagttgttttagaaataagaaaacagagagtgatgttatatgaatttcccacagcctcattgctaataaatattaggcatctgttttgaattgtggcagccgtgagtcctcctttagtaggtttttccctatatcaggtacctttttctacatgataatagatccttataagaattattggcataatcaactgtgcaaactgcgtaatgtaaaaacattgttttgcattatgtagttatttccttgcttgaagttaatatatttctctagtataatgtcatttttttcatagtctctcttacagaaagcctagagtatatcttttttattaaaagaaattgatgccaaataaacttcattgttcaaaaattgtagtagaaataaattttctcctagctttgagtcctctactgtggtaaagtcaaatactcataggattgtgatctattttcagaagtgtgacaagatagaatgggcaaatataataattcatgttcataaatgatgccacaaaattcttaaaaatcagtaatgtgcctcagttcaaactagatttcaggactgggagaagaacacctaacatttagatctatgaggttgatctcaaattttaattgtatacatctgcacctttcacaaacatgagaaatatgctgccttatttcaaactccctcaacaaatgcaacaagcatcattgccttttttttttttttttttttgagatggagtttcactcttgttgcccaggctggagtgcaatggcatgatctcggctcaccgccacctccgcctcccaggttcaagcgattctcctgcctcagcctcccaagtagctgggatgataggcatgcgccaccatgcccaactaattttgtatttttagtagagatgaggtttctccacgttggtcaggctggtcttaaacttgtgacctcaggtgatccacccgcctgggcctcccaaagtgctgggattacaggcgtgagccaccacccctggacattacttttaaacaatattagctattgcaggaaaaaatggtcaaatctattgattattccctaagtattttttgatacatacatacctgtaatattatttaaaatatattcctttaaatacatatttgcatcacatatacctaaatttaaaaattaattctaaatatttatagtatgcttggtaatatttagaaagattctctaggatttaaggtccacaaggtctagatttctggactggttatttcgctgatggtgattaacagtatatgtaatgtatggcatgttttctgtactattcaatctcgttttggttgaggatatacagcgtttcatattatccactctaggtcctactctaggtgcagggacattgtaccattgcttgaaatcaggttcctcataggagctctgtgtataataatatatgtgagagaaaaaacgtaattcttgataaattcaatttttgtaaacaaagcttgacacaaagagaccactaaaatgtgtcgtgtgaatctaatgtacaatgtgaatctcctagagatcctttttgggaagcatttctagcctttgatctggagatttttgtctctaccaaaccacagtgacttagattaaatacagcacaaatacagttaagctaaaaataatgtagagctacatataaaaccttgattttttatgtttaatattttaaggttgataaaaaaaagttctactccagaatcaatagagcattcctattaggtttaattcaaagggatattttcttctttgtaagtttgttattggaattagatttaagctttctctcagccttgactttgaagagaacatatcttctctcacatatttactggttagaataaagccaaatttttcctgctttacatgcaggacagaaatcataatattcaaattgggaaattctgtaaatatttttatttttagaaatgcccatgttgggacaggtgcggtggctcatgcctgtaatcccagcactttgggcggccgaggcaggtggatctcctgaggtcagcagttcaagaccagcctggccaacatggtgaaacctcgtctctactaaaaatacaaaaattacctgggagtgatggcgtgcacctgtagtcccagctactcaggaggctgaggcaggaaaatcgtttgaacccaggaggcagaggtttcagtgagctgagatcgcgccactgcactccagcctggtgacaaagcaagactttgtctaaaaaaaaaaaaaatgcctaagttgcgttcagagaataaaataattgaaataatcgatatgactttttaaatccatcctatgatttgtgttaaaatataaaagaatcaggtttgagtggttcactgtttatcattttatagcattatgaagatttgattttaacatgaatttttttttctgacctcaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactgtatgtattatttcaatgcagtctagaggagggggcagggatcttgcaaaagatgtctgatcgtttattctcactgtttctaagttttaaacaaatgtgatacatttaaggtatattgcttgggacattgcaatttgcagagccctgtgtctgtatacagtatttgtgtttgtgtgggtgtacattttgtgtttctttttttcttgtatgcaaatcaaacatattctaatgcctgaaatgcttctgttttttttttttagccataaattgcttttgaggaacattatttaatatagtaacacacttccagtgtctgtcatttcagatattccaggttcattgcgtgattcaatgaaccacaaaaaagaaacttgctgatccatgagaatcttaattttgttttaatccttaacacattcaatagcatatcacagagagaataaggattttctaaaatgtgttttatcacttcattcacattcagaagtaatttgaatagcctgttcctttaaccccaaatttggctaaaattggcctaaaactggcaaacatttttccagtaacttttctttttttcaaatgaattttcttcatacttaaaaaagccctttgctaaaatataattttcaaaaaggtaaaattatgtctatggcactaatataaaatgagtagaagttaatgattttacttaactcatttttttctttctttctttttttttttttttttttgagacggagtcttgctctgtcacccaggctggagtacagcagagcgatctcggctcactgcaagctcctgcaagctccgcctcctggcttcacgccattctccccctcagcctcccgagtagctgggactacag

SEQ ID NO: 2440 - DNA, 582065 bp, Homo sapiens
ggggagaagtgaccaggcggcggcggctctgctgaggtgacaacgtgctagcagccctcgctcgctctgggcgcctcctcggcctcagcgtccgctctggccgcgctcgaggagcccttcagcccgccgctgcgctatgaaggcccctctctggggctggccgaggctggagccggctccctctgctcgcgggcaagtgtgaagagagaggcgcgggcgggagccggggctgcgcgcggcgctcgcgggccggcgcgggttccaggtgagcgcggactcggcgagccccgcactcggcgcggccggccggcgcctgctgggcttgatctgaggctgaatcccgtgtgtggaccgccgttccctcttcgcgggatcgttggccaggatagcaggtctccgtctctttctcgcttcccctcttttcctcttgattgtctgggacgagctccctctgggctgccagagtgccggggctaggtgccgcaaagtcccgcggcgagtgccggggcgcggagccgagcgccccgggccggtcccagggcaaaggcaggggcgcgggcggacctggcgacgcggcctcccgggagctccgagtgcgctcgcttgcggggctgcaggtgttgcgggaggaccgcgtggcgcggaactttctgccgccgcccaccttctgctctgcttttctggctaccccggtgagttgttggtggcgggggggggggggggagcggctctggccccctctgcgttctggtgacgttcctccgcgggggtggctcggcctccaagcccagacaactttctcgcaccagctgcaggcagccccggctgcgttgcgggcgtttctactcgacccgacaccaggcgctccctgggtcttgggtgtcttcctcgacggttgccttcgtatagtgccccctttgcctcgctttttcagagtcctcttgcctctcattctcgccgtgtgtgtctctgcctctgtttctctttctgagccttggtcccctcagtccacactctccggccatgtatctgtttttttctcttattctgtttccctctttctttcttgggatatctgtgtccctgttaatctgtctttccttttgtctctccgttttgcaacatttgttctctttctgtgtctgcttctcgcagcttatctctgtctccctctgtcatctctctgccccgtcttcccgaacaccagccccgcgatcccgaagcgccttggttaggggagcaagccctggcgcatctaatgggtatctccaggtgcagagattttcctgcggggtcagtggggacgcggaggagacagcctgcccttgtccaggctgtcgtggacctgaaggaggggcgcaaggggttagagtggagggcaccgcagcaggctccccttgccgggtccgagggcgctgcgctgctgcgaacctgagcgcactgaggctgctactctggacagcgaaagctgcgcaagcccctcccgcatacccgattctttgactatggttagttgaatttccaggaggagagtctgcctccccaacctttatagccagctgcagaagaacggacagtgagcaggcaaacatagatgctttggggttcagggaaactaacctcgaaagggtgggagctttcttcaggcaaaggtgttgctagcagaggagaggagctttggggactgaggtatgcctgccttaaactaccatgcattcattgcttaggaaagcggtttccttggagagatcgtggtcagccttccctgaaacaacataacaacatagaggttttattcgcaaggctaaaggcacttggctgccaaagcccccttgaaatttctggtatccttgaatattttcagctttatgtgaaagctgcctttcctcagagtctcagtccgtctctctctctttctctctctctctttttctgtgtctctctctctcgctgtctccctgtctctctctctctgtctcgtttgcgttcatgccctctagtgttaaagaaacctgctggttcgagaatattgaaaagtaaggtcaacctattggttatttacttttggacctctcaccttccgggataattctccttgtattacacgcatcctttccttttcctcaaagaatgacttttgcattacattactaatctttctttccccccgcacccccctcccgcaatctctgttttttttttttttttctttccccacgtctcctgcagaataagaaccttcatattgaaaccctgttcgtttgatttgggaattggataggtctggagaatttgcgtagcctaaggcagactttgaacattaaaaagatgcatttctctgcactgtttgccataaaccaggatttcacatctctcctttagcccctatccaccttcaattccatggagaattttcctggctgcttctgcttgtttaaataaatgcttttatttcaccatttctgtgatgcttatcccattccagggcttaaggtacttgcttaagtaggggcactgtgtctcggatccgctttggagaggaagaatagaaagcttttctaaaggaattatagggtactgctggtatagattaattccagttcggaaagtcctgagtgggaatgtgagaatggaggctgtctcagatatgtagtccctaggacagtgtggggaaactagtaagtgcttaataaaacttgttggttgattgattagcatgcagcggatcataggcttccaagttaccaggtatgctaaggagcctgcagctaaattccacctccccgctccttttttgggaggtttcatttagattttttatgaatggtaattgagaactagtagaagggatattgaaacaggggtcttctgcttctttgtagttcatgttattgcttgaatttgcccctttttgcaagtctacaacttggctggtgttctttaacacagtcattgcagaattgaagaaatgagtttagaggggccctgaaatgtggcatctctcaatctccttacctgaaagtaagttgggacatggcatcatttttgggtgaatactttcatgtggtttctaacaagtgaaaagttctctcttttaatataaagaacagatatatcagcttaaaatacttgggggctatatattgatctgtaagctggatcacttaccctaaataatttatggattcccctactgcttcatatatatatatatatatgagatgtgcgatactgcatgaatgtgagaatttcctaaagtacctggaaacataatgcctcctaattcaaagtaataatagaaatccatgggcagcaatactactttcttgatgatatgctagtcacctcttaaaatagttgctaatttatcatgagtatggtgcaggagcatgttcaaagcaatttttctttaaaaatattatttataaatcacttgatactgtacccaatttttatatttaaaaatagcaaagacataatgaaggtggaaaatctgatattgtttgagagaccttctatttgttttacaggtttaacttatgcatctaactttttaacttactgggcagtcatttcagtttaaacagttatgtcagagtgaactatgttgttatcatgccaagttgatttctagaaatagtagttgtaacaggagcattttcatgtaatagagcttgtacagcttataaagacttcgggattttaggaaaggggtgagataagaagtaacagtaacaaatgggtatttttattctttatgaatgggcagatgaagagaatcctggtgtttctgaataataacagtcgagaaaatgcttgagaataaagtaggaatagaattaagccttactgtctaaaataaattataatgctacatatctctgttaggtgttcattgtccttttaaaaatggacacttcatatagttatgacctttaactaatttgccttattagacatgatattttaaagagaaacctcttgcaacaaacaacacattcttgacagcgactcttagtacatcaccttcttgtatttgtgtccctgtcagaaggaacatgtagacatcttaaatctaatgggatctaacaggatcactgctttgaagtctgaatgaccatatgcctaattatcaaaggatttaaactgggctttggttctaaatccttccctctgctcttgtcatcaaaataaacacatgtgaaacatcaaatcaagtcctacatatatatactcatatttattctgacaacctatttaatgacatttctaacagcaacccccccacactacacacacacacacacacacacacacacacacatacacacacagtggctaagcatatgtttgaaaacgtaaatcacatttaaagatctggcactgtctgctttgataaaccatttattattttatcagattagacttctgtttacaatttctatcaaggcacattgttgaaggacttctgccattcaaatatatgcatacctgtgtttgaaaagtctggtttttcattgtgaaatttagcttttcaaggaaatttatgaaaatgaatacatttaattcagtaatagtcatccgtttggggcattataaacaattatatctagtttttgggaggagcagtgtaaaccaaacagactttaatcacttgatatttgtttcttcttgatttcatatttagacctgtgtctgtgttttcagtgtagtgtatctattataatacatttaattggtgttagcttgattaccaagaaatgattacaggtggctaaagacatctgtgtgattctgattactgtgtgctctcatgtccttaaattcatttatagctatgagtttttcaagctgtttttagtatgtctttagacttatacatttaaatgaaattcttaatttttaaaagttatcactgcagagattgatgggatctaaaatttaaattgttaagttaaagttgggagacatgcttttcctttaagggctcaacttcattcaatgtccacgtaattagagtcctcatgaactgtcaggctctctcttaatgtgtacactaccataattacctacccttcagaaatgaactcaaacacaattcaaaatatcagttattaaaaattgttccaggttaatggttaatcctctcaagatagtttgagagggatgtagggagaagaatgactattattaccatagatatgaacatatttgttatcatcttgtagactatgtgagaaaattaaatacaatgtccataataaatacttagatttctttcatattttttaaagatatgctcattgttaagatagatgggggctgtgcaagatatatcatgttaaggttttaacatgaagaggaattaattgggactctgtttcatatattccactacattgaattgtcacttaaatcttatttaagctcttatacaacattttaggaagagtgtgattaatctgcttgttgacacattggtgaacgtaatgcatgtggtgagtagccactgtaaacagaaagaagaatttaaaagcatagcacaatcaaaaatcatccaaataacatcttgaagatagtagtaaatgtcaacttagtctcttgtcttatattaattgccttgatattacaagcaaagcacctcttttttgttaataaagtggattttgacatatgaggaggattatgtagcttagaagcataataactgacttaatttcctcttgagattattattatataattagtttcagatagagaaggtgagatttatatgactatcaaaaccccaatgaaatacaaccattagtttaaagaaagaaaaatggaataaaatatatgtaaaggtgtatccattccagcttatttatgaagaaggtaagatggtgtattgggttataaattgataaagtggctaaaattcgttggttgtttactttgtatttgtactgtggtaagtaaacatctggcaggtcttaacatgttttatctttataacaacaatatgagtaatagtatgttactgttgccattgtataaatgaggcatcacctcagaatcacacagctaatatgtgtgagcatcaaggatgacaccagtttattctgccttgaagccaataatctaatagttctcagtctgacattttcactgactgataatttaaaaaaatcaagtggtaaactttatgtgattattttcttttgtatagtaagaatgattgaaaaagtctacttctatcatctcaattttataaaagtggatattttaacaccaaataacatggaagaactgaatctcaaaataaataatagttatttaaagagaataaattaagctccctgtacatttttccacattgtactcattttcctaatttcacccaagactgatgaaaatttcatcacaaaaaatttcccgtagattgtgcttggatgcccatcttactctgaaccactgtgatatgctgcctactctatgcacccacacagctctggccggcatggtcatcatattcatgacttgatgacataatgcttatagcttattccattctcttcctagtttcaaataaaatttggacctaggaaagatgctagcacttgctttagccttagtttactgtgttaatgtttgttgaaatgattggaagattagggatgacttgttccttcttggtagttaactgccatttactgacactaagatggtgccactctgtgtcctgggattggaaatgaatattgggcaatgacaaaaagagcttgtcagaactaatttctccatcttccctccaaaaaacacatcccaacttgtacgggtcagtttgctccatttttacttctttgccttggcgaaagtgaagcaggtttggttagtgctcttgtaaaactggtggttggttttacatcccaggttgctttagatagtgtctatttgggccatcaaagaggaaaagaatactggtggagtgtgtgaaatgtggctaaattgacctaagacattagtttcatttctaccaaagcaggttgtaaatccaaattaccttgagtttatttattcattgtagttacaggtgttcaggtcccactgatacagagtctcatttaactgggatggatccacagaatctacctttatgcacattttcctatgtgattctgaggtgcagtgacatttcaagcaactaatctgcttgtagtatatcacttaacagatttatttaacaaaacacagcaattactatgccccagagttgttctaagtgctttgcagatattgattcatttaatcataaagaccttcaaaagtagattttattagtattcttattttagagacaaggaaagtgagtcacagaaaggttaagtaagttggccagtgtaagaagatcagtggaagggcaaggatgatgttaattttgataaaataattaaaactacctacgtgtgtgtgtgtgtgtgtgtgtgtgcatgtgtgtgtgtgttctgagacagagtctgcctctgttacccatgctggagtgcagtggtgcaattatagttcactgtagccttaaaccccttggcgcagcctcccaagtaactaggactacaggcatgtgctgccatgtcaggctaatttttaattttttttttttttggtagagacagagtctcactatgttgcccaggctggtcttaaactcctggcctcaagtagtcctcccgcctcagcctcccaatgtactgggattacaggcatgagccactgatcctggccgtgctttgagccacaaaacttgaagtagcagaattgaaaacagaacacagatttctatgtcttttccctatttgagtaagttttgcctttgaaagtgaaggaagaaaagctgatatttctcgagttggaaaatttttaaaaagtttatattttagaagttgttgcaccagataaataaatataattatgaatgggatagtaaacatggaaaaatcagagtggttttcctcaagtagtgtcatcattgacttggcctctaattagaccaaaacaatattaataatcagtaatacataatgttgcagacaagaatatttttaaaagatttggaaaataaacagctgtttgtttcaatccataacaaaataaccatatatacttcaaatacgtaactaagatttacatctttatactaaataagaaacaatttattttcctgtaatgctcctcataagatctttaagttacattaggaaatattcatatttatggaaggattggggaaattctacctaaatttatggattttttctcaataatttttgtaagctttgtataagatggaatatttgtaatttataatcacttgtgaaaactgatgtattgatctttaacaaagtacattttctcctttctgttatttaatatttttgtttaatacactaaaataatcttgtaaaatggcttttctttggtgttttttaaaatgaattttattttagaccgatgtttgattaaattatgtaaattatttgaattctaaacccccaataatgagtcattccacttgtgtggtttaaaaaagagttaaaaatcggcatttagaaacaatgtgatttccaattcagtaaatgatttaagggtttatggggttactgactattctactttcaagactcactaccatcttttctctttttcttatagcaaatttcaccaggattcctgagacttatatttcttcgattctcttgatcattcagtctcaaataggattatatatcacttgtcctgaaaaatattagaaacagtctgtcactgaatatggtgcagattttattcatatgttatagattttaagcataccttttgatttttttcttaaggtaaatactgtatttattattttttagtattctttttctttgctccatatcttgttctttgttcttctttccattcttcttcatggtgctttttgctttaaattgtctctcttttatgacttaataaatcttcatgtagccagactgaactatgtattggtttccttgattctggtaaaacaaaacaaaacaaaacaaaaaacaaaaaaggaaattaaaaaaggctgttcatttaatcatttagtttctgaataggtaagagacactatagctcttgcatctaggtcatttaacaggtggaaggggatgctaaatttgcatctcattacctttgtctacttttagagttgtgtgcttgggccctgtggtcagttggcaggtggcaggccatggctccaaaggaatgccgtgttatttgaggggatgccaatttcacttgccacacggttctcacattacttggtcagactttttaaaaataaaacaaccaatatatggttcattatttatgctagattactgacttcacatcaaaaatcattgtgatattgataggctgtgataaataattttaacaatttatattctgtggtacccactgtcagacttatggatagtatttcctctattttggtaacctagagcagacattttgtcaaaaatttttaaaagacttttattgttgtgcactaaagttgagatgaattgtaggtaattggatggtacagctgaattaacacattgaattgctagttatgagacacttcatttgctgttgcagacaacaataggcccatttttgcttctacaatgcacaaattcttattatctatataaaatgctaattcaagtgggataacatgtatacatcatttccattccttttgtaaggaaaactaacttccacaaatgtaaaatatttgcaaatatctcaaataattttgaacttcaattaatctttttttgcaaatgttaatcagttttctcattttccacaaacagaacaggatataaggcatttcaaacatgaaatcagtagtatcaattttaccctgtgtcccttaaggtctgtgcagatgggcaattcacatttatctcaacagagatccttatttgaatcattctgaagaacattattactatcatgattatggtgacatgcaatagtgtaataattttgttggctcttgggtttttttcatttagactttttaaagtatagcttcttcgttttcaatagatgagtatccattttaagaggaaggaataagaactatttttatctaaactatctcctgaaaactcattaagtcaagcattaaatggagggattaaaagttataaaactattacaaattgtagagagtaaaggaaggcaaaggaaactgcctagaatgtaggggggggtcgaggcagggggaggtgggttggtggcttgaagttgaggagattcactctgcccatattaagcccccaaaggcctgaggctcaataatgctgaaaaaagtaaagaacagaaatgagagtctggggctaaaacaaaataatttatcaaacatgtatagatgaaatagccttgtattcacaactctattttctatgtaaacatctctatagtaagtttttctcactcactcacctaactatccactcttaacatgtactaactagcaagggacagcaagggcaactaaggatgggtcttagaaaaacaatgcctcttttattttggcacttacagtctttaagcctaatgatcagctttttgcttgccctaaagcaaagtcttttagtcaacaagacccactcaagttcacagagatttgcactttttattcctttatattctttacttttttttttttttcttgagccagggtctcttgcccaggctggaatacagtggcatgatcatagctcactacatgtaacctcaaactcctgggctaaagcaatcctcctgccttagcctcccaaggaagcagggctacagaaatgtctcaccacacccagctaacttttataattttgtagaaatgggggatcttgctatgctacccaggctggtattccttcattcttaactacataaaacagcaatcaaggatcacagacatttaagatataatgtaggaacaaaaattttagaacgtctgcaacatgaaaaataaagagaccaagttaaagaaaccagtaacaacaaaatgactttgcaagaaacacacagaggaccataaaagagacaaatatatgttatttttatatatatatctatatatacacacatatatatgtatattatatatatatatatatataattcttgaaaagatccaggaaaatattgcattcataaaacaagtggatgatatagaaaaggaacactaaatgagtaagaaaaactcttggaaattgaatattttcaaatattttaagggaaaatttgtgattttaaatggagaaaaatctatcaattctaataaaaatgaaacaagatggaaaatatgagtcacagtgaatctccacgaagcatgacttcctaattggacgtctagtaagaaaacaaaaaatacagttagagcaacattaatgaattgaggataattatcaaatttctgaggaaaggtgatttacaactcagcataccatacccagtcaaaatatcccgtgtcagggtagaattaagacattttaagacatatgaagacaaacgttatcttctttaaatataacctttcttgaaaagttactccaggttgaacctcagcaaactatggttaagaaaaacagaaagacatggcatgatggctatgtgaagtagtccaggaaggtgaacaaattgtgttgtttcaacctggtataggattagtataaagaaatggagggtttggttggtgggaggatttgggacaaaaaggggacattatagaatatttaatgtttaaggagtatttaaaaagacaaaaaatgtacaaagaaaaaaagtagaaatgtcaggtaaaacaaaagaatatgcaaaaagggaaaataaccataggactttagttggctccaaaatgaataatatttttatattaaatatacatggtatttactgattttcatcttttgattgattttcagtcaatcttacttaaaatgtggaagataattgtggtgatagaacaaaatgcaaatattatcaagactgacaatgtcacgataaacatacaggtggctgaggttgggaattaggtatggggactggagagagttgaaggaaaggttagggattggaatagtagcatatcacaaaataggagtcaagagatagtgtctatagttaatataagaaatagcactgatatagtccttaaaattacaaagataaccaacaagaggaataatgactacattaggaggaaagatacagagaagttctgaatatgatgtgaagtgacttagataatggctaaactactttgagtttgcttggtcaaacttgctttaatttttttgaaaaaaaaaatgtgattatgcttcgatgagtgtgtacttcccagatttccacagattccaaccactctctgtggaggcatcataatccataaagatattgggatttaaagattccattgtagagctaataaacaattaaaagtgagttcctctggggagaggaactggttggggttgagggggtttactatataaagaaatataaattcttggcacttttgtcactgaacgtgatagcaataattccctatagtactacattatggggctaagaggggaacattggatttagtcctgataaagccattaataaactctataacatgtcatttaagttctctgaatgtcagtttcctcatctttaaagcaacaggtgctgggtttgtaatcccagcacttttggaggctgaggtgggcggatcatctgaggtcaggagttcaagaccagcctggccaacatggtgaaacccagtctgtactaaaaatacgaatatatatatatatatatatgtgtgtgtatatatatatatgtgtgtgtgtgtgtatatatatgtgtgtgtgtgtgtgtatatatgtatatacacacacacacacacacacacacacacattttttagccgagcgtcgtggcacgcacttctagtcccagctactcaggaggctgaaggaagagaatcattttaacccaggaggtaaaggttgcagtgagccgagattgcaccattgcactccagcctggcaacaagagcaaaactttgtctcaaaagataaaataaagtaaaataaataaaataaaataaaataaaaataaatcaactgatattaaaaagtccccagtaccactttgtagtctaatgtttattttgtgaagataggtctatcattttattgagaataaagtgaactagaatttttctaggtataaagcctaagactgatacagagctcttacttgctctgggtctttattagactaaaggtgttcattgccttcttaacaatgatcttcagtctctgtcctgtatcctttaagtttgattctttactttgtgtctaactgactttaccaatcaaatcagaatcatacatctttagttttatgaatgtgtgtaaccagatcctaaatagaattgttttaatagaacttttttcattcttcaaggccttattttcccacagcttaatggttttttttgctgatgtaaaaatgcacattacaagatgattgtttaaaagatcgtatctccatttcacctgttttcctaaacactttcaaagcactgaggaataatttgaaacaacattttatagtggattccagatagaggcagtacattttatagttctctctgtttttaaacggtaccagttactgtgattacctgatgtgcttgcaaatttacagaagaattggtaaatgaaggatggccatttcagtgttcacagatgtgaagatattgccatcttagatcagcagctgctcttgaaatgttcactccttagtatccttgggctaacactaattttgtagctgatcaaaataattgctgtaaagatactagctattcctaattaacgtgagcatatgggtagttcccacaaaaaaatttactaacctgccggttgttgctgtgtatatgttcatgctttagcattcttaactatgaacatgaatcagcaaactaaaaaataatcatagttagctttctatggatagaaatggagagagagacagagagagagaaagagagagaaatgaggaagtttccaaggttccccccatagtgtaggatacgtataccacaaaaatatattgtggaaaactgagaaaaaatactttatttaatttatgtggtaaaacctagtcttttatagtataaaaggataggggattctgaactgaaaaaaaaaaaacaaattaacaatgaggcactcttttttttttaaattatacttttaagttttaggatacatgtgcacaacgtgcaggtttgttatgtatgtatgcatgtgccatgttggtgtgctgcacccattaacttgtcatttaacattaggtatatctcctaatgctatccctccccactccccccaccccgcaacaggccccagtgtgtgatgttccccttcctgtgtctaagaaaatgtggcacatatacatcatggaatactatgcagccataaaaagcgatgagttcatgtcctttgtagggacatggatgaagctggaaaccatcattctcagcaaactatagcaaagacaaaaaaccaaacactgcatgttctcactcataggtgggaattgaacaatgagaacacatggacaaaggaagaggcactttttaaagctgtgaatatctgttttctcttgatagtttgtgattaccgtctctcttggtcccctcattttaccattttctgggtgatcttgatttgaggacagtaacttgtgggcagttagagctcttttgtcctgttattttatgtggttggtgaatctaaggtccattaagttacatattaaagttgaagttcttggcaattaattaggaccttttagcatattaacttcctcttcattctaagataagataaatgtagagattcaagttaggagacagtaaaacacaattaagtgttaaagacacaagtttaattttgtggtgcctggaatcacataaatgtagtttaaaaattcttatatctaattactagaagtatgacagaagacagttacatagcctgcatggaacttagttacctcatctttaaaatggagataatagtcatagtagataacatgaatacaacccaggtctcttactgggcaagaaggtctcttttaagtgctttacataacattaactcatttaattcttacagcactatgagctagatattctcatccaccttataattgtaatgacatgagagttgaggtgacaatgcatgaaatgtactgattgttgtgcttggcacttagcaggtgctcaataaatgtgagctgttatttgtgtatctcctctccgatggtcctctcttggtatctagtgtgacaggtgcctagtaaatttggcctgcttaaccgattttcgaaataaaatctaagacctggaagagttattgtaaggagttactgcaaaattgggccccaagtgccaataaataaataggagttaaagatgggactgaagccaagtgaagtagaaacagtaaaactgtgttagtgaaatattgagaaatcttacttgagagaagggaagataaatgtgtgaaggcaaaggtgcattcatttcatgataaatattatgatattatacacattatacacaatgctaaacaatgacctaccactttgcaaaaaagtgcatctagctgagaacaaggttgatatcttctatttgggaatttccaacatcaccgctgatttttgttaggtgttctgtgttaagtgacagccatcttgcatttcccccttagttatttgatctgctttgactatgttgtttttcttgtggaagaggcttagagaaattgaaagatcaatgctttttgtgtgtgtaaaatagagaacattttaaaacattgccatcccacccttcatttctgaatgaaaaagatgaaacattgtatatttcttattctttaaagacacagattttattttcggtatgtgatatctagtttttaatgatttttatacatgcttatttggagactttctgcttttttaatgtggaagaaagcataatttgaaataacaaattgtaattgatttcccatttagaaatatttgaattccacttctcttttcttatcaagtgaggagaatatgttttgagcactggtattttgtcatttccttcataataacttgtgcaaatgataattatacataaattaataaactgctggtgggaatttaatgatgcatcatactgtttttgatttatttccaaatcatttgcagaatgttgaaatgtacaaggactaagttttaaatgtaacctacaacttcctcagctccaagaacatattcagtaaaataaaatagttatttttaaaaatggtggtacagaaataaattgcattatgttttgtgagcttattatatgaggacattataggttattaaatagtattgtatttatctgtgtttaaaaaatgtttcatattgcaagtaaataaattatttttaaaacctattagaacttttgccatgtgattcaagcaattttctagtgctgcctaaaataatgttgggtcctcatttgcatttccttagtgctcctgtttcattccatcttgaagttttgtgtgccacttgaaaatactttaaaagtaattaaaaataaaattttgttacaagcttcaataactttgtaaacaatttctacataaaatatatttaaaatcaagtactaactcctgccaattctggggaccatgcatgaggttaaccattttcaaccaaggttacatgtactcacagacagacaattgattcattttcttgtattattgcatctatctgccaacatattacaccaattataattattttatttatagagtgatagtcaattgataattaatcctgtaagttcactttcagaacagtcttcattttattcaacaccaagcaccttggaagttagtaagtcacaaaagatgttttccatagttataaaatatttagcaatatgattaattttacagtgtattcttcacgagcatgaaatcaaagatacactgtttcctagcacagggcagagttgatgcaaactacctgtgtgtgtgcttttctgcaaagcgctcctatggaaagttgatttttcatttttctaagtttcctggcagtttttaagtgtggtcctccacgatcttggccttggacaccactaaaactaagtataaattattgatcttatttcataattcagattcattcttgactttcagttccttcattaactctagagtttattttgacctgatattagatcaaattaaattttgccaggtggattaaaaaaaaatgctccttatcccaaaccttacgttcagtataactttcttgttaggttctaatcagttttaagtttttaaccaccctcaaagccttcctgacactcttttatccttcctcaccccacactaacacactctaaaactactacatgtagtgggagttactttctgtctgtttgctttttataaaatctcatatgtatttattacttaccattgaaaaattttattatgtgattttaatcatgttgtattatatgcacttgccattttactataattcactaaataccgatgcacttttatttggccagaggcctacatctcacagtaactgggtatataaaattgtgggccagtaaaatgctgctacattttaatatagaaatgactgtactttattgatgcatgaaatgattcctgcttaagcagtcagtatacataatcaattaataaatgtagctagtgattttgagatctacatagtttaaggcactatgtaaatgcaagatcaggcacttccaatttattgagatacatacttaccagtgggttttcagcagtgggttcatgctcatggcatgcaattattgaatgctttttgcaattataaaaccctgggggtccactggccaaaatttagttttgtgggtgtgtctgcacttctgcttgcttcctgtgaagtgtctgccctactgaagtctcatactatcaagataattgttctctcattcttgcttctgagaattattttctcaatcaggaaagagtaacacctgcgaaatagagctacatgttttcatgaggctattctatcaagaaaggatgtctttgtaacataaacaaacacaaaaatcatctgtctatatgaacagtgttccaaatgtatgaatcatgaattacaaatgtataaattacatgttgttattttgtagaatttttagttttccttttctgtgttttagtaaatgtgttcatattatgttatttatggttgtattttatgggaaaatatgtgcctcattcattcacttatcactgtgcaggggttcaaggacagggagttttgttagtatcgacagttgtgatctcatgatatacttggctgattgccatcaaaccagtcactcaggggacttaagaattctgatctcatacacaatgtacttggtctcagggataaaattcacactgcaccccaacttaaaactttttcccgtgttgctttctcaatccaggttcacaccttctatttattagaaatggtatgagttcctgccttttagctgacacttttatctgggtctccctctgtaaggctaaatgcccttgttagaatggcacaacaacaacagcaacaaaaacagaagagaaaacaaaaggaaaggaaaggagcttgtatccccagactcatgctgtgtggtggctggtttgtttcttctttcttcagcacatcactcctgtgacatgctgtgcctcagactgcttgactgaccttgccgtttagagctgttaaacctgaatagagcagagcttttcttttcccttccagtaggtctcaggagtgagatctggtcactggcatttattctctgacccttaactgtggttccccttgaaatggagctaatcaaggtgttgttccacttatttattgatgctcatgaagcattcattgttggtacatataattttgcctattcctatacttgaataaattctttcttctacctaaactatggatgtatgtctacatctctttgctatttgtagattagaaaatccagaaaggcagtctaacagaattctttttgtgctgtacctagcaaaatgctctacacaattaagtccttactgcatgcatttagctacatgcatttaattagattgcatatgtacagataggtcccttgggccttccagagcagtagaggctactttgcaaaatgatgcaggccaaaaaggatttaggtcagtcaaatttttatctggctttcccagtaggatagttgaaactgcctttctacttgctataagaatgtcttccatgtgactttttttttcttctcaaattccactgttagctagtcagagattgtgcactttatatgcttcttgtcaaactcatttggtatttgaaatcacaacgcctttatgattttcacccaagtggcttcagagttctgccacttatgtcatttataagaatttgcctggaaattgtttcctttgcaggagacataagtcacagggtttaaaattgaaaaggatctcaagggctgattctgtcactcctgctagccctcagtcaaggttgtgcttaatctaaacccaagactaatatgtttctctaaaataaaactatgcctcatcattggtttgttaaatactctacattgtcaatagagggatctctgaatgagcatgtaactcctgggtgttaaaaaccttcaaaagctctacaggttaaatttcaaattctttagcatatcattcaaggtccttcttagagatctattccaaatgaccttttttggccttgcatctcactttttaccccctcttaatctactttcaggattcgctgaattgattctctgttacctggacttatcatagaagtccatgattgtttctttgctcacgttgctttgcagccttgaattacctagatgctcatttcaaagatcagctcacacgagcaaaaccttgaaggatttctccaaatccccaaggcaaaattattctattttctgtgttcccatagaaccttgttcctattgctgttgctaactttcaacctgttatcatagtggtgccctcacatgcctcccattttagatgagaagctttttcacaatggagacatcacatttctcattgttcctctgagacctaccaaagtccataatacaaccattcattctataaatgtcttgaaaaattgttaaatattgatgcagtaggataaagggctatgaatttaatgatgctctattgaatgaatctttgtgacatgccttgtatctttttctggaatataatgaggatataaaaatattaacataatctcttgcaatgataatctctacaagtttataaaaatcatgggtccaagattatgctaaaaataaaacccatttcttccatcccatgtttatagcacacttctagttggaccgttatttgaaaggccccagatttaaagttaggtttaaagatgttctaaaatgtcttcacttaaaaaacaaaaagacaaaattaatatctaagcaatctttaatttctagaaatttatttttacagtgtagtataagctctcctggtactgttaaagctatttctttacttataattttaaaaataacttttcacattactaaaaacaaactactaaacatttttcaatgaaatataaatttctttatttgggtcatttttaatgtatcctaattttccaactgttaattctttccatttctgtcctctgtcttcattttaaatatgattcgacatgtgaaccctaatgtatgctagccaaatactcattaaacccatgacaaaaacattctttaattttatctgcaaattcttagataatgtgtatcatttaggaattgtgctcagtgtgtatccagagtggcctaaagaaattggtactttatttttccctcacaagatatgaagtcttgatgttggtagtctgctaagatgacctctgtaatgttaccagagatcttggattcttgcattcattctaggattcttgtactcaaaatagctgtcagggttccaatcattataactacattttgaacaggcgaaggtcaaagagcataaatgtgccaatagcagctaagaaaggagagattagacactggcgaggcacctttcaggttcaaccacattcgtcaaaaaatcatgttttcttaacttttggaaaattgattttgtttcttacttatgttgcaactttgtactattttccagctcttttaatgttgaagttctgcctaacttatagctgtgtaattagttcttacctatgcactttgttgcttttgttcactttcagcttttaagctagtatttttttggattataacatgatatgtattttttgtggaatatttggaaaattagaaaaaatgtaaaaaagaatatgaaaattacttacatttttacaccatttagacgtaacaatgttaacatttcactgtatagtgaattgttatactgaatttatatacatatataggcacatgtatttacatatatgtaaattatgtcattatttacaaaacaactttattctccatattattttagaaattattgatattgttttgaagattagattttggaatataaataaatattatttgggacattatttttatgactacatggcatttcatcatatggacaagccataatttacttagttgatccctaattgttgcttttatggatttaaaattgtagcattataaatgacacggatgaagtactttgaacgtgaaattttgcctgtatatcttattatgtcttagaataacttgatggaagtggaatgggtcaaaaagtaaggatatgcaaaggaaaaggcagcatttcttcagaaactaggaaataatgaagcaaaaggtataaattatgccatgctttattgtgtgtttactgggaatggagtgcagtgaataaagcagaagtgttccagttttcatcccagaagacagaagagccaatattttctcctgtttcttcaggtagcgaggggccagtggtgaaggagctgtcattgaacactcttcacgttggctggtgactgcttggaacaatcattttgccacttctttaaacattcaatgaaaaaaaatgaaacaaagggaacaaagaattgacagacaacccacttgaatctctcgagaccccacttgagaacccacaggtctctggcctctcctcaactggttgaataaaaaggaggaatggatgatagagtattcagttaggaaatgcaacaacatggcacctaaccatgatgtagagactggatatggaattacgcagtgatataaattggctgatgaagtacagagaggttatgtttaaatattggttgtgtacaaatcaggggattctgatttgtcatgcctgtgatcgaaaatatcatgagatcattatgaagtagtatttacaataagaaaatatgcaagggagttagtggccttgaaggtcaaattaaaagagagagagagatgggggtgacagggagggaggaaaagagggaggacatactagggatgacttttgaagttatagattaatcagtttgctttgatatttatgaaaataataagacaaaatgatgattgatttccatacacttctaagagcagaaaaaatggggtaacagccaacatgtctgagagaagtaaataactcagagttaatgtaattttcttctctaacacaataacagaacttaaatatgagaggacaaaaagttcatatatctttacttcggtaaggtttagtttttgtctgacatgctgttctgatcaaccagcaaagaatatgtagtcttgtgtaaagggaggcatagcttgttacttgtccctgaatcagtgacctggtagagcaaacaaagtaagactaaaagtgtttattggggacttgtactgaataatatttgtaataatctccataatttaataatacaaaatgtggaatctacagactaggaaaattgctaaatctatgggaatttgcaggaatctaaagtgaatatgggaattaaaaaagagggactgaaataagttggctgtgtatgagaaccattgattaaaatggcattaaaaatggtaatatctagtgttgctgagacgttttgacacattgttgctataaattggtgatgagacctggaatagttgtttgtattgttcagggggatttgtagtgtttcctgccttaattacatcccttatcctgtaatgaccatttttttctatgttctgagtttcaagattgtaacacatcttcctctatttgtaagcatttttctttttttagctcaacaaaatgaataattattttactaaagttgctttgtttccatgcctttccgtataaacaatttttcatttcagtgttacctttttgtgtaatcttttagaagacattttgaaaggtaattaaactcaacatgtagaatacctagagtgcatacaactgaaatgaaggcatgaccatatgcagaactagggtcaagttggggcatcagcaggcaacaaacactttgtcatgactataactggctgcagtaattgtaaaatataacctgatttggaagatggtcaaataggaaagttgggtacatcagtttcataaaatatggtttaacaagttttaacagtctcatgctacttgacccagaaatcccagttctgggcattttatcctaaggaaacaatcacgctgtggcagaagatatatgcacaaggaccttcacagtaacttctttttgccacaaatatttgatgataatttatattcagaaaataagtaaatgatggcatgccatagcaacaggatattaatcagtgatcttgcagtgtaatgataaaaaaagatattgtcacacaagaaattcacaattaagtaaaaagagaatataatcataaaatagtttgtatgatataattatttaaataatagtctgcgagtaagaacaggatagttgtttctggaattaaggatgattttatatttttatgttttttcctaaattaaaaaaaacttgccactttcgatttagaaaactaattgtataaggaaaaaccacttatattgctaatctttaaagactgataaccttttgtcttttttctttaagtcctgactactttcacttattttttgattaccattttattatttaactttacattgcttaattttctgactataatataatgttgtttgtgtgatttattttaaaactctaaagttggttttacatttgttctcattctcctgtattttatatatttaataggtatatatcaatgtgtaaattatgaataaatatatctttcatttaatctgaatatataaatattaaatatatatgaagatgtaaattgtatatacataaacactaaatgatatatagtatgtaagctatcactctggatttctcactatactaattattcaaaaacatttatgattttgaattattttttaacctttactttttttctgatttatttatttttaacttttagcttcaagggtatgtgtgcagatttgttatataggctaattgtgtgttacaggggtttggtgtacagattatattgtcacccaggtaataagcatagtacccgataggtagttttttgatcctcaccttcttcctacctttcagcttcaagtaggacccagtgtctgttgttctcttcttaaaaatactttctcgatatatgtttgaatattattctgtaattcctaaatataaatgtctagattaaaataaaaccttttatttttatttttaccttgttgcataattttaaattttgacatactttcaaatgtacagaaaatttataagaattgtgtttaagaataccttttgttcagattcaacagttgtttacaattttgcctcttttgcttcatttctgtctgtgctttctctctatgtgctcatgtgtgcatgcacacgtgtagacacaccacattttttttcctgaatcatttgagaatcagttgcagacatcatgcttccttaactgaagtgtttaagtgtacatttcctaagaaaaagaatattgccctctataaccggtgtgtaatttttaatgcaatattcacaatatattacttgtattgtgtaactcccagtatatttctaggatcccaggtgtattttgttgtcttatcattaaaagtccttttatctggaacatttcctcagtctaattacttggtcattataagagttcagatcagatatggagcgcaatattctcaatttggctttactgaatgtttcctaatggttaattctgttttgcatttttgacaggcataccacaaaagtgatgttgtgttcttctcaagtgcatcatacttggaggcatgtcgtatttgtctgattattgatgatgttgtctttgatcaatttgttaaggtggtctctgccaagtttctccactactagttactattttccccattgtaattaataagtaatttgtgggaagatacttttagactggaaataccatgtttgtcatcacactttcatgcgctggtgctgatccactaatgttttctttactgattcaggtacctaaaatattatggtggttttctaactccatcagtccatctatactttttagttgacattatactcgaagaaggagttttcccttcttaatttcatactttattatattttccttaatacagtttaatccattacaataattatttatttcccagttgtcccagattaaaccagtaaaagcctcttgaagctaggacctgtgtccttttgacatattcccatcattttataaatgccttacttgcttttcttccagaaaaaaatgccacctcaaatgtcatgtatttttaagtcttctctctgtgtccatgttctaatatgccagaatagtttttcagaattttcataggttgagtggattttttgtgagtgattttcatgtcactgttaggaattctggtatcctttacctttttcacagtttttctggaccccatatatctctgtatatagtgggagcttgaaagatagctctgttagaaattggtgtctaattttctgtttacatacaatctgacatgtttattattctccagcttccaattgtgccgaaggacttggatttgtgtgttttaatttgtttttttaggtgtatatattttttaggatatgtgaacagtttcagatttaggtggctcctactacctgagttcctcagaatgccagtccatatttttatgcattctgcaaaatatattgatatttgaagacaattgcaatatgccattgtttaaccaaaatttatggattgtatagctttacctttagctgttagtgttatcttaatccagtttatccaattaaattgaagtgtttaatgtatcataattattttattacatagtatgcctatcaatccaggaaatagctctctgaaaggcatgtccatggtaaatgtaaaattattatatgaggtctcattctttcacttgatgatgtactaatcaattgtttgtaatatttttcccttagctatgaaaattatcaaatatatatttaaaaaataaaaaatattcaaacccacaaaattttaaaacatatatagattgaaataagataaccaatcaatagcatgtgattataggaatctagtgaaatgtagtattgtaagtggttatttcaattgacaaaatacagtttttgagaataataaaggtaaattcttcctccagttgcacagcaaaaaaaaaaaaaaaaaaatgatggcaattcttaataaaggagggcttggatctggtggaaaacactccagtatttaaaattgtcagagtaaaagatggtttgtaaaagtaggaagtagatgaggggcaaccatttttctgttccatacctgagtctagccttataaaaatcttcactttttcaaaaaacctacatataaggattttttatgagaaatcttctgcttttgaatattatgtaatattttaaaaaccatggtgtgggacaaacgaaatgtatcagtaagccagatgtggttttcatgcccccagttttcaatctctgctctggatgcaacctagaaactagcagatattgcggtaagatgaaacccaggtcagaaaagctggttttgagcccaggcttgcctcctattggctgtgtcagattgagcaagtgatgtaattagtgttcacctcagtcttcttgtctatgaggatgaatatgctaaagtatgaagaaatatagagatttactaattgttataactttataattgtattgaattatatgtgaagaagaatatatatcttttattatgttttaagttttaaacttagaaaatacaaagtttcttgggcatttcttgatttttttccatttaactataaacttgctaactatatttagttttctctgtttgagaggttctgtgtgaaacattagcaaaatcatttattcatgggccaggtagagacctgtgcaatcccaatgtctttaacatactagaggaagataaattagattttatattcaaaatgcttggtctgaatattgaactgttgatttggttacagttggttttggtgaacacaaaagcacaacctctgtattatttaactgctatttctgcttagtaccatcaagacccagatctctcagcagaaattctgtttgttgctgagaacttaatattcctttaaagatgtttggtacttaaggggatttttatttatattgttcatagtctgtctgatctgtctgaaagaacacactgtatttttgaagggagatatatacatatatatatatatatatattttttttttttttttttgagatggagtctcattctgtctcccaggctggagtgcagtggcacgatctcatctcactgcaacctccgcctcctgggttcaagtgatggtcctgcctcagcctcccgagtagctgggactacaggcactcactaccatgcctggctaatttttgtatttttagtaaagacagggtttcgccatgttggccagactgatattttcattaggttgtattttattatatgtctttgaacagttcttttataacaccgtatatactccgtagtgtaaaacccatttaatttgaaatattttgagattcaaaatcaatatgctctttcaaaaccctactctaaaacaaattaattaataatgcttgattaaatcactttctcctcataatcacattgatattctgaaacacagagaatggaactgtttgtgtatttttgtggggtatgcaggtcgtgtgcctgcatttttctcagtgcatggatttcaattagaatttaaatgcagttacaaagtgaattggtgcaactctctggataaatcaagccaaattcttttctaactcagtgatcctcatatgtcagataatagtaccttttaaaaacttgaaatatttgaataatcacctcaactctccacgtatatttacttatgaacatctcatatttttgaattacttttatgccattctgccaatattctggggggcactgtgtttcttgcatataatatgaagctagtatgcagacttctcttacctctttcttcaaagtgttctccttgactgatgttttggaatatttgcatatagttgggaatacttctgttcatcagcccattatactttggtagatatatggtctacattttgtaaaacctatttaagcacgttaaagtatatagtgtttaagtgtgtgttggtctgtattagtttttctgtgatcttgacaaattgtttactcttttggattttttcttcctccacagatgcatttttgtagaagcattttgaggatgaatgtttgcaaatcattttgaaattgccaagtgccacatacagtaagtaatatttttatttttctactcaattgcagtcatgttcgattaatttggcagacagtcatgaaagaacccatttctatttacagtctttgatattgtcaacattgttaaagataagaaggttgtatgtgtgcagcattatttctggggtctttattctgttccattgttctgtgtgtctctttttgtatcagtgccttgcagttttggttactacagccctgtggtatagtttgaagtcgggtaatgtgatacctctagttttttctttatgcttaagattgccttggctattttggctctttttggtttatgaattataaaatagtttttcctaattatatgaacaatatcgtttgcagtttgataggaatagtattgaatctgtaaattgctttggacgtcatgaccattttatcaatcttgattcttcctgtccatgagcatgggatgtttttctatttgtgtcatgtctaatttctttgaccagtgttttgttgagaactttctcctccttggttagctgtattcctaggtattttattcttttgggggttactgtgagtgggattgtgttctcgttttgctgtcaggctagaaattgttgttgtagagaaatatacctctgccctgatgaagtgttctggccaacactacccatcagagtaaatgagtattttgtgactgaatttcaaatttaaaaaaataagaattgccttatattcagtgtcaatagaaccaatcagcaacccaaaatgagttgccttgaacaaaatgctatttgattagagaaaacttaaaaatatataacagctcctcccctaatggcagatataataccttactcttctattatacttttcagcatttgcagtggctgaccacagccttttcttgcactcctttttagttgctttttgcagtgaagaagagattgcaatgaagggttgagcttgacttaccattctcttccctctttattatcttcagatgtgtagtgttcatagtactatcctttacatcacactggccacattgatgctttcccttttggactctggtgatcttcaaattctttcacgttagccatccattggtcctaacccctgtacactttatttcttgaaacaaatcatcagcaacattttatctggggacattttcagaattactagtatttaaaagattattgctctaaaattgaatggattaaatcgttcatgctcccacactacttttggttttgagactgaaggatttacagagggatgagaataagagatgaagtctccatttctagatttgacctctggaagacaaagctagtgattttgtttagtaattttatttcctttggttcaattaatagtccatgctcctaaatgtgagaggtactgtgttagtaaggactagagtaagtgggagagaaagacaaaaagaactctcaaggaaactttgtcattagtttgaggaaactatttttcctcaaactaggaaaaaggtatttttaaatgttattctggtgatatcttcaaactggattgcagttggaagacttgttgcaaaaagatcaatttttaagcatttgtagagggataagaatgaagggatgagggcaagacctaaggtcatagcagtggggatggactggcaggggttggagcatgtgagatttatttggaagtaaacaggttcagggagtaatagtaataattaatgcttgtgcaggattcactgagtaccagggttgttttaaatgttaatgactaatgtcatccccattttgtgcaagaggaaactgagagaggcatcatttaagcaaattgtcccaggtcacaaaagtaaaacataccatgcctgacatttggggccatttagtcaagctccagagtcattgcagtttaccagtgtaccatcatttatctaaaaaaataactgaagcttccaggattactgagctggaaaatgatgttgccaataatcagagaaacatattttgtttacagagtttaccctttctttagataggtttttggatagccagaaaaatcttgacctttagggagaaatgtaccttatggttagtgataaatctcttgtatatattcacttgttgggcaatagcaacagtaatttattatattattcaattataagttacgatagtaaacatgtcatcttaatctgatttgtcttccttccttagtagaacttaaaaatgaaacaaggatagagtggtaaaaaaaaagattttgtatcttgggtccgtaaaagaacgcattttaaagttagtttaccgatcatgcaaaactaattttgacgagggaaaaacgtaacactcagcatatggagtatctctttttctattaggttaatgtaaaagtaattgcatttttgccattactttgcaaaaactgcaattacttttgcatcaacctaatatactggagaagtagaataatatactgcttaagaccatggtctccaggaccattctgcttcattgattcatgttccaagtaaggcccatttgctgtgtgactttgtgtcaattattgatgctctctgtgcgtcagcctctgtaccttcaaaatgtgttattaatagtactgtgtcttctggatattgtaaagcttaaatgagataaatcacctaaatggctcttggtagcagcgaattttaaataaaagttatgtttattaaaatttatctcaggtaacagttttctatttttcaatttcacctacataattattactcttttaagctttttgctttgaatttttacgcattaaggagacagagcaatgattttcacaagcaaagacccatgtaaccatcccacaggtcaagaaatagaacaattgctgcatctccaatcctactttttctgcctgccagccattacctcctttccatcagtttcccgtggatgacattattcctgatatttgtgggaattacttccttgcttttcattatagttttaactttaaataatgtatccttatatgcaaaatattggtttagcctgatttttaaattaatgtacataatattcatatgacacacattcttcagtgtatggtgtccttttctgaatgtatgtttgtttttaagtttctttaatgtttttgtgtggttcattaattttcattgctatatagtattccattgtatagaaatactacagaatatttattcattgtattgttgatggacatttgtgctctttctaggtttgggccattacccaaatgtaatgctgccataaacattcttttaaatgtgtttttgctaaatatgtacatatatttctcttgaatatatacttagcaatggaatttcttagtcatattgcatgcaatctttcaactttagtagatactaccagacagtattccaaagtaactatactaatttcacttcattcattagtgtgtaagagtttccattgtttcatctttaccaaagattagtataatcatttcttttaattttagccattctggtgagagtttggtttacattttcttgttgattaatatgattatgtcatgtagcttaatagccatgaacatattattgtctataaatttcctgttcatatgtgtatttttctattgtgttgatttttaaaattgttaatattcacaagttagttacactagattaagagcctcccatcagttaaatatgctgcaaagttctccttttctatgatttggtttttcaatttcttaatgaggtttttttgatgttcctaattttaattttaatcattatatcacctcattatgtttatatctttccacttgccttcatttttgtgagtgatgtgaggtagaagtcaagttctagatatccagttgttatagaatcatactggacaattctctccttcgcccactgttctttaatgtcatatttactataaattaaatttctatatatgtctgggtcttttaggagccaacttctatttaattggattattagtctcttcttaccacttataacactattttaactatggctactttttaaatattcttaatatctattaaaacaagttcttctaccacatgttattcaaaggcatgttgactttgccttctttcatgtaaattttagaattactttgtcaagttaacaagaataattgtttagattttagttagaattgcattcaatctattgttaagtaaatttttaaagagctggtgtaattacaatattaactgatttcatttatgaacataatatatacagcatttcctccttattaactggggacacattccaagatccccagtggatgcctgaaactgcaaatagtactaaaccttatatatagactatggttttttctatatatacatacctctgataaagtttaatttataacttaggcacaggaagaaattaacaacaactaataataaaatagaacaattataacaatatactgtaataaaagttatgtgaatatagtctccttgtctctcaaagtatgttattgtactgtacttaacctgcttcttgtgatgatgtgagataatacaatgcctacatgatgagatgaagtcttgtgaatgattttggtcataactttcatagtttgaggtgcaacagcaaaactaacataaatctcttgttctttcttcacaatttcaaggacagaagaagcattcttaccatagagcttagcaacgtgagcaaacaactttttccctttattattttcttaaaggaaacactttatggcttctctttggcatattcaaattgccaacatcaccagtcttgtaatttgggtccattattaagtaatataacggtgacttgaatacaaacactgtgataactttagcaatcaatctgataaccgatatggctactaagtggctattgggtgggttgtgaatgtagcatgaggatgctggacaaaggaatgattaaagtcctaggaggaatagagcagagccatgggaaatttcatcaagctacacagaacagcacaccatttaaaattataaattgtttatttctggaattttccatttaatatttttggaccacagttgacgatgagtaactggaaccatggaaggcaaaaccataagtaaggggggacttatttattttgatcttttagtttctcttaatcccatgtctggttgtttttttttaatgttgagttcaagctaatttttctttttttctttttttttaaattttattattattatactttaagttttagggtacatgtgcacaatgtgcaggtttgttacatatgtatacatgtgccatgttggtgtgctgcacctattaactcatcatttagcattaggtatatctcctaatgctatccctcccccctccccccactccacaacagtccccagagtgtgatgttccccttcctgtgtccatgtgttctcattattcaattcccacctatgagtgagaacatgcagtgtttggttttttgtccttgtgatagtttgctgagaattatggtttccagtttcatccatgtccctacaaaggacacgaactcatcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctgaggaatcgccacactgacttccacaatggctgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcgttttttcatgtgttttttggctgcataaatgtcttcttttgagaagtgtctgttcatatcctttgcccagtttttgatggggttgtttgtttttttcttgtaaatttgtttgagttcattgtagattctggatattagccctttgtcagatgagtaggttgcgaaaattttctcccattttgtaggttgccttttcactctgatggtagtttcttttgctgtgcagaagggttttttgtttagaggtcttatgtattttggttaatttgtgcctagaagtttaatgcagtttaatattaagattatatatatacacacacacatataattatatacatatgtatcatatacatataattacatacataataatacatacatattatatacacttttttaacttttattttaggtttaggggtacatgagcaggtttgttatgtaggtaaacttgtgtcatgggggtttgttgtacagattattttgtcactggaatactaagcctcgtacctaatggttatttttttctgttcctctacctcctgccaccctctatcctaaggtagagttcattgtctgtttttcccttctttgtgtccatgtgttctgatcacttagcctccacttacaaatgagaacatgtggtatttgttttctgttcctgccttggtttgctaaggatgatggcctccagctccatccatgttactgcaaaggatatgatctaatttttttgtgtgtgtggctgtatagttttccatagtgtatatgtgccacattttctttatccattctaccattgatgggcatttaggttgattccatatctttgtcattgtgaatagtgctgcaattaacatatgtgtgcatgtgtctttatggtaggataatttatattcctttatgtatatacccagtaatgggattgctgggttgaatggtaattttgtttttaactctttgaggaatcatgacattgctttccacaatagttgaactaatttacactcccaccagcaagcagtgtgtaagtgttccctttcgccacaaccttgtctgttctgttatttgactttttcataatagccattctgactggtgtaagatggtatctcatggtggttttggtttccatttctctaatgatcagtgatagtgagctttttcatgtgattgtttgccacatttatgaaaagtgttggttcatgtcctccgcccactgtttaatggggttgtttactttttcattgtaatttaagttccttatagatgctggatattagagctttgtcagatgcatagtttgcatatatatttcccattctataggttgtctgcttactctgttgatagtttctttttctgcacagaagctcttcagttgagttagatcccatttgtcaatttttgcttttgttgcaattgcttttggtgtttttgtcgtgaaacctttaacaggttcttcatccagaatggtattttctaggttgtcttccagagtttttatagttttgggttttacatttaagtctttaatccatcttgagttgatttttctatgtggtataaagaaggagtccagtttcaatcttctgcatatggctagcctgttatccaagcacactcccattgaatagggagtccattcctcattgctttcttttgttgactttgtggaagaccagatggttgtaggtgtgcagccttaattctgggctctctattctattccattggcctatatgtctgcctttgtaccagtaccatgccatttttttattgtagctctgtagtatagtttgaagttggtaacataatgcgtccaactttgttctttttgctgagatatcttgccttggatatttgggctcttttttggttccatatgaattttaaaatatatttttctagttctgccaataatgttatttatagtttgatagggatagcattgaatctataaattgctttgggcagtatggccattttaatgatattgattcctcctatccatgagatccatgaacatggagtgtttttctatttgtttgtgtcatctctgattgctttgagcagtgttttgtgattctcattgtagagatctttcacctccctggttaactatattcctaggtattttgtcacagttgtgaatgggattgctttcctgacttggttctcagcttggctgtcattgccatataggatttttaatgtgatttttgtacattttttgctagtttgtacagattttgctagtaatttttgtacattgactttttatcctgaaactttgctgaggtttatcagtttaaggagctttcaagctgagattgtggggttttctagatacagaaacacatcatctgcaaacaggaatagtttgactccctttctttctgtatgtatatgctttatttctttctcttgatggatctctgtggccaggactttcaatactatgtttaataggagtggtgagagggggcatccttgtcttgtgtggcttttcaagggtaatgcttttgcccatttatgtgatgtttgctgtggttttgtcatagatggctcttactattttgaggtatgttccttcaatatgtagcttgttgagagtttttaacatgaagggatgttgaattttgtcaaacatcttttcagcttctattgcaataaacatgtggttttgacttttacctctgtttttgtaatgaattacatttattgatttgcatatgttgaatcaaccttgcattccagggataaagcctacttgatcatggtggattagctttttgatggcactgctggatttggtttgctggtattttgttgaggattttttaatctatcctcatcaagaattttggcctgaagttttctcttttggttgtgtcactgcaaggttttggtatcaggatgatgctggcctcatagaatgagttggggaggagtccctcttcctcatttttttggaataattgcactaggaatggtaccagcccttctttgtatgtctggtagactttgtcggtgaatccttctggccctggctaggcttttttttttttggttggtagactatttattactgattcaatttcagaattcattattggtctgttcatggattcagtttcttcctggtttagtcatgggagggtatatgtgctcaggtatctatccatttcatgttgatttttgagtttgtgtgaatagaggtattcgtagtagtctctgatggttatatatgtgtgtttctgtagggatagtggttattgcctttgtcatttctgattgtgtttatcttctatctttttctctttattagcctagctagtttctatccatctttttaattttctcaaaatgccaactcctggattcattgatcttttgaatggtttttttatgtgtcaatctctttcagttcagcattgattatgtttgtttctggtcttctgctagctttggagttgatttcttcttgcttctctacttcttttatttgtgatggtgggttgttaatttgagatctttctaagtttttgatgtgggcattttgtgcttcaaattttcatcttaacaccgccttatctgtgtcccagagatcctagtacgttgtagctttgttcttattagtttcaaagaccttcttgatttctgtcttaatttcattatttaccccaaatcattctgaagcaggttaatttccatgtaattgtatggttttgagtgattttcttgaattctctttttttgtgtgctgttgtctgagagagtagttgctatgatttcagttcttttgcatttgctgattgttttatgtcctattgtgtggttgattttagtgtatgtgccatgtggcaatgagaataatgtatattctgttgtttttggatggagagtcctataggtatctatcaggtccatttggtccttttgagttcaagtcctaaatgtctttgctaactttccgccttgatgatctgtccagtactgtcagtggagtgttgaaatctcccactattattgcatggaagtcgaaatttccttgaaggtcactaagaacttcctttgtgaatctggatgcttctcagttgggtgtatatacgtttagaatagtcaggtcttgtcaacctgaatcctttaccattatgtaatgccctcttttgatctttgttgatttaaagtctgctttgcctaaaattaggattgtaaccctagtgtttttatgttttccatttgcttggtagacatttccccatcccttaattttgagcctgtgagtgtcattgtatgtgtgataggtctcttgaagacagcataccactgagtcttgcttctttattcaccttgccactctgtgtcttttacttggagcatttagcttcttatattcaatgttagcattgatatgtgtggatttgaccctgtcgcagtgtttttagctagtttttatgcagatttgtttttatagttactttatagtgccacttgtctgtgtacttaaatgtgtttctgtagcggctggtaacagtctttcctttccatatttagtgcttttttcaggagctcttataagcgagtttggtggtaatgatttcccttagcatttgcctgtctgaaaagcatcttatttctccttcgcttatgaagcttagtttgtttgtatatgaaattcttggtcagaatttatctttttgtaagaatgttgaatatagacccccaatctcttcttgcttgtagtgctgtttctgagaagttggctgttagtctgatgggcttccttttgtgggtgacctgtcctttgtctcttggtgcctttatcattttttatttcagccttggagaatatgatgattatgtgtcttggggatggtcttcctgtgaagtattttgtgggggttctctgcatttcctgaatttgaatgttggcctccttggctagataggggaaattcttatggatgataacctgaatcatgcttcccaagttgcttccattctgcttatctctttcagggatgtcaatgtcatagatttggtctctttatataatcccatatttctctgaggtttggtttgttcctttttattcttttttctttattcttgtctgactgtattatttcagaaagtcagtattcaggctctgaaattctttactcagcttggtctaatctgttgcttttacttgctattgcgttatgaaattcttgtagtgtttttttcagctctataaggtcagcttcatgcttttctatactggctattttgtctatcagattctgtgtcattttattatgattcttagtttccttagattgggtttcagtgttttcatgaatcttgaaaatcttcattcttatccttattctgaattctatttctgtcatttcagccatctgacctcagttaacaactcttcttggagaactagggtggtcatttggagaaaagaagacactcttgctttttttgagctgtcagagttcttgtgctggttctttctcatctttgtgggtctgctgttccttcagtatttgaagttcctatcatttagatgtttttttttcttttatcctatttaatgaccttgggggtttaattgtggtataaggtgtattcagtcaattggattcatttctgcaagattttagggagtcaaggcttagctcaggactcccggactgtgttttctaattctgggtgactcttattgggcactggctttgttttctggcccctcatggttaggaacctgttgcacaggataggctgaaatgttcctgaactgctggtcacaatacttgtatgcatggtgccagccaaagctctttgtagggcagtggcagtggaatctatcctcatttgcatgtgctagcaacagtggcagcagcagcatggccaagtgcacacttgtcagctgtggcagggtggtagtgggtgctgggtagccagcaggtgtttgcagcagtggtgatggcagtattactcagggagacaggggtcctccactggcaactgtgcatgtgtttatgccagtgttggtgttagcatggtggtgggggtgctggtgggcgcaggactgtgcatgccctctatgcatgttcacactggtggtggtggctgcctaggttgtgggcaagctgtctgttttccctgcctagtttcactttggcagcagtgtcagtgcaagtggtgggtgctgctggcagcagggcaggcggctttcatgcctgccaatgctctgaggacaatggcaatgtgacaggtggggtggggggcagcatgcatccatgtcaacagcagtggtatagcagggtgcgtgcacacacatatggtggcagggaaaggaagggaaggtttgtctgtgcacacatgtcctgtctcatgggcaaaacagcccttcagagttcaggttggacagttcccctaaggctaaagtctcctatggaagcaagttgagcccaggggaatgggcagccctgaccatgctccgctacagacactccaacaccaaatcctctgggctctgcattggctggagttctggctctaacacttttctaagttactctttctgccaactgaagggtccatggtggtagaggggtttcctactgctgggattccagagggctgtgatgagagcagcttgctccttgtgtgttcaactcctactttctgcaggagttcttcggggccaggaataagtcctggtgaacggcagtcccatgcagggtgcccagtcccctctcccttcagtccagcatctgtgtcttccctccatctgttctcaatgccttgcctctgaagatatgctcagaggactccagtctttctgatgttctggtcccttggagggagatgttcctcctagctgtgtctagttggccatcttggggtaggcaagatatatcttaaaaaattattttctctttgttccttgtataaaaatacatgtttaaatatcgcccttgcatatagtagattgtaaactcattaattctagtgtgtttttcagtgcattattttgaattttctatgtaaacatccatgttgtctgtgaagaaagatagtattacttaacactttcaaaatcttatagctttattgtattttctgtgtcttattgacttggctagaatgtccagaacaatgctgaatgaacacaggaagaatgaacattctgctcttgttcacaaatcaaagagaacactgtccatcattttactgttaagaatgatgtccttgaggtcaggagttcgagaccagtctggccaacacagtgaaaccccgtctctactaaaaatacaaaaaactagtcgagtgtggtggtgtgtgcctgtagtcccagctacctgggaggctgaagcaggagaatcatatgagcccaggaggcaaagttacagtgagctgagatcacgccattgcactccagcctgggcaaaagtgcgagtctccgtctcaaaaaaaaaaaaaaaaaagatgtttgctgtattattttgagaaaatagcatatatttgattgagagaatctagttttattctgattttgttaggattcttaattatagttaggtttttaatttttatcaaatgcttctgcctgtattgagattttcaaattatctcaaacctattgagattatcaaattatctcttttactttcttatccgatgatttatattgatattattccaccccccaacccccgacaggcttctttgcttagtatggtacctggggcacatgatagttttttcagtgttttttttccaaccctttccgtcttccttgcatgtttgcataggggaggaaacctcttattacattctggacaatcctccagtggtaaattgctgttgcatactaatatactactcctggtgggggacaggagggtgcctggatcctgttctccagtctttatcttagacatggcctgtgcacctgtgccttagatgtatggctcttacacaatacctacccattcctcccatggggcccaagctcctcctggagtctgtgggattcatgagtgggagaggtgtcctgctcttcccccagtgttagcagacctctgttttatgttagcttaagattctgggcacaagaaagttacctgcccattcagcaaggtttgatggatcattctaccccttcctgagaaactatagctcttttccagggtgttgggaatatgaggatttttttcaccctaaaaggctaaattttgctttgtattagagaaaattttggggaattggtaaggattttgtgactttatacctccaaagagttctcactggtctctactctggactgaatctttcctcataaagaagtttatgaatgaacacatgtttatttgtatataggggattcctgggtgtctacactgttctgttggccaattctgatccttaagtatttgttacacttttagctgttttcttcttacctactttcatggtgactacctcattctctcttattctgttaaaagtgaaatagttcatatgtcctgtcactcctcagagtggctgttaccctctgaaattttgttcatctctttgcctggtgacccctgccctctgcatagaggaagcctgatcattatcatcatgggctgaaattatagctcctagatcattaggaatctagtctccttttgtagttcttttccacagtcttagctacataacttcatccacaagagttttccagtagtttgagatgacttctgcagcctagccatcacatttgtgttctatgcagcaagaatgaaaaaaaaatgcaatgacaaatgaggcatgcagccaggtgatttacccctcatcaaagagattacctggaaactctttcttatattttctacctacccatcattactcttagttgtaaaggagactgttgcacgtagtgttgtagctgcacacacaactgttttgttggttacctagtaaggatgaagggaaagatagatatttagtaagctcttagtggtcatagtcacaaggagaggataggaattacattgaggtgatctgatcttttcttttctttttccttccttccttctgtccttccttcctcccttccttccttcgttccttccttccttccttccttccttttttctttttctttttttttttttataaggtcttgctctgtcacccaagctggagtgcagtggcacaatcatagctcactgcagccttgacctcttgtactcaagcaattcccttcctcggcctcctgagtatccgggatgattggtgtgtggcgttgtgcctggctaatttttaaatttttagtagcaatgaggtctcactatgttgcccaggctggtctcgaactcctggcttcaaacgatcctcctgcctcagcctcccaaactgctgggattacaggtacaagtcactgtgcccagcctaggtaatccgatttttgaggcaggatggagtgagttaaaatgcacaggttctaacatcatacagaactattctgatctcagttcagcaaatactagctgtgataccttgagcaaggtttttatttggttatacctcctcagctgtaaaagggcatgatataactgtgtttaaatgtttcggtgtggatagaatatgataatatattcaaagggttcattgcataggaaatagtcaagaaatggtatatttagtttacctatcttatattagcataaattcagtttaagagaggacggtgtctataaatgactaatacagattgatagagtacaaaggcaactaaccttgtttctcttgagtagagctttaccttttagatgggattgagtctcaatttctgttctttgatgtataatttctatactttgaattaaactgaaagattgctcaaagttaaggtctatgatagcagcactttatgtaatgtcaaaccaagaaatagataagaatttaaaggtttctctttaacctttgccattggtaagttatgaaactgacgaaagaaattatacacctctgggcctcagtttattcagctgacaagtcacttagttgatgagatgacctctaccacctatttaacagctttaaaacaccgtaattctgtgcattttttttttgcctaacacagattcttttgccaaaagaaatatccttgtctctgtttgtgtctgtgtgtatgtatttattcatattgccatcatctttaaaatatcttgaatataccatatgtgtattaagatgtgtaaagtacactaatattaaatatatggattgatgggtttttacgtagttatatgcctgcattactgctacctatagcggtaatatagaatcaggaacacacagaatatttctaacccccaataacttccctttacatctcttccccatcaataaccttctggtttttattattttttattttgactttatgataatataatttgaaaaaggtatgcattattttgaggggtaattcaaacttaaaaatttttctagaagtattaacaattatgataaaaccaaaaacgtctaaataatgctgaaaagtgcaataaactataacaatgatgttataagtaataaacttaattgcacatccactgaaatgaaacagaattgcagtgtgaaaaatctcttaaaattctatccaaatctcccacctgtaagccaaaaaatagagctaccacacaggctggtgagtattctatcagtcatgttgccaggcaaccttagtcagtatgagagacacccaattgagcagccttggagtcaaactaaaaggtatcttggaaacaagggttcaactgatagagagggaggatagaagcagagagagagagaaaaaagaggcagaatgtcaattaggcagttatctgttaatcatgaccacagtttttttttttttctagtaaaatgcagctagcttacagcaaaattacttggatttctacttccttctctctgttttctcctgcatgtacacatgtgtgagtgcagaggtttggcaagatgtatcatcattacttttttggagagaaggatgttcaaaagcatttttagcatactcaaaacatgttaactaggagttcattgagattttattaattcaggattatgtttgattcagccaagtttaaaataattaatctgatttttaaattgaaatactgtgtttgaaaaattgggaatacaaagtaaaaatatctttctaccacttgaactgaaatccttggaaggtaaaagaaatggaaagggagatgctcctaattctctctgggtgaacttcggtagagataacatacaccaatcaaacagggtgagaatttgggatgacaaagtcaagtaagcccttgactctgcaaagcaactcttaatgtggttttctagagcggtatcttccatttcccacagtttcattttcatagccaacctttgctactcccctatgctctaacccaccaccactcttctcccttccttcttaacagatcatgtgcagagaaaatagcatctgtgagacaggaaattttgagattcctactaacttaccagtgtccctaaatccttttattctccccttctattgatgcctcttcctctataaaccaattctttcatcagtgctctggatcctacagctatctgtgcatgttctaagggtgatagttcaaatgaatattttcattttgcatgttcaaccttgtccctttctcctgattccttcctcttggcattaaacatgtaaaaatatctttccccttaaaaccaaaaatgcatttgtgcataaatcttcaccttatttcaagtccattattagctacactgtaactattacctctactcatagctaaatgtctccaagatttttcaatattttgtgtcacattcattcacacctcaacacactgaggctttccttgtctggttgtctgaagctgcttcaagctcaccaaagttagttgtgtgacttatattgcatatagaatatacttctttgctcccttagcacaattttgtactattgatcattcattctatttcagaatattattttttgatgaaatctatattattgtacttctgtctttctcctcccttgatagcattgcccaatctcatttgtgtgcttatctttcttaaaatacatattctacaagattctttatggcaccctcattttctatcatacttagattctcactgaacaaattttatcaacttccatgtcttcaatttccattgacttgctgactccctcatctttacctcttctgatattcagtccctatactcacctgtcttctaggcagctctgcttgtatatcccatatgaaattcaaaaattattaaaatataccagcagatttgtgaataccactattttttctgttataaataattaaaatatatgtgatattgatatatataaacaacaaaatgaaaataataaaattaatgttcttaacaatgatgcagaccccagaaactttaatcttgagcaggcctttgattttatttagaacttctagattataaaccgtgaggcaaggtgtctcaagcacctaatgtgggctagggttgggagcatattatgtactcaaaaattatttgggaaataaataaaataaatagcttaatatttgaatgaatcttaaaggattttctttttccaagttgtgttaacaaattattttgctcatcctaatattgattacaataatagcaatggctaacatgtactgattaattacattgtgccagttcctctgattgtcatttcatatataatctttaccagaattctataagtagatataattcttattgctatgttataaacacgggaacaactggagttaactgggcaaattaacctcttcagtatcttcaaactgaatgtgtataggggttggacttgaatcaacattgtctaataccccattatatataatacagttatattatatatattataatatataacagttatatatattatatatagctaaatataattatatatatttatatatgaatttttagaaaaaataataccttctatattcctggttctttgatacagacattcatattctgatgtttttgctattagtaggcctcttcggattctcagtaggtgcacatgacttaggtgtcatcaattacgattatagtttggattgtcttgaaaaaataacttagaatatgcattcagaggctacagtaatcaaaacaggatggtactggtacaaagaccaacacatagaccaatggaacagaatagacaacccagaaataaggcacctcacctacaaccatctgatcttccacaaagctaacaaaaacaagcaatggggaaaggactctgtattcaataaatggtgctgggataactggctagctatattcagaagattaaaactgggccctttctttatactacataaaaatatcaactcaagatggatgaaagactttaatataagacccaaaactgtaaaaaccctggaagacaacctaggaaataccgtgctggacctagaaactggcaaagattttataacaaagatcccaaaaccactgcaacaaaaataaaaattgacaaatgggacctaattaaactaaagaacttctgcaaaccaaaggaaactatcaacagaacaaacagacaatctacagaatatgagaaaatatttgcaagctatgcatcgaacaaaggtcaaatatccagaatctttgaggaacttaagtgtatgaacaaaaaaacaacccattaaaaagtgggcaaacgacatgaactgacagttttcaaaagaagacatgtatgtgaccaacaagcatgtgaaaacatgctcaacatcactgatcatttgagaaatgcagatcaaaaccaccatgagataccatcttacagcagtcagaatggctattattaaaaagtcaaaaaatagcagatgctggaaggttgtggagaaaagggaacgcttatacattgctgatgagcatgtaaattagttcagccattgtggaaaacagtgtaatgatttcttaaagaacttgaaacagaattagcattcaacccagcaatcccatgtttgagtatatatccaaaagaatataaatcactctaccataaagacacatggacgtgtatattcattgcagcaccattcacaatagcagacatgaaatcaacctaaattcccatcaatggtagactgaataaataaaatatggaacatatacaccatgaaatactatacggacacaaaaaagatcatatccttagcaataacatggatggagctggatactactatagtaagtaaaataacacaggaacaggaaaccaaatactgcattctctcatttgtaagtgggagctaaacaagaacacatggacacaaagaggggaacaacaggcaccaaggcctgcttgagggtggagtcttggaggagggagaggatcagaaaaatacccattgggtactatgtttattcttgggtgatgaaataatctgtacaccagtcccctgtgacaagcaatttacctgtataacaaaactgcacatgcacccctgaacctaacacagaagttataataataataaaaaagaatgcttaagagtttatgtaagagtaagggagatagaatgcaagtagaaattatgaggaaatattggaatggccgagagatacagtgttttctccatagtagaggaagaaaatacagtaaatttggaaaagatggcagaaacaattgacacatggacaaacaactaacaaatatatcctgcagagccaattaaaaactgaaatataaaatccaggtcagatggtttttataattgaaaaaagactatggatggcaaataagatgaataaaaaaaggatattagaaatataataaggataaacataatttaaatacgttaaaatacatctataattttaaaaatatgaggagtggaataaccaggaattaaaatgacatatagaaaaaaatccatgtatcggttagtgggttttattaatttagattgctgtctttgtacatatctttcccagaaatgtgaagcaaaaaggaaaataaaatgttgattgctattctgctggagtagagctgaatggatgtgggaaatcagagaatttttgtactgattatggttttttgcaggaaggggagtcataccaatattttcttctcagtttgaacacagtttcatttcacagaaattaatagataagatactttgaactggagtacacctactgatttcttctgatgtcagtcagttgttagaatgtatttactatgcttttcaaaatcaaaagaaaatattataatcattcagccacataaacagtggaagattttccttggactaaacagatcttttgatcttgaagctttatacctttcccatttaagctatgaaaatatataatctttacagaaaatgtatggactgtttccttttagaattttatccttgtctcaaaaataaactataattagaaaagctgtctgttagtaactaattgcttctccctgctatcaaaccaattatagagactaattttaagaaaggaaactttatagttgaggcaaacttaggtaggtgataatccttcccccaacccttactctccaccttcccccagtccactatcatgtttcgcacagctaacttctggtggataatatggaaagaaaaattgttttcagaaattgctttaattagcaatgactggcatgaagtgataaatggaaatgaatattttagaaactcagagatatattatttaataattatattaaagtaataaggtcatttgaagtagcatttttatttttattttttattttaatttttaaattttttattttttgaaacagagtctccctctgtcacccaggctggagtgcagcggtgtgatctgggctcactgcaacctccgcctcccgggttcaagcaattctcctgcctcagcctcctgagtagctgggattacaggcgcctgccacagtgcttggctaatttttgtatttttgatagagactgggtttcactatgttcaccaggctggtctcaaactcctgacctcaggtgatcctcccacgtcggcctcccaaagtgctggaattacaggcatgagccactgtgcctggcctgaaatagcatttttagattagacatttaaaaacagaataaaatgtatgtattagttaatagctttattaattcaggttgctgcttttgtacatatctttgccagaaatgtgaagtgaaaaggaaaataaaatgttgattgctgttctgctggattaatagcaaattataatagaaccaattacattcgttatatactactactttattagttatgtacttttttggcttttgaataaaatcatactctaccttgcttacttttaacagggagagtattttcttcatgttgatttgattttggaatctgattttttttgttaaatctcaatcatggttgtttttatttttttttattatactttaagttctagggtacatgtgcacaacatgcaggtttgttacatatgtatacatgtgccatgttggtgtgctgcacccattaacttgtcatttacattaggtatatctcctaatgctatcccttccccctcccccgaccccacaacaggcccccatgtgtgatattccccttcctgtgtccaagtgttctcattgttcaattcctacctatgagtgagaacatgcggtgtttgtttttttgtccttgtgatagtttgctgagaatgatggtttccagcttcatccatgtccctacgaaggacatgaactcatcattttttatggctgcatagtattccatggtgtatatgtgccacattttcttaatccagcctatcattgatggacatttgggttggttccaagtctttgctattgtgaatagtgccacaataaacatacatgtgcatgtgtctttatagcagcatgtcaatcatgattttttaaaatttccaacttttatttttaaattcaggggtacatgtgcaggatgtacaggattgttacataggtaaatgtgttccattgtggtttgctgcacagatcatcccatcacctttgtattaagccgagcatccattagctattcttcctgatgcactccctcttcccacccccaccctcagatagtccctggtgtatcttgtttgcccccatgtgtctatgtgttctcatccttcagcttccacttataaatgagaacatgtgatatttggttttctgttctgcattagtttgctgaggatagtggcttccagctccatccatgttcctgcacaggacatgatctcattcctttttatggctgcataatattccatggtgtatatataccacattttctttatccagtctattgttgatagacatttagattgattccatgtcgttgctattgtgaatagttctgcaatgaacatgtgcctttatgtatctttataaaagaacagtttatattcctttgggtatatacccagtaatgagattgctggatcaaatggcatttctgcctctaggtctttgaggaattgccatactgccttccacaatggttgaactaatttatactctcaccaacagtatataagcgtccctttttctccacgacctcgtcagcatctgttgtttttttactttttaataatagccattcttattggtgtgagatgatatctcactgtgtttttgatttgcatttctctaatgatccgtgacgttgagctttttttcatgtttgttggccacatgtatgttttcttttgaaaagtgtctgctcatgtcctttgtgcactttttgatgccattgtttttggcttgtaaatttgcttaagttccttatagatgttaggtattaggcctttgtcagatggatagattacaaaaattttgtcccattctgtaggttatctgtttattttgttgataatttctttgctgtgcagaagctctttaatttaattagattccatttgtcaatttttgctttcgttgcaattgctttggcatctttgtcatgacatcttggcctgtgcctatgtcctgaatggtattgcctatgttttctcctaggggttttatagttttgggtatgtattcacatatttaatccatcttgagttgatttttgtatatggtataaggaaggggtccagtttcaattttctgcatatggctagccagttgtcccagcactatttattaaatagggaatgctttccccattgcttgtttttttcaggtttgtcaaagatcagatagttgtaggtgcgcagtcttatttctgggttctgcattctgttccattggtctatgtgtctgttcttgtacctgtaccatgctgttttggttactttagctgtatagtatagtttggcatcaggtagcatgaagcctcgagcttttttttttttttttgcttaggattgtcttggctatttgagctcttttttggttccatatgaattttaaaattcttttttctgattctgtgaggaatgtcaatggtagtttaatgaaaatagcattgaatctgtaaattgctttaggcaggatgaccattttcacgatattgattcttcctatccgtgagcatggaatgtttttccatttgttttgtgtcatctctgatttcttttagcagtgctttgtagttccccttgaagaggtcctttatttcccttgtcagttgtatttctaagtattttattctttttgtggcagttgtgaatggaagttcatttgtgatttggttgtatgcctgttgttggtgtataggaatgctagcgatttttgcacattgattttgtatcctgaaactttgctgaagttgcttatcagattaagaagcttttgggctgagatgatggagttttctagatttaggatcatgttacctgcaaacaaagatagtttgacttcccctcttcccattctaataccctttatttctttctcttgcctgtcaatcatgatttttttcaaattgtggtacactattaataggagacaacgcttttctaaagcagaaatcactacgcatctcagatacctcaagttgcatgtgattttaatttaaataatataaaaaagaataatgttctagggtccaagtatatgttttcaatatattaaaatttatttacatgagatgaatatacaatttattggtgtttttttcttttctgaagatttaattggatttgagggaaatacaggctgcaatggtgggaatagttaaaagtgagtagtcttttccactttaaataatcacttttaaatatggtcctgatggatttaaggttgtatttgtttaaacaaaagccacatatacaactagaaagagatagttcctgaattttggttaagagtccaggtttgaaaagttagccattttcttcaaaagaatgtggagttttaaaataatttcacatttgaggcaaattcttatctttccagagactgtaatactagagactagtaaaagttagaattttggaaacagattacttaaatcaggcttcgttttaatggggaattctgtcttccttttctttctcatttattctgttttgtgaataacccttgacagtcctttgggtctgttggtctatatttgcacggttttcatgactgtatgcgtgccatgtactcacgtacacatcggcacaaatatcagatgagtcagaaatttagtccgtatcactattattggtgattttcttattactttaaaataaaacatatatcttcctcattattcagataataaatactatttctagttactatataaaatcacaaaacgcattagagaagcacaatgaaaattcccacatttacacgtttttccaatgcttgtatatgaataagttaaaaaacagttgcaatcatagtgcattcataagtagacattgcaatttttaaaaatagtgtcataatatctcttaacttaaagtcttttctcaatatggggtatttaaaacagtgttcagtggagaaattactagttcaaagtatatgataatttttaagaaaatgggtcaaaaatcttatttttaataaacgctatttctttccaaaaatgtttttaccaatttatgtttctatctgcaaagaaagaaaggacccgtttatcccatctttgctaaaatataattttgttacaaatagtatttaattttgatttatagtcctttaatatgcacaattattaattaaattaattagaagttttgcagaatgataggggaaatgtcgctttgtttacaggttggcttttcatgtgcttgtacacataatggtaatctctgcttacctgttatatctcgcattatatttttccttttctcctatatttatggcagattttcttgttttttaacatctgtgttttctattaatggattatacactccattatattagttgctttatattgattgacaaattatcatctttagcaatattatatgacaagttttctttgctaataagaatatgaattttaagtccatgaggacttgaaacttttactttactgttaattaattggagagtattcaatatttggaatatttagttctttatgtaattatttacttctttcctctaattgcctgtcttttaaggcacttaacttatgattaacaactttaccaggaagtttgcaggaaaaaaaccgaagctccaagtcaaattattaaatatgtttatataagctttaatgagttgttttgttttttcccctgtggaagaagactatttcacctattaatactttattaactagtttaagaaaagagtgcatttattccatggataagatgttgttaaaaatcaatcattaaaatatgggagcagacaaataaaactttgtttacatttgtgcaagtttagtatacctctagagtaccctgtaaaagccccttcttcatctcccctttatgctactgggggttcttttgtgtctagggttctgtgcttttgtttgactttatttcactttctatcccccattaattgtcaaccagactagtcagagtgactctgatacaattttacaagataatatattattcctcattatttttctacaaataaatgcccctgttttgaaatggaagcctagataagaaataaccacattattctacacatttcaaagaaagaacacttgtaatatatttcttacatattttgtcatgaagaattcagaagccttaaggccaactaggaagctgcagtttagattttctaatggttggatgtctcagtggaaacatttattttctttttaatcaggagatttatggcagaagatggccagctagctgatagatgtctactgggaactgtctaaatgctctagtgttgttttaaatctctagttttatatctacttgaacattctgaatttctcccttcccctcttgaggactattaatgaacaagcttgaatcattggtttgccgtgttataagatgaacactgagcagtcattaaatgctatatcaaatgaactatgataaatttttaggttgatgaataggatttttaaaatcactaaatttcattatgtttttgaggcccatatattcctttttaaaagctttctttatgaggacttcttaatttcattatattttaataataatctattccttttaaagtcccaatatcatatattttaggttttgacaaccatagcatcttcatagaatgaatatccctaaattcaagcatggctgaagagagctatgggtaacaaattgccttgacacaggacatctgccttataaaatgttactgctttctaaacattctctgtaaatttatctccacccttatttcactcactctatggccaagtattgtttgtcacttcattctctcaacatttgtagttatgtataaaaactatctgttaggagttttacatattggaattactccatatgtttcatacatcattttcttatccctaatccactgcttttgtatatctcccctcctggatcctaagacaaaaggcaggaattgtgtcttgttgtctgttttgttttcttctcatatttctttttatttaattcaagagaaaagttgaaaatacctcacagtacctgcctatcagacaatgtgaggtcgagtgggccacagcactggcatcaccccaggttgttagacatgtgctatccccggccttatcccagccctactgtacagaaatctgcattttattttatttttctttccaacatttattttaggtttacgggggcaggtggaggttcgttacatgggtaaattacatgttgtggaggtttggtgtgcagattatttcgtcacccaggtaatgagaatagtacacaaaaggtagtttttcagtacttaacttcctcataccctccaccttcaagtaggccattgtgtctgttttttcttctttatgtctatgtgtactcaatgtttagcttacacttataagtgacaacatgctgtatttggtttttctgttcctgtgttaattcttttaggacaatggcctccagctccatccatgttgctgcaaaagacacggtttcattctttttatggctgtatagtattccatggtgtgtatttagcacattttctttatttagtctaccagtgatgggcatctaggttgattccatgtcattgctattgtgagtagtgctgcaatgaacatacacatatatatgtcttaataataaaatgatttatattcctttgggtatatacctactgatgaaatggctatgtcaaatggtagttcggttttaagctccttgagaaatcttcaaaacgttttccccattggcagaactaatttacagtcttattagcagtgtataaacattcccttttctccacaattttgccagcctctgttatttttgaattgttaatagccattctgactggtgtaaggtggtatctcattgtggttttgatttgcatttctctaattattagtgacgtttatcgtttttccttatgtttgttggtcacatgcatgccttcttttgagaagtgtctgttcatgtcttttgtccactttttaatggggtttgttttttgcttgtttatttaagttccttatagattctgaatattagacctctgatggatgcatagtttgcagatacgttcttcctttctgaggtgagggttgtctgtttgttgtctgcttggcagaggctctttaatttaattaagtcccacttgggaatttttgtttttgttgcaattgcttttggcatcttcatcatgaaatctttgctgggacctatgtccagagtggtatttcctaggttatctcctagagtttttatggttttaggttttgcatttaagtctatagtccatcttgagttgacttttacatatggtgaaaggaatttcaattttctgcctatgactagccagttatctcagcatcatttattgaataggaagtccgttcctcattgctagttttttttactttgttgaagatcagatggctgtaagtgtatggctttattcctgggttctttcttctgttccactggtctatgtctgtttttgtaccagtaagtaccatgctgtgttggttactgtagtcttgtggtatagtttgaagtcaggtagtgtgattcctctggctttgtttttcttgcttagtattgctttggctatctgggctcttatttggtgccatatgaactttagaatagtttttttctaattctgtgatgaatgtccttggtagtttgataggaatggtattgaatctgtaaatggctttgggcagtatagccattttatcagtattgattcttccttctcatgagcatagactgtttaaccatctatgttatctctgatttctttcagcaatgttttgtaattctcaatgtagagatatttcattgtcctgggtagctgtattgctgtattcctaagtgtgtgtgtgtgtgtgtgtgtgtgtgtgtgtgtgtgtctattgtgaatgggattgcctctttgatttagatctcagctctgacattattggtgcataaaaatgctactgatttttgtacattgattttgtatgctgaagctttgctgaaattgttcatctgatctagtagccttttagcagagactgtagggttttctagtataaaatcctattgtccacaaacagagatagttttatttactctctttctatttggatagcttttatttctctctctcgcttgattactctcactatgactcccagtatgttgctgaataggagtagtgagagtgggcttccttgtctttttctagatcttaaggagaacgtttccagcttttgcctattcagtatggtgtttgtcattggctgcggttttgtcataggtggctcttattttaagatatactcatttcatgcctagtttgttgaaggtttttaacatgatgccatgttgaattttattgaaaactttttctgtgtctatcaagatgatcatgtggtttttatttttagttctgtttatgtgctgaagcacatttattgattcacgtatgttgaaccaaccttgcatcctagggataaagcctacttgatcatggtggattagcttttcaatgtgctgctggattcagtttgctagtatgttgcttttacctctatgaggatttttacatctatggtcatcagggatattggcctgatattttctcttttctttgtgtttgtttttaggttttggtatgataatgatactggcctcacagaataagtgagggaggatttcttcctcctcaatttttgggaagagattcagtaagattggcaccagttctttatatgtctggtagaatttggctgttaatccctctcatccagggctttatttggttggtgggttttttattacttattcagttttggaactcacccgggaatttatccatttcttctgttttctagtctgtgttaatagaggtgtttataatagtctgaggttttttgtatttctgtggagtcagtgataatgtctcctttgtcacttatgattgtgtttaattttctccccctttttattattctaactagtggtttattaatcttatttattttttcaaagaaccaacttttggcttcattgatctcttctatggtttttcatatctaaatttaatttagtttagctctgtttctggttatttcttttcttctgcttgctttgagatcaatttgcccttgttttactcgttcctttaggagtgatgttatgttgttaatttgagatcttttaaactttttcatgtgtgctatagactttcttcttaatactgctttagctatgtcccagagattctggcatgttacttctttgtttttcttagtttcaaagaatttcttgatttctaccttaatttcattgtttgcccaaaagtcattcaggagcaggttaatttccatgtaattgtatgtttttgacagatcttctttttcttttttttctttttttctgtctttcttttttttttttttttttgagatggagtctcgctcttgttgcccagcctcgaatgcaatggtgcaatcttggctcgctgtaacctccgcctcctgggttcaagcgattctcctgccttagccttcccagtagctgggattacaggggcctgccaccacgcctggctaatttttgtatttttagtagagatggggtttcactatattggtcaggctggtctcaaactcctgacctcaggtggtcctcctgcgttgccttcccaaaatgctgggattacaggcatgagccactgtgcctggcccgacagatcttcttagttttgatttctatttttattgctctgtgttttgagagtatggttggtatgatttcagcttttttaaaaatttgtttataattgctttatgggtgaacatgtgattgattttagagtatttgccatgtacagatgaaaattatacatcttctgtttttaagggatgaagagttctgtatatgtctgttaggtacatttggtcaaatgttgagttcaggtcctgaatttctttgttagttttctgcctcaatgatctgtctaatactgttggttgggtgttgaagtcccccattactattgtgtggttatctaagtctctttgtaggttcctaaaaagagaatttctgtgccccagtgttggttgcaaatataatattcttcttttgtcttttttgatctttgttgctttaaagtctgttttgtctgaaattagaatagcaactcaatatttttttggctttctatttgcttggtagattattgtccatacctttactttgagcctatgggtatcattgcatgtgagatggttctcctgaagtcagcatatgcttgagtctttcttctttatccaaatcttcactttgtgccttttaagtggggtgtttatcctgttaagtggggatgtttagcctctttatgtttaaggttaatactgatatgtgtagatttgatcctgtcatcatgttgttagagtagcttgttatgtaaacttgatcatgtaggtgttttatagcgtcagtgggctatttatttaagtttgtttgtttgtttgtttttttggtggccagtaatggtctttcattttcatgtttagcactcccttaaagacctcttgtaaagtgggtctgtgataacaaattccattagcttgtctgaaaaggattttatttctccttctcttacgaagcttcatttggctggataggaaattcttagttggactttcttttctttaagaatactgaatataggccccacagtctcttttggcttataaggtttctactgaaaagtccattattaaccagatggggttccatttgtaggtcacctgcctctcctctctaggggcctttaacatttttctttcatgttgaccttggagaatctgatgactgcatgtcttggggatggtcatcttttacagtatctcagaggatttttctgaatgtatctttaatgccttagcacagtgttggcatttatgtgggcactaaattatatctgttggataaatgaaaggaatattttagctttataattaaggtggtaattttattcttaaagtaatacatgattgtagcaaaaattcaagcttgcagaagactgtaaattctgttgttcggagattaccaagtttagtgagtgtatctgtaaattttctgggaatgtgaaaatttacacagacagacacacatacatatttcctgcttttttgtgtgtgtgatgatctcaggtctgtgaaggttctggaatttgattttacctcacataaaagctaaaagttagcttgttattatgtcatggatttgggcagaatggacttctgtattagagcaaaggacattttttactcatggcacaggaagtacatgaaccatcaaatgtcacgtgtcaatgcagtttgtcacatattggtcttttaacacatgcttgcatatacggatatccattctatgaagatgctatgactataaaagtacaatatatgtttgtgtgtgttccacttgcttcctgtgtcctattgagggtatgtggatagccccagtggattcctacttacatggtgggttgcattacagaaaaagaccaataaccttagataagctactattttataataaacatttttcaatattccttactgcaaacacagttatgaaaagtggcctggctgtttggggccttgcattcttggcatccccagcaagaagtattaggagtttatgagagtggaggagtgtctctcaatgatatccacttttgatctttgatcatgttggcttctggtgaaatttcatgtgattatggcactccattgaacaccctaaataatatgacagtggctggggtcagatgtatttagtttttctcatacagcatttatataaggctattatgagcagaacttctaacaacaggattaggccaacttggagttttgactttactcatgtttccctgtggtccgggactcagtcactgtaaataagtctaagaggatatcaataggttttattctataaagccaaactgtggtagtctaagaacagtgtattatccagcacaactgacacaagggagtttacatagaactgcttatctttggttatcattgcaatagatgatttaatagaatctgaatttccatggagagatagtccatggctcactcagcccatatacaaacatatagcccaaagggacataaatctgtccaatcaggattttttatttaactttatttggatcatcattacattggtctgattaagcatgtgtcatgtcactgaagagttgtagcctggattgtttacatggcataagccaaagtgctcagatatcaggagaagcaagtgaatttctatcagccagatagaaacaatgttatgcaagttcctgtgtttgtttaggtgggaggaagggtatctttttgggagcagccatttatggcatcaggcacagcagagcagttcaggactggccatgcccacatgagtttttctgtttcatagcacttggaagagatgacaaatggaacagcaggctggattgtcagccacagatgctacttcactcaggcaggccatatgattattttgccaggctctgattctggatctaggtgacaaacagagcattaattaacccatcctcttccccacaactcttggtgtacaagccatttcttccccagatgtcagttattgctttctccacagccatgaaattttgtgtgccctatttcagtataactttgctttacttctctccagtcctctattaatctaacccagagctttgatatgaaagtattaaatgcaagtggaacagagacatttttacaaaatatacagagactcattatacctcccatgtttgcccacataggccattgtagagggattcagttagcagtagagttagctgtctgtgtctgcagtttctgcattcgcagattcaagtaaccttggattgaaaatatttgtgaaagaacacaataaaaatagaaatacaacaataaaatcacagataaaaacaatttagcattaacaactatttgcataacactcacattgtattaggtgttatgaataatctagaaatgacttaaggactacaggaatatgtgcataggttatatacaaatactatgccattttatataatggacttgagctttgagtttggaaaatctaataccttgactatcattttattattaggtggcctttgcaacaaatggcacaacattgccagactgtagatggtctggaaaccagcaaatatgacccagtttagtttcatgggccacagtggtatggctggaggtgactgattggcctgaaacagcagccctgtagcctgaaaccaggtaggatggtgatgtaggcacctttatcacagagagccataaatattcttattcccgccatcccttcttagcgatgaaccatacttgtgtttcaggccaaggataggatttacaatttattttaaatgtgatagaagctgttgatcaataatgagcagaacagggaagatatctaattaaatttaattttttttttttttgagacagtctcactctgtcacccaggctggagtgcagtggcatgatcttggctcactgccatctccacctcccgggttcaagtgattctcctgcctcagcctcctgagtagctgggactacaggcgtgtgccaccatgcccggctagttttttgtatttgtagagacggggtttcactgtgttagccaggatggtctcaatctcctgaccttgtgttccgcccaccttggcctcccaaagtgctgggattacaggcgtgagcaaccgtgcctggccattaaatttaaattttaacaggaaccacctgccttttgtgagaagactagattataatgggggtgcatttaagatgctaagacatagcatatgatcaagcaattctacacctaggtatatacccacgaacaatgaaaacatatgtctacagaaaatttgtacctaaatgttaacagcttaaatttttcataatagtcaaaaggtagaaacaacacaaatgtgcatcaagtgatgaatggataaataaaatgtgtatagctatacaatggaatattatttggcaataaaaagaaatgaagtacttgtatatgctacaatgtgaatgaacattgaaaacattgtgctaaatgagagaagacagtcatgaaggcaacatattgtatgattcaatttgtatgaaacattcaaaataggaaaattcatagccaataaatcagattagtagttacttatgtctatggatgatggtaggattgagggttctagcaaaggggagtggtttactttttgaggaaaggaaatgccctaaaattgattgtggtgatagacacacaatgtgtgactatattgcattgtatactttaaatgagtgaattatcagatatatgaattatatctcaataaaacttttttaaaacaatctaaggcagcatttcaaaatcctggtggctgcttggtctatagttgtagtggtggaattggtgaaaagtggcacagaatttgctgcacaatcaaatatggaatgtgaaagaaacaagttgctagaaaggagtacacggtttatggccaacctataccaaatgctgctgagtatttatgtaagatgatgattaagaattgatcattggatttgaccgtgaccttatcacatgaggtttccacgtagtggcaggacctaaagcctgtgaagtttaagagagaatgggaagatagggatgtatagacatatgtaattattgtcaaaagttttacattaagggtgagtagatggatgtagggatacctgaagagaggtgtatggtgaaattactttattcaaagattattattaatataacatctttgcatattggtaataatgacttgttagagaagataaactaatgcagaagagaaaagtgcattagtcaaatccttgaatatgtgagggtagagggtattgcattctttaaagggacagttcaccagggtaacagttggacttgtagaatttggtatggtagtaatggaaacaagcaagcaatacatttaacatggcagtatgcaaaattctcttctgattgtttatatgttctctgttaaatgtagatgcatagtgatcagccatgagaaaaagaaagtgtggagatgacagtatgaggaagtcaaataagctgcaaaattgttgtctgaaagatggagattgatttggactccactgcagtgtgggctcatagatttaaaatgagaagtggtggaataatttgggagtttcatgacagccatgttcacctgtttgcatgtagaagtggagtataggaaagtgaatttaactagccagtgttttagtttgctggggctgccctaatgaataccacagactgggtgccttaaacaacagaaatatattttctctcacatttctggaggctagaagtccaaaatcaagatgtcagcagtgttgattttattctgagtcctctttttgtggttggtaaatggacgccttctctctgtgtcttcacatggttttcctgtgtcctaatctccttgaagggtaccagtcatattagattagggtccacccatcacacttcattttgtctaattacctttttaaatcccctatttccaaatatggttccattctaagatactaggggttaggacttgcacccatggatttttggaatgtggcaggcaagggcaattcagcccataacaacaaatgctggagttttaaaatttaaatatattggagtgagagagggcgtatgtaagagaagcgtaatcctgttctcatatagcttaccatttaagaaagggggacaaataagaaacaaaaaaaaccccacaatttttcaataaattgggggtgataattgctaagaaggaaaattaagtggggtgagaagacagtgagtaaggtgtgtgtgctgttttatataggctgataggaaagctcgtggtgatgtgacatttgagcaggaaggaaggaagatctgaaggaaacaagagcagggagccatgaacctatgactgggcagagaaagcacaatcgcacatgccctgaggcaagctagtaattcgtatatttaaggaacagccaggagacctaagtcactgatgtgaacatggtaggaaatgagatcagaaaggcatgaagtagaagctctcttatctggtgaacttgtgactacaatttatttaatcaaaagttgatgatatcagggaatcatatgatacctatttacctttaaaagggaggtacaatttacattgagtgaaatgcactgatcttaagtgcatagttcaatgagttttcactattgtaaaaccttgtgtgactcataccacattagaaactacatctaaaatagttctgctttgtggtacttttgttatccaatcccctgaacacctatacactgagcatgcaatgtttctgcaagggtgggtagggagaatcctcattgttttttcttgctcttagaatgatgtttctgatgataacaatatgtgttactactagtaataataactaatctatattgagttcttatgtgccaggcactgttataagaggttacgtgttacatccctgtactcatcctagccttacaaggtaactactattcgcattttgtgagtaggaaaaccaaggcattaaacatttaaggaacttgaatcaagttgcacaattagtgagtgttgaaacccagactcaaatcatgacaatgtaactctgaaacgttttcttttacaggctatgttaggttccctcctgagaattgaattttagcgtatcatcaatattctccctttccttagtgtatatgcaaatgagggcattttttgttgttgtttttttcagttttgtttattgcttctcttctaccatctttcagtaaaaggcatttatttagcattatatttgttggcttctttgtctcttagtttaacctttagtgtgatgtggttattacagtggacactttggtttaggctgtgagtggatttcctgggtttaacttaagtttttgtctttttttttttttttttgacagagtcttgctctgttgcccaggctggggtgcaatggtacaatctcagctcactgcaacctccgccccccaggttcaagtgattttcctgcctctgcctcctgagtagttgggattacaggagtccgccaccacgcccagctaattttacatttttaatagagaccgggttttgccatgttgaccaggctggtttcgaactccttacttcaggtgatctacctgcctcagcctcccaaattgctgggattacaggtgtgagccaccgtgcccggccaatttcttatctttattcatacaaagatctgttttcctatcagttagacctgaagctaatttatggtattttttcagggcttactcactacgtttatcagcccataaaccaaactgcaaaattatttggtcattagttcacagaagctcctgcctaactatttaaaacatttaaagtatgctgagtgcctgaaacttctggaagcattaccagcagccttacactagtttccaggatcccttggcagcctcaaggatagcctcagaaaatagactgaaaacatttgctcccattacacaattttctacaaaagaaagtttatgactatagataaaaatatgtctaatagcaagtaaaatagattccctaagtaataacttcctaattaaaaaagaacaacaaataaaaaaccaaagcaaaaacaaaagcttttttcttcttaatttaacaacatagttacaaaaccctaaactttatctagattttatttcttatatttaacatcaaaattttttttgagatggagtttctctcttgttgcccatgctggagtacagtggcactatctccgttccattacaggcacacgccaccttgcctggctaatttttgtatttttagtagttacaaggtttcagtatgttggccaggctggtcttgaacttctgacctcagatgatccgcccgcctcagcctcccagagttctgggattacaggcatgagccactgtgcctagccttaaaatcaatttttaataaagataggaaatatggtacacattttcaagtaaaaatcctataacatagacaatcttgctgataccattacttaatgtttttgaaacaattaggaaaagggtaatagtattggatagaaaagtctgtagttcatgcaagttgctcatgcactacactggtttggcaagccagggatattgaagaacttggattttctgactgagaaacagaacagtatttgcaaataagtaggggtttcctggaatagaaacataatacagatgctgattctcttaaataaacctgggccaccaactgtgcttacgttggttagtattctgtgtttaaagtaccatttttctgctcagttttcttcttttaagaggaatattgaaatacaatatataagattattattttataagtgccaggggattagatttctgtgaatgataaagtttagcctgttttcaaggtgtaggtgttttcaaaatataggtaaatttccaaattaaaaaatacaagcagagtctgtttcataattacataagaagtttaaacagcaacttagtttttcacatgatatagttagaattctttcagtgctaatgtcttaatatatagcactagcaggctatgaaattaggataatttgaatactgcttgaagtggcaataatatgtaattttgactttttatcataaataaagtttaagttaaattctcaataacctcaactgttaggcttttattaggaaatgacttatcttagacatttcaatatttaattaatactgagtgatttcagattttctattataataatattcttcatcttttcttgaacgattttttaaattctttatcttgattaagcctcacaatattttgtgagattgatggggcaggaaatatgttataaacaaatgaagcactgagaagcaagatacctacctaaggtcatccctttatttgatgacagagccagggatggtgctgtttacatcttccaggatcatttatgtatatggcactccttataaacttgggaatggccgtgtagtgaccgtcaatgttataggtacttctccatggaattattttctacaataaagtgaaaggatctaccctatcttaagactgaagacagaacatttgatagcttgaattgtttcatatctcaaatttagaaaagaatgtacacggtaacaggaaataaatatgggataatcattcctttattatcaggtttagaggctgatttccaatatttagctatcatttttatagaaaattaaagtggaaatgaaacaaagtagataataacatgttacttttttctaagaaaaaaaaccccaaatgtcatgtattctttggatttacatatatctctccattatatatatatatacacattctgaataaatgtaaatgtaatttttttgtaattactaaaataaaatctgttacaataattattttgtaactggcgctttatgtgaattttgaatttgttgctagtttaggttggttataacaggcaacagaatttctgttgctttatggtgctgtcagctgctgttaatttaaagagcttgtgctcatcaaattatactttgatgtttttgagacaaacgtttatgaaatatttcaagtgtctttgtatttaatactgttcaccccaattagctctgtcaaaacttcatcacttatcttattcacatcaataagcttacattttactcgatattatttaaaatgtaacaaatgatatcagaatatgttttgtctgatttacttactttatagataaaagttggttaaccaggtagttaaacaaatgtagtagtataaataaaatgctcaatgtagtataaataaaacaaataagtgtaaggtattcattctacacttaccttgaaaaatgtctcttaataattatgtacatatctttgttatagcctttaaattcttgctctgattattttaaatcatttatgttaatatatttttcccctgataaattggatgcgtgctatctattctaaacacacatttattgtagatactttctctgcagatcagctgggattttagaggctgtgtaattattgatcgtgtcttgcaattgctctacttaagaatatgagaacaattttttctgttttatgtatttattttattttatttttacgtatgtatgtattttttttttttgagacagagttttgctcttgtcacccagactggagtgcaattgtgtgatctcagcttactgcaacctccacctaccaggttcaagtgattctcctgcctcagcctcctgagtagctgggattacaggcacgtgccaccatgcctggctaatttttgtatttttagtagagacgtggttttaccatgttggccagactggtctcaaactcctgacctcaggtgatccgcctgcctcgatctctcaaagtgttgggattacaggcgtgagccgccgtgcccagctctgttttatgttttattaattatctgttctgcaagatgctttataaatatgattctacataatcctcataacaaatgaggtttagctttggcatttctatccacattatacagatgagaaaactgtggcttagaaagtcttctattcttaggaggtgtacagacccagacgtgtctgtctatgaaggccagattttagccactataatatattgtatcccaggatgatttctatttcagaattattggctagtcagaagtactgaattagagtaaagtcagaattgcactatttgacaacctggagctataaagaatatcatgatatgactttaagttcattacaatacaacttaaaggaatcaagtagtttgtcaagggcctggcagagtagtggcagatctagtattaggtattaaaatgttagccaactagcttgctagcaactttcatttatttaggcttttaattttggattcgaaggcttgagtactgatatatttgagaacattaaataagtcatacatttcatgttatatgttctttatccaaaaatctatgtgtacaattaatgaaattttcttctttgttttaatgcagtggaatgtatcctgctttcatcttggagttcacctgtgtggcttggatttatcacagtagcatttgtcttcaatctgtgtgttaactagaaatcaaggaaagacatgaggagatttgtctactgcaaggtggttctagccacttcgctgatgtgggttcttgttgatgtcttcttactgctgtacttcagtgaatgtaacaaatgtgatgacaagaaggagagatctctgctgcctgcattgaggggtaagtgcttatgaagcaaatactgtctttatagagatgagaaaagtggtgccttgacaaaatgagaaacttcagaatcagaagagttttgccttagtgagttagaagagcattttggcagcactattaatgcatgtttaaccatggggaagttactttacctttcttggtcttaggcgtcttcttggaagaaataagaagagttagctaacctctaagataccgttcaacctaataaattctggtgttctgtgactgtatgaaaagaacagttgagtgaacgttcaaactgggcagaattttaaatctaggctgctagaagccaaaagcctttaaagaccaagcacataacataaaacggaaaaaccactaaagtgagacaggtggcgattttagcaaacgaactgtgcatgaatgacaccgctaaagacttccaaaacagttgaaataaaacaaccaatttttaaaacaaaacacatggcggtatgcagatttaccagattgctggctgtatgttaagtgaaaaagataatttcaagtatactgtaaaattactttatttcagtattttcctcttgagggaccagtttcaaagactaaatatgaatgtaaacataataatttgtatgaatggttatttatcaagtaaagccatagagatttgttttctgtgaagttattccagttttctctatgctttcttttttgttaacttcaagatctataaatatatttctaatgtattcctagaaaattcaatacttctaaaatatgtaagagtactcaaaattagttttattctcattgaactaacatattctctgtttggcaaaagttttctgcataaatatgacaaaaagcaagcttcaattgaagtatcatgacatgtttgtaccttttggaaaagtgaatctaaattatcaagttgagatttacatttatttaatgaatatgatctgcttttaatgttatacatatttttgagatatttattgaacaaaatatttaataaacagaatctcattaacactatcaggttacatgaaatttagggaaacagaagagcatttccaaaatttaatttttgttcaaagagtactttagacatgttgagtttgctttagattgcaaatcaaagattactttagacatgttgagtttgctttagattacagaaatactcttgttcatttagagaaattctgaatcttctgaatcgcttccttgtcttttaaaatggaacttgcattttagattttgactaatacaaataatttaaaaaaatttgcaagtgactgatgctagacccatttaggtagtttacatgcattttttatgcctttatacttcagttattctgagaggggaacattataagtccatgtttttgacaaatgaacatggggaatgatttgctgatctttagttaaaaccccagaattaatcagccttctgagcttctttgtcagaatcagttgagttgctgcttggctgaatgtagaaaagtgtttttgatggattacatcagtttggaatgatcactctgtcatttgttgaaggaaaccatctaggttggtcacatacaaaaaatgtaataatctgattcagcaaaactttgatagccttttctgccagtaacacaaaggtacagttttgctgatttatgtccttaatgctccttaagtcttaaatctcaaaatgtgaaatttaacaatgcaaggcaaaaataacttttccttgtacttaaattgtaaaattaaactattgttctctttgttgataagacttgttattttacttcattcaggttgttaaaaaaatatagacttggtggctaacaaggaacagacatttatttcttacaattttggaggctggggattccaagatgaaggtgctagcagatgcaacgtctgataaggggctgttccttgtaaacagctgtcttctcactaacctcactaggcagaatagttgagaaatctctctggggcatattttataagggcactaattgcattcatgaaggttccaccttcatgacttaatcaccccccaaaggccctatctcctaatatcactttgaaggttaggatttcagtatatgaattttgcagagacacaaacattcagtacattgtactactttaaagttttatattaatactatttgtctggaataaatggaaaatagacttgagggttttaatttcattttcagttgtcacttgttatttcagaatttttactttaggagtttgcaccttgttttcaaaatattttatttgtaagcagatgatgctgtgcaaagtgtacctaactgaaattttcacattttaggtctgctaaaaacaggcttttttacttaaaaaaagatccttctggacctgtgcatctccattattaaagcaaaggttttggagtaggcagtttctaagttcccttatatgtctaaattttaaacaattcctaaggacccaatattaacatacactgttaatgaatttttgacatattttcattcattcactcattcattatttattaagttcttactctatgcaaatcctggggatataactgaggtccctgatgtttgggacataagggaacaaggctcccacctgccatggagcttaaagtcaaatatatagtaaacatttttgtctttctgtatgtatttatgtgactgtgtgtgtgtgtgcgtgtaatcatgtgccatataatgattttttgctcaacaactgactgcatatatgatggtgatcccataatattttaaagtaatgatcactgatgttgagttttttttttttcatatgattgttggctgcacatatgccttcttttgaggagtgtctgttcatgtcttttgcccactttttggtggtttttttttcttgtaaatttgttttaagtcccttatagatgcaggatattagacctttgtcagatgcatagattgcaaaaattttctcccattctgtaggttgtctgtttactctgttgttagtttcttttgctgtgcagaagcttttttgtttaattagatcccatttgtcaatttttgcttttgttgaaattgcttttggtgtcttcatcatgaaatctttttctgtgcccatgtcctggatggtattgcctaggttgtcttccagggttattatagttttgggttttacattcaagtctttaatccatcttgagttaattttccatatagtataaggaaggggtccagtttcaattttctgcatatgcctagccagttctcctagcaccatttattgaatagggaatcctttccccattgcttattttggtcaggtttgtcaaagatcagatagttgtaggtgtgtgaacttatttctgggttctgtattctgttccattggtctatatgtctgtttttgtaccagtgccatgctgttttggttactgtagccctgtagtatagtttggtgtcaagtagaatgatgcctctagctttgttctttttgcttaggattgctttgacttttgggctttttttggtttcatatgagttttaaaatagtcttttctatttctgtgaagaatgttaatggcaatttaatgggactaaaaaaaaaaaagctcaacatgactgattattagctaattgcaaatcaaagccgcaatgagattccatctcacgccaatcagaatggctattactaaaaagtcaaaaaataacatatgctggcaaggttgtggagaaaaaggaacacttctttcctgttggtgggagtgtaaattagttcaactattgtggaagacaatgtggtgattgattcatcagagacctaaagacagaaatactattcaacccagcaatcccattattgtatataccctaaggaacataaattgttctattataaagagacatccatgcatatgttcattgcaacactattcacattagcaaagacatggagtcaacctaaatgcccatcaatcataggctggataaagaaaatatggtacatatacactatggaatactatgcgccataaaaaagaatgagatcatgtcctttgcagggacgtggatggagctggaggcagttagccttagcaaactaatgcaggaacagaaaaccaaatagctcatgttctcacttataagtgggagctaaacagtgaggacacatggacacgtagacaggaacaaaacactctaaggtggagggcaggagaagagagaagatcaggaaaaataattaatgagtactaggcctaatacctcggtgatgaataagtgtgtacaacaaacccaagtgacacatgtttactgatggaacaaacctgcacatgtgcccctgaacttaaaataaaagttaaacaaattataacattttactgtaccttttctatgtttggatctgtttagatacacaaatacaattgtgttataatttcctatagtattgagcatagtaacatgttatacaagtttgtagcctaggagcaataggctataccatacagcctaagtgtgcagtaggctatactatttagtcttgtgtaagtacattctatgatgtttgcacaatgatgacatcgcctagtgatgcacttctcagaacacttccccatccttatgcaacgaatgactgaatatatattcaactgaaaaggaaaagtaagttagaaatgattataaaacataattgatattaggatcaggaagaagaggacactggatctagagtattagataaaatttctcaagccaggcatggtggtgtgtgcctgtaatcccaggtactcagaaaactgaggtgggaggattgcttgagttcaggagtttgagtccaggctgggcaatatagtgagacttcatctcaaaaaagaaaaaaaaaaaccttcacaaaggctgtaacattaaaattgaggtttacagcataagagtaggaaataactagtaaaaagcaaaaaaatactaaaattctaatagaatgataaagattccagaaagcccaggatacttgtaaaggagaaaaatacagagtggggatgtggcaagtaacagctcttaaaatttagtgtaattaaggctatataattggaacagagaagcacagggggagacaaattgtccaaaggaagagaattagccctctgatggcgaaccacatgtgtacatatgtttggaacattctttatatgacaggagaggcactgcagatcagtggggaaaagagaggctgttcaataaatggaaccgagaataaagtggcaatccatgtggaaagagatgaaattggatgcctaactcatgtcatgaagtttggatttaggacttaaatgtcaaaaacaaaatttaaactttagcagaaaaatatttagacatctataagaccttggaataaaaaaattcttaaaacataaaaaaattactgcaaaaaaattgataaatttgactatgttaaacttgagaaagttagttcattcaaatgtaccttaaagaagataaaaagagaagttaaaaatcgtagaatatatataaagcaaacgcaactgaccaattattaagtacgtataagtaacttgattgttatatatatcaagtatatataaaattttttctataattaataaaaaagcccaaataacccaatagaaaaaaatgggcaacagaactgaagtgacacttcatagaaaatgaaacacatatagcaaataaatttgtgaagaaataattaacatgaactttacttggaaaaatgcagatcaaggctacagtgatatatcacttatatttagtcagttggcaaaaactataaatggctgataataccaattgctaaaggtgatgtgtctctacatttttataataacttcagataacagttggacattatctctgaaatctgaacattcatatataactcagcacttatagtcatatacccaagaaaatttttcacataaacaaaatatccatagcactataattcataaaaataaagcctgaaaataatccatagatctattaatggaaaagttgattaataaatgttggtatatcaatacaaggagatcttatatagtagtttaatagttactatgaatgcacttcagagacttccatcaacatgattgaatcttgaacatataatagtaaattatgtacaaaaactacctattgagtactatgttcacagcctgtgtgacacgataatttgtaccccaaacctgagcatcgcacaatatatccatgtaacaaacttgcacatgtaccccgaatctaaaataaaattataagaaagaaaaaagttgtatccttcaaagattatatacagtataatactgcttaaaacactaaaagtaactaaaatttaaaaaatgtagtatttaaaaatatagaaaaatacaacaaaactttacaaaagccaaaaaagactaattatgaatatgggaattaggatgttgtctgtcatgtgtacgggaaattggggtgtgagatgggggtgaaaattttgactgactgtagggtattattacagtcctagatttgatttggatatgggtttgatgtgtctttttctctatgtggataactaaataagtgaataagatacactgaatggattttaaaagtgggaagccactgaatggacttaaaaatcaaagcaaacaggataagagttgtgtcacagaaagattgctgtggatacaatgtagagaatggattagagaagagctattctttccaggaggtctgggtaggagtctgtggcagtattccatgtattctgtgtaggaaatgatgtctgcttagagcaaaatagtgcaaaatgaggtgtaagaggagtaggtaaaaccaagaggcatttaagatatgatattaagagagctggattgcttgcttgattctggcaggtgtaggagaggggagtgtcaaggtcaagtctctggatttttgcagaagtttgtttgatccaatttcctgagagaaggaaggatgtaggagatgatttgagggtggactttgagtttgttttggacacgttgagtttgatatgcctgttagggctctgaaaggaactgttcagtaggaagttggctatatccttaaactctaaatatcaaacttgaaaaaacagtcactttaatggacatttttctaaaatggattacattctgaccttttattaaagtgaagtttatggactgtaatggaatctttgttacagagtcagtattatcattttacacatcaattattgaatgatgttgtaaaaaagaaatgatttcagtgactttatgggagcatgtagttctattccaatattagatacagacccatgaatgctatttgtttttctgttttttaaaggactgctcttgggcaacataagtacttgttaggggatgatattaaccctttcgtgccactctgatgccacctggaattaaagtgcactaaagatatttctgactcctaaatggtatggaatactaagtgctgctactcctaatttggcagagttagaataggtatttgagagaataggtatttaaaaagcccaatgatgccacagtgcacctgcaaacactttgtggaaatttgagggcatgtggtaggtttgcatgggcgttatgacatagtggatccttgtcctggctcccccactcatattctcaggcaagtagattaatctctctgggcctcagttgtaatatgtaatatgaaatgaatatgaatcatgatttttaaaatcatgccagtctgaagtgaatgattatatgtttctagctttaagaaaataagcctatagtaaaccagctattttattatctagcctttggttagtctacagataatatttggtttgagatgagaaatggtcatgcagagaagacacaatgggaaaggatctgcttagaaactccggaggtttcttatcatcacagagggcaaaagggatatgatgttatgatatgtattactcacagagttatctagagggacagaactaataggatagatgtatatataaaggggagtttattaaggagtattgactgacacaatcacaagatgaagtcccacaataggctatctgcaagctgaggagcaagaaagccagtccgagtcccaaaacctcaaaaggaaagctgacagtgcagccttcaatctgtggttgaagttacaacagcccctggcaaaccactggtgtaagtccaaaagtccaaaagctgaagaacttggagttcaatgttcgagggcagggagcatccatcacggaagaaagatgaaggccagaagacttagccagtatagtccttccacgttcctctgcctgcttttatcctaaccatgctggcagcggattagatggtgcccactcagattgagggtgggtctgcgtctctcagtccactgactcaaatgttagtctcttttggcaacacacacacacatacacccaggatcaataccttgcttccttcaatccaatcaagttgacactcaatattaactgtcacatgatattctagaagggaaggaaacctacctttctttgtcttattctgaaccttaaacatatgacatatgcataggaaatgaaatgaaagttacttgaaaaaagggaaatagcaaagcaagaatttctgattctatagaaaaaagatacatacattagtcaatagtaataacacaataataattttaagtattaactattctaaattatttacaagtgctacaactaacactacaagtgttagtaaattctcacaaaaaaatctgtaaagttggcattattattattattattttacatgtgaggaactgagacaaagagagggtaaagagatctgccagaacttttacaaccaatggaatgagctttggttattatagtgtaagttcacaaaatgattctgtcatcagtaaataccggtttgcattggaattcaagtactgtgttttcatttggataccagtgtggagatacacattctgaaaactccgtgttttgtctttactctcagagacattctacaccctccaggtctccctagcctgtaggatgtgtaaatctcagccaggaaaatatttactagtgatctttctgcttgcagataattagtaagacagttatcaccttctctggcattttaagttgctcttattcacttttgtccctcagacctccccaatgctgctctgaattgggggaaatcaaaatgagtggaattgctgaccaatgacttcagttcaaaacatttacatttttcttggtgctgccagggaggctaaggtttcttctcataaatccagggagacagatggccttgctctcttacatgtttggcaaaaggctgttgtgtcagccttttctatttttgttttttaaaattatctcctccttatagccatgcactcatttattaaacagcaaatgtttgttgattttgtctgattaatctttggtgctttggggaagaattcctatgtttacataagggagaactaaagaattaaagcaataaattaaattaaagcaataaaactaacagcaaatttttaaaatatatggcttcatcttttgcaagataggtagagggtatgattgattaaaatgcattgtcagtattggaattgcccttaataagttataatgaccactggaatgttgagattataatatttataattgtaaaacagtggaatataccaacacaattgatttggattaagggcatatatgtcccggataattttcaatcagttctatatacagtttcccaaaattaataggccttataaaattttgaccgctgatatttgctttgctctttcatactcttatccacaattcactctgacccttctgctcttctacatgggcatagtaatgtcaggaataacaattaattataatcaagatcacaatttatttattttaataaataattatagttactataataataatttattataataaataaataatgaaaaattattaggtttactgtgctaggtgctttacaagcaatattttgagtaactttaaaagcatcattaaaaggaggtactattattatacccatttacaaatgagaaactgggctatggaaagattatttaaattccccaaggttacaaacctctgcaaggactcacagctggtttgtcagacttttgagcccatatgttgaaacggtagactgtgttgtgcccctgacccaggcatgcctagactcctttttgccaaagtaatcataacatttatatactatgtatgaactatttatacaaacacgagtatttctggaggatgtagaaagaggtggccactgacttcgggtaaaaaaaaaaaagtcttatttaatagaaaagtgaaaagtacctttgccaggctcacctagccttattttagactagcaattttgcatttattgagtctctagagcacactgattaatttagattgcagtttttctcagcagtgagttttggggtcaacctaacaagtcttagaaaaaatagttaaaaattgaaagcaatagtgaaacaccagtttttccccaaagcttaataaaaatatttgataccattcattcattcagtagaggtactggagatttgatgtgctcataaataataaattacaaaacagaaagtggtacctgctgtaagagaagcaccaaataaacttgaataagagttaagaggccttgaaatatgggagttttatggacatgtgaaaattggaagggaagagatagcagaagaaagtgaagtaccaggagaagcatcttgcctttcccaaaatatggatatgagaaatcagtgaattagttgataggagcagaatcagtcataaaagggtttctagattttaagttgaacatcaggagaaagattttaaagggctgagtgctggggaaaggaattttaaccttgttctttacgaaaagggatcactgatggtttctctaaaaaaagtgtggatttgatgcaggactggcaagccccagagtggatcttagcctgtaaaggttctcagttttgcccaggaaagaattcaagggcaagccagaggtggaagaaaacagttttattgaacagtgttacagctctggtggggttacagctctgtgactggcaaggagtgcttgccaacctccactctcatctggccgagaacatccagctgactacaattcccctgacttgaagtcctctggctctgggggccctaccaagggacacgatggacccaaagcaggcagcacactaccgtagcattggtacaggacaaaataagagcttggccattgacactgccttcagcacaccctggcaaaaaaggtgggctacaaaacaaaacccaaaatccataggccaaagggaatggagttgggcaagcacctgccagcctcaaaacccttctaagcaaaaaccaaaagccaaaatgaggttacacattgaggaacaccaatagcatagaactaagttatgttgggagaaaacactgttcccacagacctctaagacaaaatactttagcattaggcacaacagcagtcataatcagaggagaaaaactcaaaggagctgacaaaaaaactaatggagagagctacatgaatctcagaagctttcaaaagaagtagatcacaggattgaaaataaaaatttctggtaatttagcaaatcaataccttaagaaaatttggttcagatatagagaccattttctaaaaagcctgttatagacagtttccttttaatacttccatacattctcctttactaacttttcaagacttatgcagatcatctataacatgctagaatgttctgacttgtcctatgctgcctatttcttaaataaccagtcattttactctagggcaagaatttactatacgagatcccttctcttataaaattactctttctttatatcattccttgcaaaataataataaatcttctattcatgatgttctctacatctctcttttttactcactggttccctcatattttgaacctcccttttaataactaccaaattagacaaaattatttttcccaataaagaatacatttctttggcacattttatgtaaacctagggaggaagaaatcctagcccaccagacactggcattctatagataagaatcattctatcactttaagacgttaaaccacataatacgctcactatttaagcatctattccattctttcacttttaacagttttatgtagactatctccgagaaccaagttgctatgcaaatctagtcaccatttaaagccattttaaccattttaaagcctatatcagtgatttaccaaagtaaaaatcttaatgtcaaatttcagaagatgtaacattatcttcaaactaatcaactttgactagtcatttaatttatgaagattatttataaaccaatttgatagcatgctagacaaaacatatatcacaatacttgtatatatgcctaaacaaacacattaaataaagttacctacacaagacaactggattcaagttatttacaaaattgggaccatctacttggccaaattttgtttgcctcaataggtttgaaaacaggaagaggcagggaaagggatccaatagcatcaaattagaaagggaggtagcaaacagcattgctcaaggggagaccctggagaccccgaactaccaaagagcgcaaccagcagtggagtcactgaagaaaaatgttcaggcagctgcttgtctgccactgtgggaagccatctgcagggacaatggtccaagacttccagtaaacttacttgagtaagacagtttgtgggggctagtagaagaaggttagctctagaattgatggagagccttttttctctctcttaccagggacagttaggacatgcttattgccaagggccctcttgcttaaagcaggtgcactgattctggcccaggggcaggcaagttgggggctcttgtctaggcatcccatcccagatgccaatttcataacattttctcatgatagataactcttagggggcaggggacttaggcaactgctaacaattgtactttttggctatttctttttcttttttttcctattgccctgagatagttctctaactgtgtcgtaattgactggcttacccatatactttttcctttgcttttttcccacagcagagcaagtagattatttgtaagtcatgatgagttaaatcaaagaacatggtcaacttaacaaactcctctatacactttactggattttctgaaaactttctatgtttttccttgtgtaaagccaaattagacatagaaaatggcacatgtactctaagtattccctcacttccgttaggtatctcctgcaatggacacaggtttgactttagatgctggtatggggctgactcctggtggtactggttgggcttactttctggggcagcaaggggtataggctgaggctagttggataaggatgaggtgtgcctgatgtccttggggtacagtccttcattagagaactggtgggacccctccccaacccactgagagttgggagactgaggagaccctggagggggagtaggcctccaaggggaagcagctgggaggggatcctttaggcatgaatttctgttgcctggaagtaacatgagccagtaaaggtctataaaagcctgtacataagggacctcttcccgttttctttcagttttagaaaagaagtctaattgtaaagtatcattataacatatagaaccatgtttaggccaaatgtgttggtttgccactttgtgtcgaacgcaaatattattgccatactaaatgagtttcttcttcttttagccaaatttgaatttgctccattggcctaaaacataccccagtggtgggtcctctgggatgcttgctgttgcacccatgtctagtaaggatctctacagagggttttggttagcctaagtttagtaaatgccaagttgctttttcccttttacattcccacttttcataggtagcaaggtgttacaaattagatcccaagctacaaaaaggcagtgggatgttgaacttaaattccacagagagagggttacacagaaagggaggataaacaaatggctgtggaagagagaaaggaaagggtaaacagcattgcccaaggggagacctcagaggccctgaattgcaggagaatttacccagtagtggagacaccaaaaacaaaaatatttggatggccacttgtctactgctgtaagtggctgtccatcaggccaggggcctaggaactcccagttcctttggccaagaggggcttaagcaaggcacttgttagaaagcacacaggaagggacttgcagctggctgttgggaaaataatacttctaactctaagggcagaaaaaggcaagaccaatattcccctagggggaggggctataacccaccatacttagaaagaatgtcagtgctgaaaatcccagagcatattggggggtggccaaaaatactaatgctgaaaacccagagttactgagtgtcaaccaatgagggtcccctcaccaaatgctgaaaaccttgggggcaatcagggggcagccaacagtgaacccaagaccaagttgggggtcacagaacagtgtgactctggcatcccagagtcaacacaacaggggacctctaacaaccaagtgtactgccttaattgtccactcacaattaacagaacgtttaaagcaaatgtaagagtgcacatcaaacacattttaaggcataaatcatttaagaaaataaaacaaatggtggagcaataaaatggagttagaagacaaaggacttggagaaggggtgacaaggacgtgtttcaaggcaccgaaactgtgaggaactgacaacttagccaaaggcttttattccctagctttaccaaatattatgaaaggaagggcagaggggataccacccattcagcagaaatggcacagactgtgggacctggtgaagatctctccaggatacctcagcttgggtgagtttggcagggctgcctcagagggagaggcctgcaccaatttggtaatccacccattactagtcagagaggcgggccccacacaaaccagatggcactatggctgccccccaccaatggactttactgctggggtgggagaggcctgtacaggcaggtaactgacagggctgcctgtcagagagttgggccccacacaaagcagacagcctcacagccgtctcaccgatgggctcagctgccacagtgggaggggcctgcatggccagtaacccactgggctgctggtcagagaggcaggtgtcacatgaggcagcacactatggctgcttgttcatctgatcagctccactgcctgccagggaaaatagtggctctggaaagagctttggtagtgacagacctcaagtgttacaactctgttttgctgcctctccgatcctcagtctgctaatcactttttgccaccattggctctgctgatcagtgtcccatgaatcctgccaattgctgcttcactgattgctgactgctgcctcattaatcacccactgccatcttctgtctttgccccatgttgggtgccaagctgatgcagggcaggagagccccagagttgagcttaatccatgaggattcttggctttgcccaggaaacaattcaagggcaagccagaggtagaaggaaacagctttattgaacagacagtgttacagctctggtggtgttgcagctctgtgactgctcctgcagagcaggcccatcccatagacagagagtagcagccagggcagttttgcagtcacatttatacccatttttaattgcatacagattaagagatgaaggggtggtttattcagggaaggggtggtaatcgttgggtcattgccatggaaagggtcagcaactctggggtatcgccatggcaatggtaaattgacattggcagtggtgggaatgtctgagtgaaagcttctttttacctggcctttttaagctggtcttcagtctggtccggtgtccgaggcctgcctctgtagttgagtcttgcctcctatctcagattgattatttgctgatgtttataatacaatagcactaaaatattttagtatttatttaaataaagattcatactgaagttttattcattaattaaaaccactcaaattaataactaaatggaatactgtcatttaaaatttttacgttacaaattaattggtaggagaaagaaagatttttgtcctgtaaaattgagtttagatattatttttaaaggtaactactcaagtccaaattcatcaaaatgtatacatcaaatatgtatatttttgtatatcagttatacctcaataaagtataaaaaagtaactactcaaaaatctttactcatgtagtataagttgagacaacttatccaagaaacattacttgaatactgattgtgacaaagcctggagatagaaagaggaagaatacatatttttgttttcatgtttagcagggaagaaaggaatttggaattaagtgaatgaaatgtcagcacatcaatgctgtactattaggaggagagagactctatgaaattaagaccaaaaaatcaatagatgctatctgtcctttgaaggcaaggtctaatattctttgtaatattgaacagcatattctatgcaaatacttaataagttattacagcaatgtaaatatcaggcagatattttcattcacgtttatataaggcaaatgcattagttagtgtaaagggaggtaatacataataataaaggtaacagtctatcaagaagacagaacaattttagacatgtatatacaacaccctttatataaaattaggaaaaattagaattacaatgaaaaaattagcagacccaacttcatagttgagtatttagcaaaatgctttcaaaaattaataatctttaaaaaatggaaataaaagctatagaaaacaaaatttacaagcttgaagatcaaattttcaattccacaaatacttgattgattagagagtgggtaacaaaactgtttaccaaattgtccaccaataaaatgggaatggacagattttatctctactcagtagaaattattgtaattaaagggccatgttgtacagagacaactggctataatagaattttgtccacttctatcttcatcacctaaaacagtgcctggcttatagtgggtgctcacttaacaattgctgattgaataacgaatgcatgataagtttggtaccgttttcatgatcatagagtagccagtttatatatatgattaagaaacttgatgtaacttcattatcatggcccaaataggcttaaaaaattgtttaccttacacacaacccaagtgtaaaatattttcttgtgtctcttcttggcccatataatttgatttatagcccaaattgggcacatttatagcctggagatgatattttttccttcagaacctgccttatgttacattgtatatactttcactttctccacgatatacagaggttttcataagatcattgcatatttacattgtagtagtcaataagtcaagagagtaaagcgagttctagatggaatagacgtatcatgtggagtatgtggaatgaatcagtacatggaggactcagcaggagcactcatgaaaataagattgaggaactttgaaaaagatggagataggtggtatgtttgacttatgtgtaaaaagcagctaataaatggagacaatagcaaatgaaaataataaagtaataatggaaagttttaagagtgagaaattcaatcagaaaggaaaacaactgagagtaaggtgattacattgtagaacagaactcatggtttagccaataagtaaaactccatgtaagtatagctttgggaataattaaggaacttatttccaaaatcatctttattaaggtatattataaaaagctccattttaattttacagtttcatgagtttggacaaatggatctcagatttaatctcacaatcatgactccctctgcacaatgtccctcatacctctaggcagcccattcctccacttgaggcctgataaccactgatctggtttttgtgattattgattacttttgtctcttctagcaaatcttaaaagttgaattgtactactcagcataagtgttttgagattaataatgttattgggtgtatcagcggttctgttgcataaaaatattctgtggtatggtttctttgtttcatgctgctataacagaacacatgggactgggtaattattaaagaacagaaatttatttcttacacgtttggaggcttagaaagccaagaccaaggtgcaagcaggattgttttctggttccaagttggtgctttgttggtttgttctccaaagaggaggagcattgttgtctttatgtgccactataaatcctattagtagtggcattaattctattaattaggacagaggtctcactatctaaacacctaaaagtcttcacctccctatacctccatactgggaaacatttagaccatagcatatggatggagtacaattatctttattcttgcactggctggtggacatttaggtcgtttccatcttttcattattatgaataaagctgctacattcatacacaagtctttgtgtggacatatgttttcacaactcttgggaaaataccaaaggatggaagtgctgagtcatatgccaagtgtatgtttaattttgtgagatactgccagtctgttttcccaagttgttagactattttctattcccatcagcaatgtaggaaatatctagttacttcacatccttgccaacacatcatagccagaattttaaattttagccattttactgagttaattgtggtatctcattgtgattttgacttggatttcgtgataactattgatactgagcatcaatttctctctctctctgtctctccgtctctctctctctctctctctgtgtgtgtgtgtgtgtgtgtgtgtgtgtgtgtgtgtgtgtgtgtgtgtgtttggccagacttgttttatgaactatctgttcaatcttttgttcatttttaaaattggattgcctgtggcttgcctttttacttttctaaatgaggtctatgaaagagcagaaatttttaactctgatgaaatctaacgtatttttttatgcttcttttattgttctagctaagaaatattttccaatgccaaggccatgaaaattctttctggaagatttatggttttagattttaagatttgatttaattttggtgtagagggtgaggagggttaaagttccttttttttcccccccaaaagaaaccctccattcattcaaaaatatatgccccttgaagataagaaaggcatgagttttagaaataagaacagcatttttggccgggtcctagtgactcatgcctgtaatcccagcactttgggaggccaaggcaagggaattgattgagctcaggagtttgagaccaacctgggcaacatggcgaaaagccatctctacaaaaaatacaaaaattagctagccatggtggtgcgtgcctgtaatcccagatacttgggagcctgaggcacaagaatcacttgaacccaggaaatggaggttgcagtgagccaagatcatgcaactgcactcctgcctaggctacagagcaagactctgtctcaaagcaaaaaaaagaacagcattttcatatatttctcagtactctcttgtacatttctctgttactaatatgaataatttagttatgaatattgaggtttatttttaaaattcattatatattatatgtaatgatataaaattcattagataacttgaaaagtatgtaattgttacagactgaatcttctctagatatttcattgaaggataatgaaaaatatattttgttaaatttctttcaaaaaagtactatttatttttcctaataaaattaatattcattgtagaaaaaaataaaattaaaataaagaagaaaattaaatttgaattccacctagatgttgccctcacggtaaaatgaaatttactttttaaattaatatattatgggcattttgtctttcataagatatcctttaaaaatatggttttaatggccacacaatattttatcatatgtctatatggtagtattcataactatttgtcatgaattttcatgtagattgcacccaacattttaccactgaataatgttattataaatatttttatgaagttatctttgaaaatgtgatgaattttttatgtaatggaaaggatgtttcaatatttttaaggatacataacagttttacatatttatgaggtacatgtgatattttgatacaagcatacaatgtttaatgatgaaatcagggtaatggagatatgtgtcacctcaagcatttacgatttttttgtgttaggaccatcccaattcctctcttctagttatttttaaatatacaataaattattgctaactatacttgtcctattgtactaccaaacactattcctttgatcaaaagtgtatttttgtactcattaactaatttttcttttctacccctaccacattacccttcccagcttctgataaccatcattctactctctatcttcatgggatcaattttttttaactcccaaatgtgagtgagaaaatttaatacttgtttttctgtgcgtggcttgttttatttcagagaatctcctcctgtcagaggagaatctgcgaagggacaaatgacatattctgccatttgtgattacatatatagaacaggacggtcttgttttttggttgtttcataaatcctttcttttcttcttcttaatgtttttctttatggatacataattttatttggtagaaagttttaatttcttggtatttgttttttgtgtatctattttaggttatgctttgtagttaccataagacttgtagatattatcttataatcaatgattttaaagcaatgacaacttttctctggtcacaatgaaaaggaaaaaataagcaaaaaaaaaacccaaaaactaaaaaactctacattttcattccatccccctaactttaagacttctgttgtctctacttatatattttatattatcgatctcataacaaattgttttagttactatttttgataggttggtttttagttttcctactacatatatgagtgacagtctgaagttacagtttcagggtattctgtatttttttgtgaacttacttttgccagtgagttttatactttcatatcatgttgtattgcccattagtattcttttgtttcagattgaagaacctattttaacatgtcttctaagaagggttgatgttgaaattctccctcttttctttgtctgggaaagtcttcatttctcctaactgttctggaaacaatactcaatattctaggttggatttcttttttttttttttttttttactttagcatgttgaatatgtcatcccattccctcctgacttacaaggtttatactgagaagcctggtcctagatgtataaaagtttcttaatatgctatttgcttctttttttgttgctgttgttgggattctttttttttttgagatggagtcttgcactgtcgcctaggctggagtgcagtggcgggatctcggctcactgcaagctccgcctgccgggttcacgccattctcctgcctcagcctcccaagtagctgggactacaggcgcccgccaaaacgcctggctaatttttttttgtatttttagtagacacggggtctcaccgtgttacccaggatggtctcgatctcatgacctcgtgatccgcccgcctcggccttccaaagcgctgggattacaggcgtgagccaccgcgaccggccccgggattttttttttatccttgacctttgggaatttgaatattatatgctttaaggtaatcttatttgttttgaatcttcttggtgttctttgttgttctacctggttattcgtgttttttccaggtttaggaaggtttatgttgtcatttctaccttgatccctgtctctatatcctctttaataaaataactcttagattatcccttttgaggctattgtctagattttgtgggattagttcattctttttttattttttcacccctgactgtatattttcatacagtctatcttcaagtttactaattctttgttctgcttgatcaattctgcttttgagagactgcggcatttttcagttcgtcacttgaattcttcatctctagaatttttgcttgatttaaaaaaattatttcaatcactttgttaaatttctctgagaggattctgaattccttctctgtgttatcttgaaatttgctgaacttcctaagacaggtattttgaattttctgtctaacaggtcacatgtctttgccaatcaaggattggtcactggtgccttatttagttaatgtggtgaggctatgttttcctaatgtccttgatgcttgtagatgtttgttgatatctgggcattgaagagttaggtatttatcacgatctttgcagtctgagcatacttgtactcatccttctttagagagctttccaggaattcaaaggggattgagtgttgttacctaagcttgtcgtcactgcagctctttcagcagtaggtggcccccataagcccaggaacactgtggctcttcacttaattaaatacacagtcttggtggatttggggaagacagagtattccctgtgttcctaggcaaagcctcttgttttctgccctgtcttttccccaggcaaaaggagtttttctccatgtggcactgcctggagttgagggaggggtgatgtgggtactcccatggctctcacagctggtatcatgaggagtcacacctgaaaccactgccttccagagcagcacaatagtggtgctcacccatggaccacatctactactgtctgtctgccccggatatttttgtcaaggcccaaggctactttagtcagcagatggtgattcctgctgagacttggtccaacctgtcagtgcagtggattcccttctggcccctgatgggtctagaaatgcccttcaggagcaaaggtcgggaattaggcacttcagaaatcttcctgataatttactttgctgtgagtgagctggtacccacgttgcaagacaaagtcctctgtactatcttctctcctgacccaagcagaaagagtctctcccagtgctgcacagcctactcttaggagggatatgacacgggcactcacttggccaccacagctggtgttgctctggtccgtaccccaagtccactgcctctgagaccagcctagcaccagagctggaccaaggactgcagtcactgtggcctggttgccactcaaagttatttggagccccaggccattttaatcagtcactggtagagctgactagaattcagtttcctcccactggggcaaaggatacctctcagacccagtggtgttctaagtactccgtctgtgagcaccagcagaatttttccctgtgttgtgctttactgtgacagaatggccctggcttcaatgcaaagtcccacacttcctttgctgtcccttcttcaagcacccagattctttctccaggctgtgcctcttggggttagagtacgggtgttgtaggcaatgcaaaactcttcttcctatccccttcaatgcctttttctttgttgctatgttgaacctaggtatgtggtccttacctgcttatctggtttttatgaatgtgcttccttgcatggatagttgttgaatttgatgttcctgtgggcaacaatctctagagggttattttggtcagttcgttctaccttcctctgaaaagtagtttctgattatattcttagactggattattggtattggattaaatttttaaagacatgaatattcttttaattctcttgagagaaactttcactgctttaaatatccttgtttgtaatagtttaaaacaatagtttaatagttttaatagtttaaaaacaaggctattgatcttcttatctcatcatcagtatgtgtatacatatctcaccacagtatttatcatttcatttaaacacatttgtgagctaaattactttaaaatcagaaattctttgagtttttctttttttagttttttcacattgaataatttgatctgtatatatttttatttagagtaataatgaggatgaattttaattttttgataatgattcacttgtagcatatattgaattgtctttgctctcattactttttgtaatgttaaaattaacgtgtagaaaatctttatgtataccagggtctgtatacttcaaagtctgatccagatatgatctcacttcctccattttttgaggattaaagaggtaaactaaaaaaatgcattaggcatcacaaaggcctctagagaaaaatattaatatacacaccccataatttacctgaagttaatagtttaaaaacaaatctaattccttcaattagaaaaacttaaaaatttttttaaattaaaaattacctaaaaaaatatgtgatttactttttagaagacttattctccttttaggttgcaataacacatgatctctatttaaacattttgttcaatatagaaaaatagaagaagaatataaaagaacttataagtccaatacatatagattgttacaattataatcttggtttattttttatatttataatagagatcttgctttatttcatttttacatcctgcttttattgtctgaatttatatttaggacattttcttacagtattaaattttccttaaaccacagttttactgactgtacactattccgcctattacagtttgcttaaacattttcctctggattttcaaagggatgataaaagtttaaaaatctttctttactagttcctcattcataactatcattattttctgccacatagtatagttctatgtgttttcgttttcttctttaatctgtgtgttataatttatttcattattattttacttatttggggcatgcctaatcctacttactatttattattcaagatgtgagctggacctgaaaagatggattgctgaaggtgagagattgttcttaaggaaactggcactcttgttgaatttgaaggtttatgtgcattattataaacatattcaccattattagagctaccacttattaggtgtttactacgtagcatgccatgaattcaaagcacaagtgctgtatcacttagttttcaaacatcgctatggagaagttcagacagaatcatcttgacaaaattttctgtactcatggtctctgaattcagttcacagtttcttttgtaaagatactccaagcagcttcttttcaccatgacttcatcagaaatgcttttattaataccacttattgtttccatattgctaagtccaatgattctcaacctttattttacttgactgtcaataacatctgaaacagttcatcatccctgcctccttgtattgcttttgttacttgtcttagaggctgtcacaccctcctggttttctacctcactgacgacttcttcacaatatcctttgcaggttccctgtcttcaccttacctcctaaagttgaggtaggccaggaagcagaattagatttatctgttctttttctgtacttattcctttagtgatctctttgaatatattgttcatttatatgccttatcataaatttatcacttcaaactttacatagccatgttatactcctctcctaatttttagacatttgtgaccaaggcttacttgatatatctttttggattctaagaaacatctcaaacttaccatatccaaaactgaatttctcatctttcatcaaaagcttttctctttgccatcttttctgtgtcgatttttggcagtttcatcactccggctgcttaaaccccaaaatttcagatattctcaacttttccttttctctcccatttcacattagcacatcctgtttgcattattatatgcaaactttctttaaagtatatttagaattcagacttaagtcagatcatgccattcctctgctccaacatctttgctagctccccaatactcagagtagaaacaaaagttattatgatggcttactcaagttctgtgccttgagcactggagtcacattgactttaggtcttggtattctccccttattcattctgttccagtcacattggctttcttgctattcttgcaatgtggcaggtatatttctacctcagtacctttgtcttgctaactcttctgtatgtaatgttctttctccagtttacttcatgtcttaattttctacctcaccttattcaggcattatctcaaatgtcagtgactcagtatagcccacatggccacactatttgaaaaggtaaattgttccccatctctacactcgctgtccttcttctctgccttgtttttttaccactgtatttttcactgcatgacatattatgttttacttatttacattctttcttttctagtctccctctctgcccaataacaatcctgtaagtctattttactgctgtatctccagtgtctagaagcgcttgacacatcagatatgtgaatgagggaaggaatactgagtgaatatttgcttaatgctgtcatgatagaagaatctgcagagcaagaattcagcttttgttccaataataatttaccactagagagacttatttcaagaatttaactagaaatctatatacaacataaacagaatataagcatgcaaaatttatagagaaagcatgaagttttccaatataggttttccaacaactgaaagcttcacaaaatttgcttttatgatgtaattttatagtgctgataaaaatgcatgcattcttataacctgtaaatcttttcatattttatgcaaattgataaaatatatcataaccattataataggttgaatagtgtcccagaaaaaaaatcatgtcaacctggaccctcagaatgtaacattatttggaaataatgtcttctcagatgtaattagtcaaggattgagatgagatcatacacaattagagtaggctctaaatccaatgaccagtgtcctcataagaggagagaatgcaaagaagtacatagaagggagaaatttatgtgaaaatgaaggcagagagtatagttatgttgtcacataccaaggaatgcttggggtcatcaaagaagatgaacgagacaaggaaggagtttctcctactgcctctggagggagtgcagccctgctgacatcctgattttgcacttctagcctccagaactgtgtgagagaatatgtttctgttgtttttttgccaccaagtttgtggtaatttgttttggcagccctaggaaacaaatatagcaactaataacaatttttcaaatgttccacagtcatagaaatacaggaagagtcaaaacatggcttgtcccaaatcgcaaagtgattcagtccggatattgatgtgacactaagaactctttactcctggttcaagatgctaccacaaatatccttctccatctttttaactttaatattaggataaacaatttatagttctataaaaatataatacttttttatggaagtccccttattagaaaaacaataactacatattgagaatgtataacatttaccaacttatataagtaggctgctgcttatatttcataatttgcagtcattacttctaatgacaaaaatgctacagatgaattggggatgatgtcataatatgtgcatgtaactctatattaggtacttgctgtacctaatataaaatagtgtattcatattaatataaggaaatttattgcttcagcttgtgatgcagatacttccctcacctaacatagagttatatgcccatattatgacatatatgtcaaggtatttcttcctttaatgaagtggaacttactaatttaggtaattcaggataacctatgaagtggcctcactgatagaatttgtgttatgtaacactttagagttagtaatcctgtgacaaagaataaatgaaaagaatgatataaaggtagtcattgagttttagaactggtcacaatcttagaattcatgtaagctattttcaaacttctgaaaattctcaatgacatagaatacattttcaaataaaatctcatgtaaatacaatttattaattggtaaaatatttaattcttctatgtaaagaggggttagtcgttcatagccccttttttttcctaacaaggaaatagagatatgaggaaagtacatcaattatcaaagttagacaagtagtagaggccaagataaaactactgagagctttgaggattctgacctagagctctatttaaaaattacagtgatcgtgaaaagacctctataatttacaaccttgcttttgatctcattaattttatatctttttctgaaatgtgtcaacatcatcctatctgctgtgccaaatatcattaagagttactgatgtttacaaagaattaccacaaatcctttaatacactatttttgatgtactggtggaatatattttataactcagttactagcaactcactgaagatttctgcaatgccaaatttacagtaacccatttctcttctcaactcatatagtaccttatctaaacttctcccattataatctttttataaaaattataaaatttttagctatttatgtgcttttctttttttcttttttttgtgccttactgacagcagtttgagttcagaacctatgattgatctgtgatttaaggaaagcatctaacaaagtatctttcatatagcaggtacagaaccaacgtgaatgactaaactttgatgtagtttggacatcctttcctccttttactttttagacgttctttgaagatatttaagtaagttttttaggttattcacatgcgcacctagtggaattagatgaacatgaccatatacagatgatcttgtcttaccaagtgaaatacagtgtctggtagagtctgttgatgatggctatgaacattgcatgccctcaataaatatttcctgaatgatcatttgtaataggtccacatctcaagctgaagaacaatttgatgttaccaatgatttatagacttttactttgaactagttcctgaaattatcttgacattgtgctttttcctttgaaccttcttgctgccttgatgttcttcccctaccaatcttttctccacactgatggcagataaatcttcctgaaacactattttgtggctgttacttgcctgctcagtgtccttcaataatttccaactaacggcagctctaagtcataactccttactttggcaccagaaactgtctatggtctggctagacatagtcttagcttcaaatactttcctaaatatttgctgtatagtggttaacaatcgtacttttgtatgagacagatttgtattttaatcaatctgtcattacctgaaggtgtgaccttgttaaattcatttgctattgtgagcctcagttttttcatcttgaaaataagaataatgaccacatggatttttattccttccttcagtaaatatctattgagtgttttttatgtgctagtcacttctgtaggtattgggatgagtcaataaagaaagtaggcaaaattattttggagcttgcatgctagtggaggagataataaatataacaaataacctatagagtaggctaataagcaataaatgctatgtaaaaaaataagtggatatggggctattaggaatggaggaagagttctggagaagaggaaggatggaaatcagtctaagcataaatgagatattcttcctgccttgatttccagaagtcatggttaccagaagaattaagatttttagagatagactaattcaagcttcctattatttgttctgtcactaggtcctaggaaattggagtcatgtgtaaggaaaagaaagttggttttgacagtctccctatgtctttgtgatgtaaaatagtctagaggaaggaaatctgaatgttttttcttaagtgataagtgggaaactttcacaatcttgattagtgtattatatgggtagcatcattagaaagaatggaaattattttatacccattcctttatttgcatatgactgtctttgttgttttctttgtgtttgggtataaataagcaaattaggtaggaaatattaaaaagaatttcagcaaagcttttattcttaattcaaggaaatgtattttgacattaatgttttttaaccctcattattaaccctgtgatggcatctcttggccttcttatcatgccttcaaatgtgtgattattcattcctaacaatgattacatgtcacatttacctggaggatttgaaaacatgctttttcttagataccattcacccctgctccttttttactggtgctttaccaaatttctcagttgattctaatatgcatcctgacctgagaactactgacttacatggtctggcacatgcctctctctctaaccttatcacctcccattctctttatcacttgcctttctctgcactcaggccttcttttcatttgcccaaattgcaagttatgttcatatcagtccctttgcattttctactcttaactactcaaaatgcttttccacagagtcattcatttaacacttcaacacatatttgttaattaatcacctattcactctaccgtggatgaaactgaaaaaaaataacaattcttcttaatttggctgctttcttctcatcattaaatgattcaatagagagttgttggccaaaagaaccaaagtttcagttacacaggataagtggggagatgatgtatagcttggtggctacagttcagaaaactgtgttgcatacttgaaatttgctaagagagtaggtcttaaatcttctcacagcactacacacacaaaaaaacggtaactgtaaagtgatggatatgttaattagtttaattgtcataatgatttcacaacgtatacctataaaaacatcacattgcacgtcctaaatatatgcaatttttctttgtcatttatacttcaataaagctgggggaaaaagaaaaataaataaatatcacatcccaacatacctcacctgaccattccagctgacattgccacttcaaaattattttgtcttccttattttatgacagctcttatcttgttatatattttgattttgtcttacgtatgtatgtgttattgtgtttacaacctgtagaggatatgttctataaaagtgaaaatttgtatatcttattagccattttatcctcagtgcttagattagcattggctggaacataatgggtactcaataatcaatcaattaattaattaatcaatctgctttacaatgtaactaaatgtggtttctgtagttcctaaactgagtcttatctaccatgaagatactgaagtttaaggtttagcacccattttaatcatgaatcattttcaatcaattttatctttgtaaagcagtccttcaaaattcacaaatttcaagccttataataaaatctggatgtcttctgttcctaaattttcttccaagccaattaggtattagtttatcagaataacatttgttttatttcagttaaagtagtaaaataattttgctctaaagaacaagctatattggaatcatgggttgagtgaataaaacatttggaaccaataataaatggttgaggtaatagctcattttggaaaacaaaagccattcatttagcttttctcgtagaaatagatttttttgtcaatcgattatgttgggttacttataataagtaacatagtaaatacatttaattccatattactaagtgattaattcccacagcacatttgatatttttagaaaatttgcatatttttgtaacaattggcaaaaaattaatatggaaacatgaaaaattattgatatgggtatgcatttaaaataaacttgagcttagttaggaaataataattgaaataattccatctacacattttttaagcacttgcactatacctcctctaataatagagggcatactagtcataattgaactgataaatcattttatctttaagttatttttaatattgcttttgtcaataagggaatatttttctttgagaaagcaatgaaagcaagctttgtgcttgacataaaatctaggtgtagtaagctgtcattcaaaatcctttataatttgacttaaataaacctttccatcaactgcctctcaaggaaagggtactactgacttattcaaagcataaatgattcttttatgcctgtatacttgctcatattattttatgtctagcattaccatgctacttgtattagtatgttctcatgcagctaataaagacatacctgagactggacaatttataaaggaaagaggtttaattgactcacagttcctcaaggctggagaaacctcaggaaactttaaagcagaaagggaagcaaacacatccttcttcacatggcagcaggaaggggtggtgctcagcaaagggggaagccccttataaaaccatcagatcccgtgaaatcactaactcactatcagaagaacaggatgggggaaaccaccaccatgattcaattacctccacctggtccctcccacgacatgtggggattatgggaactacaattcaagaagagatttgggtggagacacagccaaaccatatcactatttgaagtgtagttctcaaaccagcatcatcatcattatctcagagcattttagagaaatgcaaaatctcaagtcccactcaaacccacttaattagaatctgtatattaacaatatatctgagttattcatatgaccattcaaattttaaaattaaggtccaaaatgcccttttcattaactttttaatttttgaaattctaacttcttctcaagactatactcatatccactacctattgaagtcttccttgaatattctagagaaatacgatctttcaatcctgggaattattgcattaaaaaaaacagtgccttcaattacagctgtttgtagataatcttcctctttgaggatgctattcatgcctcagctatcacctagaaaaatagatttaatagcttttccaaaaatgttgtttcattaattatagtcatgctttccaaaacattacaaatgaggtactgaatttaatgcaaggtaaatttctcagagataagaagatagaatattgtctgtttattccctaaactgctgctttcatgctaggattgcaggtcctcagggtcagaaactttctttctacttcctgaaagactaagatagtagcataaggacagaaaattgaagaggtttcctacattttcattatgactgaaaccttgaatcatcatctctacttgcattcagcctgggtatgaatttttgctttcctctttgttttgcgtgacctttgtcaagtatcatagttttctatgtctgatatggtttggctgtgtccccacccaaatctcaacttgaattgtatctccttgaattcccatgtgttgtgggagggaccctggggaggtaattgaatcatgggggctggtctttcccatgctattctcgtgatagtgaataagcctcatgagatctgatgggtttatcaggggtttctgcttttgcttctctctcatttttctcttgccaccaccatgtaagaagtgccttttacctcctgccatgattctgtggcttccccagtcatgtggaacttgaagtccaattaaacctctttttcttcccagttttgggtatgtctttatcagcagcatgaagatggactaataaaatatcttgtttctttatctattaaattgagctgggcatggtggctcacacaggcagtcccagctacttgggaggctggggtgggaggatcctttgcgcccaggagtttgaggctgcagtgagctctcattgcaccactgcactccagcctgggtgacagggcagctgagctagactctgtttcttaaaaaaataaacaataaggaaagataataacaatacagtaatatgctccttacgtcataggtttattactaggattaaattatgttacatctacagaaaattttgcatagttcttaatatataagaaacactctgaaaggttaataacaatagttattattattatttgattattttaaatctaggttacttttattgtagctatccaagaaaagctcacacacaatttcttaaaataaactatttaatttacatttacttataatgaattaccccaaatcaatagtgttgtactttgaggatggttgtttttcataaatcttagtgattcagctagccacacttatttaaataatatgctgggttgctgaggggcacaggatcaaaaattaatgtggcaataaaggcttccttgcttttgaacagatcaatatctgtaagtgaactagaggcacttacaactaaatatccaggaatgaattaaaaatagattctctgatgcttgatggagttaaggatctgagattatggtctttgagaaacttagtgacctgaatacatattcctcttctaccatcctccttttctgcaatactcatcaatttcaataggtattgatatgcctggttgcataaaaggacattgaagagttgagctctttattctaatagcttttaaaatacaaatgcgcatcataattattctctagtagaatctttgtatataacatcatatgcacaaataaaacatttataagtatgattataaacattcttcaacctcattacagatctaaggaagctgacaaagagtaaagaagggcagattcagcatctacgtgaggctgatatgtatgctttttgccgagacaaaaaagattaaaatgtttaagcctcgtcaaaagtctgtgagaaccaaatgaaaggtagattatattcttcctcatattccagattattatttactaattcaatggatagagactgatggaacactattcagtgcaagacattaagttatgtgctgtgatatgagagtaatccagagagttcagctaatattaaacttaaaagttaaagacagaattgcatgttgaattacaattgtgatatatatgatagcatgtaaatggataatatgatctcctttgtgccaaggccctaggcaaggaggaattaacagtattttggagacagggagaatgctaatactgctggagcataggtggaccaaggaggctagtgacatggtcaaatcattgtagacaatattaagagtttgtttttaattctaaaagcagtggagcaccactgaaggattataaacagggaaccttaaacactagggtcagatatgcactaaaaaggattactaattgctatgtgaaaaaatacgttagagagcatgaaaagtgggtgggaaggaagacccgttaggagatattagagtagcttggaaatgtacataatggtagcctaaataaagttagtgaaaaagagagggaataggaagagtagactgaatcaagaaagaaaggtttaggaggagtaataggcatagtttgggatgtttgtaaattgtttatgaggtgtcgcgtgggtgatcatgatctttgctaagaaaatgagtttagtcttggataggttgcacttgatgttccctttagagattcatgtaagagttttgagtcggcaattggatacatatttctgaatcttagagaactaaggggcaactttaaaaattgaaaattcttattttaagacagatgaatggaaaaacttctctactcatataaaccttttaaatttgtcttctcatgtttattgacatgtgagtatgaaatagaggtaggcttccaaataatttagtcatgcagtggtttgcaagctttgtttcttaaagccgtaaggtatcgtgaaggtggctcagaatacctcgtatattgaggagatacctgtgtataggaagccaggctcttccttttcaactaaaggagctttacttttatgtaagttgcaatctcaaatgatattttattcatttaaaaaattttaaaatatctttattcacgaatggaaactgtctgctacattattaaatagtgaggtatctcagttcacaccctaatatttgagaatgaagccatgaaaggcaactatcataattatctccaaaattatttctttaaagactaaatactagattggagctactgcttatttggtctcatgcaaaattgtgttcatccttgtgatattttagaaatatagtttttttattatactttaagttctagggtatatatatatgcacaatgtgcaggtttgttacatatgtatacatgtgccatgttggtgtgctgcacccattaactcgtcatttacgttaggtatatctcctgatgctatccctccccactctgcccaccccataacaggccctggtgtgtgatgttccccttcctgtgtccagatgttctcattgttcaattcccacctatgagtgagaacatgcggtgtttggtttttttgttcttgcgatagtttactgagaatgatggtttccagcttcatccatgtccctacaaaggacatgaactcatccttttttatggctgcatagtattccctgatgtatatatgccacattttcttaatccagtctatcattgatggacattcgggttgtttccaagtctttgctattgtgaatagtgctgcgatatagtttctagaaactataggcaaaagttgcttaaattcacagtttaacactttgaattttgctttgtcacctgagaccagcaattcattgagccaggttatctcctttggctttcagaattttttctagctcatggtatacagatctgttgtctatatccaacagtcctctctcagacatagaatagcctgatatgtatatttttcttgctagttatttttttctccattattattattaatttactatatatattatcatgtctattactataatgtcagttgtggcattagtgagtagtcttgtcctttttcttgctatgaagggcaaataattaccacacaaagaatgcccctctgctagaaactgaaaggtaatttcagctttctgatgctctttcaaactgacactcaactgtaacaaatgtgtgctaggagaaattaacattttttctctcatatttcactataatccacaagaacaaacacagtaccaacatttatcattttagttaagtgaaatgctaggaatcaaagtgacaggctctgagagaagttatactgtggaataaaactttatgatccatttgcaaggacggaaatgtacttggctcatcttagtaagtaaataatgctaaatgtatttaaatattgatctgttttcagtggaagggtgaaatgaatttcaaaatatagaggctataaatgtatacaaagcattttctactgtactaccaatattgtgctatgtcactttacgaatctgtgagtaagttgctgaaaactgcaaattttgttataagttgtagtagtcatctatcaccaagtttgtatgttgaagtcaatgtacctaagggaaaatagtgacagagacagattagtttctgcatagcatctgtcagtgtagatagctctcaccattttataggtgagaagcttaactatctttaacaggtaatataggttctattctaagatccactgtctgtttcctttaacaagcaccgtgatgaggctgtaacttctaccttgatgtttggagacatgttcaataatcttgagcaaacataatacttcatttttatttttcaaaagatttacaaattatcaaataaatttaattttatacaaaaataatcccaaatgacagacatatttaatctgtctggggaaaaaaaagaatatgcaataggaagttttggtattttctctgccgtggtgctgaggatatttaagttaccgggtatatttaaggtgctgagaatttttgttagaatttgaagagaaaaacacagaaggactaaattttcttaatgtattgaaacaagaactatttttatctggagataaattagacaataataacaattttataaagttaatttatcagaaaactaaaaagcgatattgaaataagtctattctgtttataaactaattctgtcttgcatagagtgaaatttgatgtgaacagcaagtagcaaaatttgctgtagtttcttcaatgtttgctgaatttttgagtaaatatgaatgttattttaatctttatgaattctaggctgagatagaattttcaaagaaatctgatgcagggtcttatagtagcttagaaaatataattacttacggtatgaaaatattatcaattcattcaatttttttattttaaaaaacgtatctcaatagtttctacctaaaagttgtgataaatggtaattaatattgatatttatttataaactctttaagtattagaaaccacaacttagattttgcatttaaaataatgtaatttaattctcttccacctcttctcttcctttaatttttgggttggttggagttatctggtaaagtgaatctatgacatacactgaaacgttaaatggatggttttatgtttgcagtaatgaaagatttaagctttaagtattctctcaaactctgatttccaaaaatgaaaaattaaaatgagattccatttgcataataaagtagtgacaaagaatttgagtgtaatttatttcattgcaaccctttatgtccttggcattctatctcattacataaacatgctgtttaacatgtggcagtgtgtattggtctaaatggtatgaacatatttcattctgtgccctttgtattgtgccatactggcattttcaataaaggtatcacttaccttcttccttctggagaaaatactgtgcttcttcctaaaggaaagcaaagataatgtgagaacaagacaggtaaatgtttaatggtatcacagaactgcaataaattttgctcgttagcttaaggaaagatctatcatattttattatacctgtcatctttaattttaaagtctctttctataataaaattcttcttaagtgaaatccattcagtgcttttttttttatttatagaagctacaactttagaagtttaatgaaatacccaattcttaaactacattgtcatcatggaggttgtacaataatataatctgtttttgagttcttgtgtcttaacatttatttggaatttgaaatgaaaaaatcataggttgggtttattgcaggcttaaattatttttataattgactagattattggcaatagttaacatcttcaacacagtcattatgtgtgcaatcttgtacttgtatttgaaagtgtatttaggggctatatagtaaaggatactagctccagaagactgtagtatactaaaggtatccagagaagttaacattcaaatacatcctaacagtgaaatttggagagaccaggtttctatcacttttaatattatttaaatattattggaattatataaattattttttatttttatgttagatcaaccatcttttaagccagattgtgagttatccatttggttattttttcctttaatcaattttattgaagtgtaatttacaaacaatcatattcaccaattttaagtgtgcattatgatgtgttttgacaaatgtatacagttatataagcaacatgatgccctcctctcaccccaagtccaggaatttactgatctatttttaataattatagcttattgttctacatattcctgatgcttctctttactatttgttttatatttcctctcttttttttcattttggatagttttcaacactatcaggttcactgatcttatcttctgcagtattaaatctgctgtgaattgtatccagttctttacttctattgtatttttcatctctacaaggagttctgtgataaaatatgcataatttttcgaatgactagggggtcaaatcctgttgctgatgttttcatttgaggaagttccttaattattcagtgccttgcaatcttttatctgaaaaatgggaaaacagttccatctgtgttgtaagatcaactacaactatctatatgtaacacttaaaagtaaaaagtaaactttctgtaagtaccaactattatttttattatcagttagtatttatgacttattaaatgcccattcttagaaaaactaaatatgcctattatttgtaattctcagctaagcgcatcacgttcctaagaaaaagacccttacatcctacttaactcgtcttccctccaaaatgtaaatgtccatttctcctgaagtccatttggctgcatcctgcccagactcttatcttcactgtaatacatagaacataccttttctattgttattgagttgtgtcaagaatttccttcctgttcagttgtattcctcttgtatatcaagctttccattctactttgataatttacatatggattccttttcataggactgtgagtgactggagagaatggattttcatatcatttgttctattttcagcaccaaactcagtacccggcataatagttacctcattctgaaagacaaaataaataaataaataattataggaaaacaaacacattatgacagttttagtggactccatcagcttaatacattaatgggcttgcttcttacctgtcttggccagctgtgaaaatgaagagctgaccccaaccactgcttgacatcacatgaaaacatgtcctgactgaaggtctcccagaagagttccaggcctatttgcctgatgaattttcctgtttcattatttattaaaatgctattcagtaggaagctgaatttgatgatagtttgcaatgttgcatttttattggaaatctttggctgtatttagtttccttggtgtaagttgttacgtgatctcagcataattgttcaggtcagagcacttttgtccttttgtggtagttctgaaactggcccttggccagatttataagtgtatctacaagaagtatgaaattgctagatagtattatcagtgatgaggtacggaaatatcgggcatgagactatctgactctggcagtaaaaagactgtaactctgtgactttgcctccttttcaaatcagtacctcgtatttactttatatgctaaagagctggcttcaaaccgtcaaatggtacatgcattaacatggagaaggtttattttggaagaatctcatgtagaaaaggcaacactttcttttaaaattttgacttctaaatcagaggaaaaatgtgtcatactcaaaaatatatatccctcatttaaaacaaaagagaaagacaggtattgttctaaatgagatattcctgggtaagtcagatatcacacagtaatcaataagtgctaggattacaacagtatacttggtcatataatacacatccgcaatattgatactgggatttgatagttatgcttttgaaaatcactacctggagtcatgattttggcagcagtttctcaattcgaatttatggacttcacaattgtaaagttgctttgagtagttattttttaatcccctgccctcaaatccttttagcccaagtttatcccgatcaccgtgacaagattttcatgtcacaatagaagactcttttctgtactagtgctttaactagcaaaacagcctttgtttgttgaaagcctctgaaagggctcagaatgcctacggaaatgagtcatattgggtgtaacaaagtggatgaaggggagaattataagagagaactatgaaaagctgggcaaaaggctgctcgtgcaggatcttctatgtcctggtaaaacttgtatttcatctgaagtacagtgggaagccactaaaaaatattaacgatagaggaagggaatgagaagaaataatataatcagatacacattttaaaatttttccttctggatgttgtttggcagttagtttggagggaaataagagaagcgtaagagccagtaaacagggtatcacagtagtccaaagagaagagaggaaggtggtttgaacttaggagcaagggattcgaatgcctagagttgatatccatttatacacacaataatatgtcttggtattagattggatctaaaggataaaggagtaggaagaatcaggatgagagccggatctctggcctaagcaaatgtttaaatgctgatttcatttaaataaaatcgggcaagtctgtgggaagaagaattggctgggagtaaaaagagatagggttcttgtgaaactcaagttcgttgttgtctgttggatttgagagcctcataattcatctaggtggttaaattctagtctgggcttaagggagaggggcctttactgcctctatcttggaaacaagacaactgttaagcaagaaggtacctctttagatacaaagtagataaatattattagactcaatcattgtattgaatgatctcacgcttcaatgggagagattaaatatgtatacacatgttaaatgttcccatagtaaagcctagtcttatgtttattgtaatgaatttgggcatattaacttatgaaagagcaagaagctagggattatattagtctaaggcgtctttggaggaatcatactacaaaattaggtgctgacaattgacctcaaagacttgaccacatagacaaaaaaaggaagatagtttgccctttaacttcctgggcatggcactagataggatgataactcaccctgagttgggagataattgacttcaagcatctttgcagagaaggatgctatgaaatcatttatttagttttctgaccaaaactattgcattatttgcaacagtactaaattaatagtattgatcaaataaaaatagttgcaatattaaaaggtctgaaactattcctacagttaggattaatcccataagtattcgggggagaagagcaccatagaacagaatgttttaaaaactatttttaaattaatattgttttgacaaataattgtatacatttgagggtaggaggtgacatatatatatatatatacacacacacacacacacacacacacatatacaatttagaatgattaaatcaagttaattaacatattcattgcctcttttacctatcatgttttatggtaaaacatttgtaatttactcacctggttatcttgcaatatactgtacgttgtcattgactatagtcatcctgctgtacaatagatctaaaacttattcttcttgtcagaaactttgtatcctttgctcaacaacttttcattccctctcacctgctgccacctgcccagccgctagtaaccaccattctactttctacttccatgagttcaccttttttggattctccatgtaagtgaaacaatgcagtctttgtctttttgtgcctcgcttatgtcacttaacataatgtcctccaggttaatccacattataaaaaatggtaaaatatcctttttttgaggctgaatagtattccattgtgtatatacactgcactttccttatccatttatcttttgatgggcacataggttgatcatggaccataagttttaaaatatgggcaacattggaataaagcattgacggtgattataagtagctgatgttatacagttgtcagaagcaagggcattggtagccctcttgagtaatatgcatctatctaaacccttggtgaaaatttaagaggatgatgaggatctaaatacgtaataaaagtgacatatttttaagtctttggagtatttatttatattaagttcaggtgactaaagtatgatttttttgcataactcaggaaataaattgagccaagtaaacagtaaatgccagagatggtagtaaaaatggagaattccttctctttttgaggttcatcatgttgaatttaaattgaaccttaaaagtgggataatttatgtcaaattttgttaatctcagccatgccacatgcttgtaataatagatagaggtgcaattaaggagtaaagttacatattactgttacatttttccagtgccttaagaatgcctgtatcctctcctagtcaaacatttcaaggacatttctaaagaattaatacaaaatgatataaaattgagtaaagcaatactttatgcagctagatttaatcttgttaaacatgcattaacttattttttggcctatataatctagaatcaacatacggtcatagatctgcattgtatatgtttcaaactcttaagtataaacctaaatctaaaatcatatccctctactgcttgaaaaggccacatcctttaaggccaaaaattaagagagagtggaaagttcttagtttgcctgattaattatctatattccctcctttaaggcaccaatcatgatatatatgtggtctaaatacgttgataaaagccaaccaatataattttcctcttttgggtttgtgtgcaaggaatcctggagattaaatgaagagtacttcgtctttgaagctaacttaaaggcagaatttagatatctgcaaaaatgtggaagagtactcttggcaaggtggattacgtaaggaaaggtatatgggtgtagcaaggcacagggcaattccagggagaaagtgaatatcacagataactgttgagcatttgccatatttatgcacactacaaaatactacagcagtcaaatatgcacgttccttttcctgctctcatatgtcagggatttagttggaaatgctaggaagtgaaagatattgattgaaatgatgttttaaggcatgttgatatgatctcagaatgcatggtgttttgggtatagaaaagtccagaggtaaataaatttgtcagaagacaatagaattaactccagtatgaaatggatgctatttaccttcagagataaaacaaaacaaaaaaggatcaacaacatatgacaatatgttggttgaaatagaacaacatatcgaagtaatttttcttatcccagaggagtcatagagtaacataagtagcatttattggaggcagcttatgaaaaatagttctatatagtattagtattctttcatttaatctttctgtagactggtgctttttttcatttctgttcatcagatgtgaaaaattaaggcctgaaaaaattaaataacttgctcaaaatcagacaattagtagatggtagtgttggcattctgagtcaggcagctatcattttaaaaatgatgaggaagagaaaaagatgtaagaaaggtgacaagttgtcgcagaagaccaacagagaagatatatttgccaatggtgtgttctttgtgttataatttgtatttagaagactttcccacacttaattatgtggattgccaatgttagcatcctgtgtctgtggtataaggtctacttgtaaaaaataagtgagtaactaatatgcactttcagttttttagaataaagtctttacacatttaatgcagaaatgaaaataagtcattggagaatgataaagtttagaaatccttgttacaagggaattacgctctttgagtcgtattttgagaatgtgtttcagagtctggcataacattcattacattgagtggggctctgtgactttgaaaataaaacaaaagagtaggtttgagaatatggaatgataaatatcccaaagcagtgttagcaacaagtctaaatgaatagtttaatgtgcactttcctagccatacagcttacaaagcaaaactaaaaactttcttctgcaaatgtgaactagttcagatgaatattttagaaaattggtgtacaaatggtgatagctgttgtttcaacatttgagaagcagattgaaacacaaaattagctattagcctacagcttaagtactctctaggaagaagaaaacaactgaagctagcaaattgactttcatttgggatgggtgcccatggttctgatgaaactctcatgcagtaacttccaaatctctggggacatatgttcaactgacctttgggaagtagagcaaagagaagctgggcagctttatacaaaatcacccttagcatttcactcagcaaaaccttctccaccagaacacagcattgcatagatttcaaagaaattgaagcctaactgggagaagaacataataattcactcataatgtttggaatactgtttaacacattccaataaagcactggctgggcagggctagattgtgatggagcaaaaaacgtgagaatgagctgacacctggtcaaatcgaaggattgaggattcagggacctgaagataagcctgaatagacagctggagtgagggacaaggaatctggaaattcagtccgagtcagatatattatgagatgtgaggctgcgctggagggtggaagcaagatttggaagagaaaagagtaaacactgtccagaggttccagtgaaggaggagtgtatgggcaggaggatatacaacatgtcttctttagggattaggccttgattcttaaaaatatataatgaaccatcattagaacactctttggccactttacaagaaaagaatgaacttagtgtaggtatggtagtgaggggcttattaactagtggtaaatatagacatccaagcaaataattacactgtattttgttaaacagggacaatagtatgaaatggttaaaggggataggcttgactatatttaattctcatttctgccattactggttgtgtcaccatcaagaaattgtttaatttttttaacatctatttatacttacttaaaagggggaaataatattatcagtgttactgggctgttgttttggatcagggtgttgaaggtcatcatcatctgatgatcactcctattttactaaggacaagcttgtacttaatgccaaagagagaaataaataatgtgaaaaggctgctgctggtgtcaacaatgtgtttgaaatcatgggagagtggatcatgaaaatgaaacattaatctgataattgttacccttttaaaggggaaataaacctttcagggaaataataatatctgataattttgtcctagggctttataatatagtgacttaccattgttatgtttttatgttatgttttcaatccgtaagttcttcaaataactagaaaaacagcaaccactatgttgatttaaatatttcagtattgtgaagtaaaagaattagaaatgcaatggtaattaatagttgtgtgttttaatgtatcatatgcatgtttataattagtgtgctaagattatatatgcttgttcatttaactaatttctaagggagaagttcagatacaaactgtgctttgatgaaaataaaataaaagtgaatgttaggaatctttaatgctatttataatgcatgttggcactttactgtataggaaacatatctggacctaaaatggaacaggaccgagtaatttaatgctaaatttttcattttacatataattcattgaaaaatacatgtatgaacaaagttcaacctgaacactgaatgatctgattgtataacttgcttctgggcatctagattcatgaagctgattccctaataaaggtaagtcattctggaataagtgtatccccttctagtaatttctaaacaacaaattgcatttgcaatatattgtcatgggttataactttagtctgtgaaaacaataccatgatactttttaaaaaaaaatttagaaaataaagtggaacaaaaaagcagaaaaccaatggcagcactaacagtgaaaaagtcgatctgctctaagtgctgcctcatcacccttgcctattaggcaaattatttttattgatgcttatagaagtaaactaatattcattttatttggacatcttatatctaatacccaattttctttcatcattaaaactttaaaatcctacaaatatttactttaatagaaaatatactgtgaaattagacatgatagactctggggaagcatttatttgattaggaaaggttagttcaagctgttctttatgaaggaatattaataaattcagaagatgatatatttacgactaatatattttatatttttaccaagtatgtgaagtcaatttataaatcacagaaaattatcaagattaacaccatttacaactattgtatatattaagtttttatgtgctatatttgacaactttagatatttactataaattaaatatcaagttcattctgaatagatgtgtacaaataaagtgattgtaaatttattgaataaagtggaataaagtagtagtagtatttagaataatatactgaattaaaaaatgatttcttccaacattcatagtagaaagcattattaatatgataaatttggccgggcacagtggctcacacctgtaatcccagcactttgggaagccgaggcgggcagatcacgaggtcaggagatcgagaccatcctggctaacatggtgaaaccctgtctgtactaaaaatacaaaaaaaattagccgggcatagtggcgggcgcctgtagtctcagctactcgggaggctgaggcaggagaatgtgtgaacttgggaggcgaagcttgcattgagccgagatcgtgccactgtacttcagcctgggcgacagagcaagactccatctcaaaaaaaaaaaaaaaaaagataaattaagctaaattcttcttgacatattagatgatttgcaaaaggatgccaaattttggtggtaatgacttttattcttttacttttcaaaaaatgtaggtaaaccccctgtgcaaccatgatcatgcttcaagtacttagatcgtttttcttttgaattaactcttgtatattcaacagaacacttaattgttttcttttttttgttattattatactttaagttctagagtacatgtgtacaacatgcaggtttgttacatatgtatacatatgccatgttggtgtgctgcacccattaactcatcatttccattaggtataactcctaatgctatctctccccactcaccccaccccatgacaggccccagtgtgtgatgttccccttcctgtgtccaagtgttctcattgttcaattctcacctatgagtgagaacatgcagtgtttggtttttttgtccttgcgatagtttgctgagaatgatggtttccagcttcatctaagtccctatgaaggatatgaactcatccttttttatgcctgcatagtattccatggcatatatgtgccacattttcttaatccagcctatcattgatggacatttgggttggttccaagtctttgctattgtgaatagtgctgcaataaacatacgtgtgcacatcttcttatagcagcacgatttataatcctttgggtgtatacccagtaatgggatggctgggtgaaatggtatttcttgttctagatccttgaggaatcgccacactgtcttccacaatggttgaactagtttacagtcccaccaaaagtgtaaaagtgttcctattcttccacatcctctccagcacctgttgtttcctgactttttaatgatcgccattctaactggtgtaagatggtatctcattgtggttttgatttgcatttctctgatggccagtgatgatgagcattttttgatgtgtctgttggctgcataaatgtcttcttttgagaagcgtctgttcatatccttcgcccacttgttgatggggttgttttgtttttttcttgtaaatttgtttgagttcttcatagattctggatactagctttttttcagatgagtagattgcaaaaattttctcccattctgtaggttgcctgttcactccgatggtagtttcttttgctgtgcagaagctttttagtttagttagatcctataactaaactattttagagttgatcaacaatttctgtatatgcaaataatttaagtgtctatactaatgtaagaatatccatgacaatattttttatcttattgagaaatatatatcaccattttattaaagatttaagctttcttagatgatttcatctaagaaataatacaactaagaaacaattaattagattagatctcatctaatatagtttagttataaacatttgcatatctatattaaatactttccgtgttttcagcttttttgtatttaatgtaaaacccacatattgataacttgtttaaaatgcataaaatcaacgcctttgatttgcctatttaataaataaaattgaactctcagttcattttaattaaaacatttattttatgtttaattttctacactcagtgctgtgttatacataaaaataaataccactgcctgttcattttggaaccaaagaagggttgtatgtaaattaataagaattagacattgtcatttctctcaggagctcaggggcaacttaaagatattctcagttatttcataactatcatttaaattttctttttaaaagtttttgtttatatttggcacataattttacatgtttatagggtacagtgtgttgtttcaatacatgtatacattgcatgatgatcaaatcagtgtagttttgatctatccctcaatgtctatccctcaatccttgatcatttctccgtggtggtaactttcaagattttttgtctagctaccttgaaatatgcaatacattgctattagctaaagttaccctattatgtgatagaacatcagaacttattcttcctctctaactgtaactttgataaaccaacctctaccctaccactcccaccttctcccttacctcttcagcctctacctaaacactattcaactctccacttctatgagatcaacttttagaaatttcatctattagtgaaatcttgcagtatttgcctttccgtacctggcttatttcacttgacattttatcctctagatttatctgtgttgccacaaatgacaggatttccttctggttttaatagccgaatagcattccagtgtgtaaataccacattttctttatccattcattggttgatggatgcttaaattgcttccatctcttgactgttgtgaccagtgctgcaataaacatgagaatgcagttatctcttcagcatactgatttcattttctttggataaatacccagtaatgaaattgctgaatcatatagtagttccatgtttaattttttgaggaacttctatactatttttctataatggatgtactattttatattctaactaacagtgtataagagttcttctttctccacacccttgccaacatttgttatcttttgtatttttgataatagctattctaactgggataaggtgatatcttattatggtttttatttgcatttcttttgatgatgagtgttgttaagcgtttttatcctatatctactggtcatttgcatgtcttcttttgataaatgtctattcatgccctttgcccatttttggatgggatttcttttttgctattgaattgtgtgagttcttcatatattctggatgttaaccccttgtcagatgcatagtttgcaaatattgtctctcattatgtaggctgtaacttcagtatgttgactgtttgctttgcagaagtttcttagttttacataatttcatctgcccatttttcttttattgcctgtgcttttcaggatctatctgaaaaattcttcttgaatcaattttgtgaagtgtttcccctatgcttttttgtaatagttttgtagttacaggtcttatatttgagtctttaatccattttgagttcatttttgtatatgtgagatagggtccaatttcattcttctacgtgtggatatctagttttcctgggaccaattttctttaattgaatggactgtcctttctccaatgtgtgttctcagcacctttgtaaaaagacagtttactgagatgcatggatttgtttctggcttctctattctgttctgttggtctttgtgtctgtttttatgtcagtaccatgctgttttggttactgtgggtttgtggtatattttgaaatcaggtaattggatacctccatccttgtttttttgctcaagattcctttgactattctgggtcttttgtggttccatacaactttaggattgctttttctattttttgaatgaatgccattggtgttttgataaagattgcattgaaattatatatcaccttggataatatggacattttaataatattaagtcttccaatctataaatatgtaatatctttttatttgtgtctgcttcattttttcattagcattttttcattactgttttatagtttttgttgtagtgatcctttacccccttgattgactttattcttagggggatatttttggctattataaatggggtaactttcttgatttcttttttacatagtttgctattgccttagaaaaaatgcttctagattttctgtgtttattttgtaccctgcaactttactgatttcacttactagttctaacagttttgtggtggtatttttagtattttctacacatataattatgtcatctgcaaacagggacaatttaagttcctttttaaaatttttttaaactatactttaagttctgggatacatatgcagaacgtgcagatttgtaacataggtatacatgtaccatggtgggttgctgcacccatcaacctgtcatctacattaggtgcttctcctaatgctatcccttccctagcccccgagcccccgacagaccctggtgtgtggtgttcccctccctgtgtccatgtgttctcattgttcaactcccacttatttgtgagaacatgtggtgtttggttttcttttcttgtgttagtttgctgagaatgatggtttccagcttcatccatgtccctgcaaagggcatgaactcatccttttttatgtctgcatagtattccatggtgtatatgtgccacattttctttatcaggtctatcattgatgggcatttgggttggttctaagtctttgctattgtgaacagtgtctcaataaacatatgtgtgcatgtgtctttatagtagaatgatttataatcttttgggtatatatctagtaatgggattgctgggtcaaatggtatttttggttccagatccttgaggaatcgccacactgtcttccacaatggttgaagtaatttacagtcccaccaatagtgtaaaagtgttcctatttctccacatcctttctagcatctgttgtttcctgacctttaatgatcaccattctaactggcatgagatggtatcttattgtggttttgatttgcatttctctgatgaccagtgataatgagctttttttcatatgtttgttgacagcataaaggtcttcttttgagaagtgtctgttcatatccttcgcccacttttttgatagaattgtttgttttattcttgtaaatttgtttaagatctttatagattatggagattagccctttgccagatggatagattgcaaaaatgtttacccattctgtaggttgcctgttcactctgttgatagtttcttttgctgtgtagaagctctttaattagatcccatttgtcaattttggcttttgttgccattgcttttggtgttttagtcatgaaatctttgcccatgcctatgtcctgaatggtattgcctagggtttcttctagggtttttatggttttaggtcttatgtttaagtctgtactccatcttgagttaattttttataaggtgtgagggaagggtccagtttcagttttctgcatatggttagccagttttcccaacaccatttattaaatagggaacccttaacacagacaaatggaaaatcattccatgctcatggataggaagaatcaatattgtgaaaatggccaaactgcccaaagtaatttatagaatcatgctatccccatcaagctaccattgactttcttcacggaattagaaaaaactactttaaatttcatgtggcaccaaaaaagagcccgcatagccaagacaatcctaagcaaaaagaacaaagctggaggcatcatgccacttgacttcaaactatactacaagtttacagtaagtaaaacagcatggcactggtaccaaaacagatatatagaccaatggaacagaacagaggcctcagaaataacatgacacatctacaaccatatgaacttcctttttttttttttttccaatttgaatgtcatttatttctttctctggccaaattgctgtggctaagactcccaatagtatgttaaccaaaagtggtgaaagtgggcacctttgtcttgttccagatcttagaggaaaaactataaacttttccctattcagtatgttattagctgtgggtttatcatataaggcccttatgttttgaagtatggtatttctatgcctaattcattgagaatttttattatgaggggatgttgaattttgatgtttgatttttctgaatgtattgtaacacatgtatgattcttctgtccttgattttgttaatgtgatttataaagtttatttctttgtgtatgatgaaccatcctttcatccctgggatgaatcccacttaatcgtggagtatattctttataatatattgtcgattctggtttgccagtattttgttgaggatttttgcatttatgtttattagtgatactggcctgtagtttgttttgttgttgtgttcttgtctggttttggtatcagggtagtgatgaccttgtagaatgagtttgaaaatattccctccttttaaagtttttgcgtgagtttgagaagaattggtattagttcttttttttaaatgtttgttagaattcaaacctgaagccattaggtcctgggcttgtctttgataggagagtctttcagactgccccaatcttgttatttgttattaattggctcagatcttccattacttcatgatttgatcttggtagcagttaggcaagagaaaggttgtatttgtccaggaatttacccatttcttctaaattttccaattcgttggtatatagttgttcataagtatctattataattatgtgtattggttatagtaccttctttttcatctctgattttatttagttgagtttttactctttgtttttagtctagctaaaattgtatctgttcgtattttcaaaaaataacactgttcatcggtctcttatacgtttttatttctatctcatttatttctgctctgatatttgttatttcttcccttctactaattttgggcgtactttgttctttttcctttgtcttgagctataacattaggttgtttatttgaaacctttcttcttttttgatgtagaattatgttgctctaaaattttctcatagaactatttttgctgtatctcataggttttggtatgttgtgtttccattttcattggtctcaaagaatttttacactaaaaataattcttcattgattcattcatgttgtcaaatgtctacgtattagagtttctaacattccttttgtcatttattcctggttttattctactgtcgtgagaaaatataatggatatgattttagctttttaaaaaaattgttaagacttgttctgtgacctaaagtatggtctatactggagaatgttccatgtgctgttaagaagaatgtatgttttatagctgatggattgaatattctgtaaatgtctgttaagtcaatttggaaaacagcacagtttaactgcagtgtttctttgttgattttctacctgaatgatctttacattgctgaaaatggggagttgacatctcctactattattatattgcaaccaatctctccctttaggtctatgtgtatttgctgtatatatttgggtgctctggtgtaggatgcatacatgtttacaattgctatattttcttgctgtatggatgcctttattattatataatggcttaagtttgatattgttgtcattcctctcttaaattttatctgaaacacatatagctacttacactctttttttagtttcagtttgtgtggaatatctttttgtgtcacttcagtttctatctttgtgcatctttaaaggtgaagtagatttcttgcaggcatcatttatttgcacctttttaaaaaatgttatatagtcactctgtcttttaattggacaatttaattcatttatattcaaagttattgttgataggtaagggtttattactgatatatttttactcattttctgttgttctttttttgatccttactatctttgtggttaaatgattatctttattagcacatcttgattctgtattatttttaatgcatctattataagtttttgctctgtggttatcatgaagcttacaaaaaaattatatagttataacaggtcattttaagctgataccatcttaactttaattgcaaagagaagaaactgaaacgcaatctacagttcaaacaccatccctccacacttttactttttgatgtttcaatttacataattttatattatatatctcttaaacaattatggtagctattataattaataatttttgttttagtcttcatactaatgatagtagtggtttacaggccacaattacagtattggtgtattcttaatttgtatgcttttaccacagagttttatactttcagatgttgttttgatacatgttagaatgttttcctttcaaatggaaggactccttttagcatttattcaaagacttgtctgttagttatgtatttccttagcttttgtttttctggtaaaatcattccccttcatgtttgaaggatagcttttctgggtataatattctttgttgaaaggtttttttgtgtgtgtgttttgttctagcacttctaaaatattatcccagtctttcttggaaggtagggtttctgctgaaaaatctgctggaagctctattggggctctgttgtatttggtatacttcttttctcttgctgctttcagtattctttgtcttcaatttttaataatttaattatgatgtgccttggtgaattcctctttggattgaatttaattgttgacttctgagctttctatacctggatgttgttgttattctccatatttggaaagttttcagccattattgtcttaaataatctttctaggctgtttttttcttttgtctccttcagtaatagaaaggtttattccctttatggtgtttcataatgcttgtaggcctttttcactctttcttggtctttcttttcctcttctcattggataaatttgtgtgttctgtcttcaagctcactgattctcttctcttttggtcaagtctgctgttgaagatttctggtgaggtttttaattcatttattgtatctataatataaaatttctattttttattgcttttgtcaaatttctgcttttattcctaggttgtttttcttaattttctatacatattttcttgtgattctctgcatttctttgagtattattctgaattctttgttagatatgttatagatctttaattcttctggctccattactggagctttgttaattcttttggtgaagtcatgttttcctgattttcccttgtgtcttcatattcattcctgtgcatttgctgaaatagccacctcttccatctattgcagttgttctttggtggttttagacttttaccaattgttaccagagtttaatcatgggcccgtttgttgcttcgaattctagggagaccttatagtgagcatcagaactaaaatatggcaccagaacttactcactgcccttctgctgtttcccatgctgaggatgacttattgcagtctgaagaaaacttaagcacacatcagaatttaattggtaaccttttaggttttgcaagttaggggattcttgacacaaatacttaggctttgtgaggaacccagccagggttttgggccttcacatatactaggctccctttagcaccaagataccaggcagcattctcagcatggcttcccaactgataggaaaacagagcagataccaagattttcatgcttgtcactgcaatcagtgtccccagtcttctttccaatttaccccacatcattgagccctgttggccctcccattgcttcctgtggaatgaaatcagtttggccccccatgaagattcccagactggtgaggagattaaacatccacctttatttcttcccaagaaactgtgagtctaaggaaattctctgagagtggtgttatgcctgcttgggagacgtgggcgtttaccagctgtggcttctgtcatttttgtggctcagggtatttttgtgcttcttttccaagttcttgtgaactcaaggtggcattcttgcctttgaatactttctaggtgtacttttgttgaggggagtaatgctgagggatcttctatcctgctctcttgctgatgtcactcctcttaattttcttttaagtattgttgaatacaaagtcttgttgcctactgatgtggtttgtctctgtgtccttacccaaatctcatgttcttgtaatccccaatgttggagattgggcctggtggcaggtgattggatcataggggaggtttctcatgaatggtttagcaatatctctcgatgctgttttcatgatagtgagtgggcgaattgtgagatctggttgtttaaaagtgtgtagcaccttccccctcctcttcctccttctgtgaccatgtaagatgtgcctgcttcctcttcaccttccaccattattgtaagtttcctgaggcctccccagaagcagaaaccactatacttcctgtacagcctgtagaaccctgagccaattaaacttttctttataaattacccagtctcagataattttttatagcaatgaaaaaacagactaatacatacctttaatttttctaattaaaggactaatactaatacctttcattagacctttaatgaattatagactaattctaattatagactaattctaatacatttaatttttctccatagaattattactaattgttattactttgctatagaatatccagataaagtgtttaatttcctttaatttttttttgttttttttgagacggagtcttgctctgtctccaggctggagtgcagtggtgtgatctcagctcactgcaacctccacctcccaggttcaagcgatcctcctgcctaaacctcccaagtagctgggactacaggcatgcatcgccacgcccagctaatttttgtatttttagtagagagggggtttcaccatgttagccaggatggtcttgttctcttgacctcatgatctgcctgcttcggcctcccaaagtgctgggattacagatgtgagccaccgcacccagccagtgctaaatttaatacattgaaggagagattcatttctgacagaacatggaacttaaaatgaatatgagtcagcctttcttactacatattgtagattgatctcttagtgttttgatcgacagctagtatctcagtcgtaccatagatcagttctcatttctgatgccactagtgtcacaaaaattgatttgccattactctgttacctctgatctttgaagtggtagggtattaaacttttctattggtgagaaacataattttggcacagttatgtttcaaatatatgttattgattgcaaagagaatgaatctttacacaatgctaaacaaacaaatacacataccaggtagatagtgactcagtgatatcagcattttacatactaaattattgcttgtagtctcagaaaatagtatttaatccctaaagtatacctttaaaattagaaaagatagtatggcaaatttagtaacttttaataagggctcaatataatctgttgctttagaattccatcactgtgcagaaaattgaccttattttgtgcatgtttcatttttcaaattgattttctgtattttacctctgtaattactacatatgtttcgaattttgtcttcagtcatttcagctaattgaatgtaaaatttatatgatggttatattgaaaatgatttaaaattattggttggtgaaattgctgttatattggtattgatatacaagcaataattaccttactttgtagagtaattacaaggatgatactcctctacttatagttgtgggagtttgattcatattatattttttatttgttgcgaattttattttcaggtttatgcatttattctgtgtgatttttggcatcctggaaacctgtgcccactatgatattttttaaataccttaaaaaattcttcactacataatctgcaagactgaagttctagtgtctttgatttattcttcagttgtttgcaatgtggttggaatttatggccccaaaccataatgtggaaatgagaaacaacactggaatctacattcaagcttgggccctttgctcttttctcagaggcttatccaagcacacagcgagtttattatcccttttcatcttgatgggacagcttaaattgactaattcccagatgcgtacaaatataagtaaggggaaaatgttacttaaatacttcgatttattttttttttgtggttaaaataaaaacaactgctgctatcaagagaagctaggtatatgtttctttaacttttgtgtgcataagaatcacctggagagatggttcgacacagatttctaagtataacagtcagagattttgattccgtacattgagcagttgggtgctttagaattttccttttggattagctacaagttgctgatgctacctgtacaaggaccatataatgagtagccctgtgatggatgataagcaatcagaggtatcttcctaatgtttaaaactttgaggaaaatgggtacattcattaagtaggcacacaaaatatcttccacatatttggatgttaatgataaagagaacttctagggtgcaaatctggtggtaactatgctgaacatatattttttcacagacattttacattagaataatcctgtgagattcttaattaccaaaactcattggacttcaaatggaagttgcatttattaatgattagttatcaagaaaattatgtgaattactgattgttttatagagaagattgttttaaaaagcatgtttgatgtatacattaaattttttgctaaatgtccttggggttgtggggtattgtaaatcaaatttacattaagtggatgattaaaattaaaagctgatttttaatctgttttctaataattcatcacaaatttaactaattaaaagaaaacttgctttcaatttgtaccagttgataactttttattgatgtactaaatcttgtaaattggttataactatttgtgaataaaatctcataacatatcagaaaaatggactgtgggttccaataacagtggattatccagttgcaaattagcgttttaatgagaactaccagaaaaactggttaatattttttaaataaaaataaattttacaacacaatgaccatggtagggagcacaggagaggcccagatgctggatttatcttgcaggtaattgtcaatttgcacgtgaaaattaccaggctaagaagccggaagaagttttagcagtcttcaaatactatgatgttcagagtataccaagtaggagcttaactacccaagctttcaattgataccactaaagtgttacatcttggaattgagattgtaatgggaagacttgtaagatggctcccagtgacccacattttttgtcattccctccctttgagtatgagaggacctatggatgtgatgggatattataactgtgactagattcaattttgtgaccaagatgaagagattctgcagatgtattaaggtcccaaatcagctggattttgagttaattagaaaggagattatcttaggtgcacctgatttaataaactcttcaaggagtgactgagacattgcttgtgagagagacgctcttactggccttgaagtagtaagctgccatatcataatagggccctgtggcgaggcactgtgagtggcctttagactttgtgagcagctgtcaactgacagccaacaagaaaacagggacttcattcctacacctgaaaggattgaatttgtcaccaatcgtgtgagctcaaaagataattctaaactccagaaaggagcaaggcctggccaacaccttgattttggttttgtgagcccctgagctgatggcattgataaactgcccaaatgccttacccatagaaactgtgggaaccttaaatgggaaaatgaaaggttgcgattattctgtatagttcctttcatttctaaacattatgttttcaagttgtgttagtattatattctgaattgagtttgttagaattgattccatatgaggaatatgttgtttattcatcaagaaggaatttatatacttaggaaaaggcctagaaatatgttcaccaaactctcaaaaattgatattatagttacattacatacctatgttagagtataggataaagaggcgatggttgggagatagagaagggaatgctaacattttgtttatgcacttctatactttagattttttgtatagaaggagcattgtttactctttactgtttttacacctgaatatcaactttaagacagcaatacaacacatcagggacaaaattgtttccatatatagtcttaggttgtctattaccaactatggcctaatctagacttgatgacacattaggaaatctatcttgtattcaacgcaaagatagaacccttcatatttccactcctattccatccctacccctccgtcagtgccccccaactattctcatggttatcaaattttagtatctggatgttcatcctcaacttgttatttgcttcattatgcttaattagaatctcattacagttggttgggtcaactaaaatttttctctcataagagacaggatcaactcccaaattccagtactattttgaataggagtggtgggagtgggcatccttttctggctctggttctcaaagggaatgcttccagcttttgcccattcaatatgatgttgactatggttttgccataggtggttcttattatttcgattcatatcttttcactcagttctcccttaggagtatttgggttatccattatcttggaatataattctatatcattttcctatctgaccttcgtatattaccacttgtgctaacaatttctctctggggttactttttattatattttattttttaaaatctttcattttaggtttaggggtatatgtacatgtttgttatataggtaaattgtgtgttatggagggttggtaatacagattatttaatcacccaggtaataagcatagtaccccatttgtagttttttgatccccaccttcctcccaccctccctgctcaactaggccctagtgtctatctttcccttctttgagtccatatgtacttaatgtttatctcccatttataagtgagaacctgtggtatttggttttctcttctgtgttagtttgcttaggataatggcctctagttccatccatgttgctgcaaaggacttgatctccttcttttttatggctacatagaattccatggtatatatatgtatctatatacctcattttatttatccagtctaccgtttatgggcatttaggttgattacatgtatttactattgtgaatagtgctgagatgaatatacgagtgtatgtgtttttatggtagaacaattattttgggggagtatatactcaacaatgggattgctaggttaaatggttgttctattttaagttctttgataaattgccaaactgatttcaagaatggctgaactaatttatattatgaccaactgtgtatatagtatagtgtaaggaaggggcccagtttcactcttctgcctgtggctagccagttatcccagcatcatttattgaatagaaagtcctttctccattgcttctttttttttcttttcaatttgtaaagaagagatggttataggtgtgcagctttatttctgggttctctatcctgttgcattggtctgtgtgtctgttttgttccagtaccatgctgttttggttactgtagccttgtagtatagtttgaagttgggttatgtgttgcctgctgcttttttctttttgcttaggatagctttggcaatttgatgtcttttttggttccatatgacttttaaaatactttttaaaaaaaattctgtgaagattgtccactggtagtttgctaggaatagcattgaatctataaattgctataaggtgttatggctttttttttttttgaggcggagtctcactctgttgcccaagtgcagtggcatgatctcggctgactgcaacccctgcctcctgggttcaaccagttatcctatctcaccctcccaagtagctgggactacatgtgccaccaccatgactgcctaatttttatagttttagtagagagggggtttcaccatattcatcaggctggtctcgaactcctgacctcaggtgatccacccgcctcggcctcccaaggtatgaccattttaacaatattgattctccctatctatgagcatggaatgcttttccttttgcttgcatcatctctgatttctttgagcagggttttgtaacgcttgtagaaatctttcacctccctggttagctgtattcctgtgtttttgtggttgttttgtggttattgtgaatgggattatgttcttgatttggcactcagtttggacattgctggtgtatagaaatgttactgagttttatacattgattttgtgtcctgaaattttgctaaagtgttttttaatcaaatttaggagctattgagcaggaattatggatttctcaaggtatgaaatcatatagttgtgaagagagatggctttacctcctcttttcttgtttggatgcctttatttctttctcttgcctgagtgcccttgctaagacgcttccatcttttgcccattcaatatgatgttgactatggttttctcatagatggctcttattattttgatgtatgttgcttcaatgcccagtttgttgagggtttttaacatgaaggaattttgaattttcttgaaaaccgtttccgtgtctattgagatgaacatgtgttttttgttttagttttgtttatgtgatgaatcacatttattaatttgcctatgttgaaccaaccttgcattcaagggtaaagcccacttgatcagggtggattagctttttgatgtgctgttatttggtttgctagtattttattgaggacttttgtgtctatgttcatcaaggttattggcctgaagtcttctctttttgttgtgtctcttccagcatttcatgttaagatgatgctagcctcttggaatgaattaggttagaattccttctcctcagttttttggaacaatttctgtaggaatggtaccagctgtggttcatatatctggtagaattcagttgtgagtcaatctggtccaggactttttctgcttgttaggctttttactactcatttatttttgatatttattattgatctcttcagggtttcagtttcttcctggttcaatcttgagaatatatttttcaatggaatattatatatttcttatatcttttttagtttgcatctatagaagtattcataatagtctctgagggtttttttgtgtgtgtgtgtgtatttctatggggtcagtgataatgtcccctatgtcatttctgattgtgtttatttggatcttctctgtttttttctttattcatatagctagtagtctagcaatcttatttattccacaaaaacaaacttttcgttatgtgaccttttgtattttttttctcaatttcattcaattcagatctgattttttaaaatttcttttcttttgctagtttttgggttggtttgctgttgtttttccagttcctcaagctgttaggttaggttgtcaatttgaggtctttctaactttgtgatgtagctttcttcttaatgctgctttagctgtggccctgagattctggtatgttttgtctttgttctcactgttttcaaagaaattcttgatttctgccttaatttcattgtttacccaaatgtcatttaggaacaggttgtttaattttcatgtaattgtatggttttgagtgatcttcatggctatttttatagcgctgtggtctgagagtgtggttggtatgatttcagcttttttgaatttgctgagaattgtttcatggctgattgtgtgtttgattttacagtacatttcatgtgcagatgagaagaatgtatattctgttgtttttggggtgaagagttctgtagattatctgttaggtccatttggtcaagtgttgtattcagttcctggatatttttgttagttttctcccttgatgatctaatattggcagtggggtgttgaagtctctgactgttattgtgtggttatctaagtcttttgtaggtctctaaaaacttgttttatgaatccgtatactcctgtgttgggtgcatatatatttaggatagttaggtcttcttgttgaattgaattatatgcaattatgtaatgtgcttgtctttttgatcattcttggtctaatgtttgttttgtcttaaattagaatagcaacttctgatatttttaattttacatttacttggtagatttttcttcatttctttactttgagcctctaggtctccttgcctgtgagataggtctctttaagacagtactgtatagttgggtgtttattttttatccaacttgctgccactttatgccttttaattggggcatttacccagtttgcattcaagattaatgttgataagtgggtatttgattctgtcatcatgttgttagcttagtattatgcagactggattgtgtaagtgctttatggtgtgagtggactatgtacttagttgtgtttttgtggtagccagtaacagtgttttatttccctatttaggactttcttaaagacctcatgtaaggcaggtctagtgctactgaattctcttagtacttgcttgtctgaaaagaattttatttctccttcatttatgaggcttagtgtggctggatctgaaatttttggttggaatttcttttctttaagaatgctgaatatgagtcccccatcttttctggtttgaagggtttctgctgaaagtttcattgttagcctgacggggtttcctttgtaggtgacctgccccttctctctagctgcctttattttttctttcattatgaccctggaaaatctgataagtatgtaccttggggatggttgtcttgcatagtatcgtgcaggggttctctgtattttttgaacatgaatattggcctctctggggacatgagagaaatttttgtggactgtatcctcaaatatgttttccaggttgcttgctctccctctctctttctgccatgtcagtgtgttatagatttggtttcttcacataatctcacatttctctgaggttttgttcattcttttttatttgtttatatgtctgattgagttaattttgagaactagtctttgagctctcagattgtttccccagcttggtctgttctgctgtttatactttgtgattatattatggaattattgtattgtttttcaattctatcagattcgtttgtatctatcttaaaacggccatttcttcattcagctcctgtatctttttattgtatttcctggattctttggcttgggttttgactttctccaggattttgatgatcttcattcctgtgtatattttgtattctatgtctgtcatttcagcctggtgcagaaccattgctggggatctagtatgggcatttggaggtaagaagacactggctttttgtgttaccaaagtttttatgctgtttgtttctcatctttctgggctgatgttctttaatctttgaagttgctgtcctttgaacgaagccttttgcttttatcttctttgaagccctttggtgtttgattgtggtatagggtgcctttagtcttctggctttgattatggaagattccagggggccgggaagccccagctgtgtcttctggccccttgaggttatgaccctgacggctagaagtgctgaagcgttcctcataagctggccccaaaactttaaggagaatgctggctgaagcgcttcgtagggttgttggcagtggtatcagtgctcacctgtgcttgccagtcactgtggccttgcagtggagtgcttttgtgtcagtggggtggtgcactagtatgggtgaggtgctgacaggggcgggcacaccggtgtacactgtgctcacttgcgccagagaagaagcggcacagcaggggtgggctgctggtggacacgaggttctggaatctgtgcacgcagttgcacccaccgctgtgcggtgggctgcccacacatcagcgagggcgcagtgctggcaggggtgggcaaggcagcagagtgtgctcatgacagcagcggtggggcagtggggtgcacactcacatgcctgctgtaggaagagggttggcgaggtcggtcggcccttgcgcacacactgccaaagcagtgaggggaggctgcagtgagaagaggctgtgggtgggctggttttgtcggcagagtccggtctgctggacttctctgatggttaggcatggactgccagcgaagaagctatcatgaaggcatcagggaagcaccctggttaggcatttgatgctgcattgcaagcgggagtgatcaggctggggctccaggagaagctggcagcaggagaggctgctcagatagaaatggctctgaaacatgggcaggaccgccctgttcccaatccgactgtcacccaaatgcaaaagccacttagaggagcttggtgagccttgggggatagacatccctggccatgctccactgcagccattcccccgacaaaccttctgagctatgcccaggttggagtcctggcactggcatctctcaaagcagctctcgctgccagatcaagtggtttgtgggggtcctgaggtctcctgcaactaggattacgggggtctgtggcaagggtgggccactcatcacctgttaaactcaccccttccccagtattcactgggggccaggagtgggtcacagggctcaacagccccatgcaggatttccagattcctcccgcttcagtccagtatcttcatcctccttccgtccactctcagtgccttccctctgaaggtctgcttgaagtgtgctagtattcccagtgcctggctgtgtcaggtcagccatcttggctctttcctctgtttttttttgttgttgttgttttgtttttcttactttttgtctttctgataattctcctttttttttttttttgagacggagtcttgtgctttctcccaggctggagtgcagtggcgcaatctcagctcactgcaagctccgcctcctgggttcacgccattctcctgcctcagcctccccagtagctgggactacaggcgcccaccaccactcccagctaatttttgtatttttagtagagacggggtttcactgtgttagccaggatggtctcgatctcctgacctcatgatctgcccgcctcagcctcccaaagtgctgggatttataggcgtgagccaccgcgcccagcctctgataattctctttatctacctcacccaaaatatacttgtagtgaaaatatacaatttcccttattgacatatacattgaatagaaaaataaaacaaaacatgcatattatcttctgaaaaatatgtatccattttctatagctagataaatatttaatggaagaaacaatgcctcatatgtgtgggcagaagttaaaaaaggaaaaataaaagatatggtacttcttttctaataccagagtttgaagtgcttccattcttattctactttgttttggttagcaacttaaaatatgaattattgccatcagaataaatctgatttagtgaatttattttaagttgtatttgaaaaaatagcaatatttgttaaaaatttaacaataaaaaattaaattagttacttcctggtctttgataagtcctaaagcatgacatcattgttgaacttagaaaatctctgtgctgatgtaggtacttccaatcattaggtgggattctgccactatatcaataagatgtgtctggtacactgatatttgttgacgtcactgattcctagttctctcaggagtctctctgtggctttccaacattcccctgggagaaaacgcagctatcagtggacaacttttcccattttattctgagtttttaaactattttctgtccacttgaaaatttatgttactcatcacattgccttctcctactttaattatactatgtttggaagaaatgaatgaaaacttaaatttaaatcacataataatatctataggaagcatcttactgtcacatattttgaatgttcctagttgcaattagttttcacccccaatatttagcttctcagtgtcatgattttgtactctcctgcctaaaaagaaaatctacgttctttctttaaattttaaaattatatttatcctaatattttacataactaagaacacatgactgtaatcacttgaaaggtattgtgaaaatacgaatgttttaggtacaaactcagaggtgccagacaaaatgaaattaatcagtatctacttgtgttgagcagttaccagcacagatggtaggaaattagcttattctttgtctcaatatattaatgatgcaaaattacatgtatttcactttggacaaatatctgacagactagcaagcaatattttagaaacatgaccccttgattgataatggagcgaagcatttaataccttaagtctaacttaaatttaatacattctatatcattttagatgcctccatctaagctttttaaattgggacattacacaaagtgatcaaaatagagtttcagtgactttgtggagtatagaattagaattttgaattcttcattcataaacacaggggtgatttttaaagattatgtttggcacttaagtcttgatggttgtctcctgagtagcctctaatctctattcagaagatttatattgtactagattgtgttttgtttgtttgtttgtttttgacagagtctcgctctgtcacccaggctggagtgcagtggtgcgatctcagctcactgcaacttccgcctccctggttcaagtgattctcctgcctcagcctccccagtaggtgggactacagtcatgcgccaccatgcctggctaacttctgaatttttagtagagacgaggtttcaccatattggccaggctggtcttgaactcctgacctcatgatccgcctgcctcagcctccaaaaatgctgggattacaggcatgagccactgcgcctggcctagattgttaaatcaacaaatcaagccaacaggatgatttgaggatttatataaaacaactagaaaactgaacaacaataataatttttattttttaatgaaatatatcaataattgaatgttaaaaggtgtgatgtaaatgatcattgttgaaaagaaagagtgatcggtcaagggatttttgttgttgttgctatgggcttaagaaatgaagaatgtggaattaatgagaagttgagaattttctgaggggctgggtaagaaactacaagagatatagagaaatacagtatgtgaacagaaagtagtctttttttcctctggaagattaacatatagacaaaagaaaaccaatgaggaacccacaatcttgggaagaacagataacagagtatccacagggagctgtatcccagaaagggcacgagatgagaaatgcagacttcattttttcatctataaaatgagaatttttcattctctttagtctgactaatatgactttcatggagatattttaaaattgtaaatgatatgaaatataataatagataatactggcattatattagttataaagtaaaatcatatccacatataacttttcacatccttgtatgagtaggaatgggcagtactagctttggagccataatgtcctcattatttgaaaaaactgtcaaaatccactctcttcctaaataattggttaatatgatattaaaatgtaaaatgaagactactctttgaaaattacacgataagtacaccactttagtacttacttaaaattttgttctttatagattactagggtgttattcataagtgcaacattgagaaatttacatattttcccaagaatttgggaagaatataatgaatgtttttttcttgcttaaaaacactcacaaattaatttgcaacttattattgactataaagttattcgtatcgctctggcaaatgagtaaacccagttcatatctgaaatataaaacttttctttctaaataaagaacaagttttactatttttgaaacatcctatttatggcttatcactacaagttaatatgcacattgtggagtttatttttgttattcgtagggagaattttaggtattgtagccaccttctaaagatctgaaatgagttttagttgtgacatgtattgtctttaggtcctatttatattttcagtttaggtggaaatagttctttttgacacgtccactgcttactttttgttattatcctttgcttacttttatgcctccaaaagtttgttgctttataattgatttgcctttaattcactgtaatcttcattgcaatagaatgaagtaagcttgtcaggtgtgattcctagctctttttatatttaggaattcaatggcagtagcaacttgagaactgtcttttcagaaatctcagtacattcgcaactgcaatctcatacactcagtaaatatatgaacggaaacattttttacatttccatttgttttgttactattccaattgctatttattgtcagggtttattccgtcctgtaaactgccactcccaaccataggagaaggagccacgtttgcaaaatgcaattaaagtagccacttcctccagctacctggacacagtaattgtccacaccttgtccaagctggaccaataagattctctcagaatttggaattgggtctcatagatatcagtctctgcggtcacttgaattaagttattgtaaactcaagatgaaagagttcaaccttttttattagcttgtgtgtataggaaaaaaaacagagaatgccaaaccagcgagaagataagaggatgggggatagggagagggaatgatgcaaaaggtgaggggataagagagagggagagagaatgatgaagagggtgaggggctgagggagatgcagagagaatgatgaagagggtgaggggctgagggagatggtgagagaatggtggaacgggtgaggggatgaggcagagagaatgatgaagagggcgagggaatgagggagaaagagaatgagagagaaggagaagagaagagggagagggacggggatgaaggagagtgagatggaagatggtagaaaggatgagagaggaggaggaggagagacaagaagaggggagaggaaagagaggaagaaggaagcctggaaaaaggagaagaaaggaacaggagagatgaagggagggaatagagagaaataacagggagtagggaggaagaaagataaacgagagagagagattgactgtagtaaagagatgtatgaagagcagaatcaagacattaggtgtcttcagagaaacagaaagaagctgaagcttcatgcctctttttattccttgatgctagtgccagaatcttgacttcactctctgctcttggtttccttgagttccacccatattgtttatttattttgcatcactcattcaaccctaagaaacttaaccaagatataaattaaatcaaagcttactaataccataatttaaaaatcaaatggattgtttaggtttttgaacatttaaagccatttaatatcttgttttgctatagaaatcattaattctttagcatatttgaaaaatacatacatggccaggcacagtggctcacacttgtaatcccagcactttgggaggccaaggcaggtgaatcatgaggtcaagagatcaagaccatcctggccaacatggtgaaaccccatttctactaaaaatgcaaaaaattagctgggtgtggtgacgcacacctgaggcaggaggatcgcttgaacttgggaggcagaggttgcaatgagccaagactgcgccactgcactccagcctggccacagagtaagactccacacacacacacacacacacacacacacacacacacacacacacacacacaaaagcaagaaaaatgcacatgtttaaatgattttttgttttttttgtttttttcattttattatactttaagttttagagtacatgtgcacaacgtacaggtttgttacatatgtatacatgtgccatgttggtgtgctgcacccattaactcgttatctagcattaggtatatctcctaatgctatccctcccccctacccccaccccacaacagtccccagagtgtgatgttccccttcctgtgtccatgtgttctcattgttcagttcccacctatgagtgagaacatgtggtgtttggttttttgtccttgcaatagtttgctgagaatgatggtttccattttcatccatgtctctacaaaggacatgaactcatcattttttatggctgcatagtattccatggtatatatgtgccacattttcttactagtctgtcgttgttgcacatttaggttggttccaagtctttgctattgtgaatagtgccgcaataaacatatgtgtgcatgtgtctttatagcagcatgatttataatcctttgggtatatacccagtaatgggatggctgggtcaaatggtatttctagttctagatccctgaggaatcgccacaccgacttccacaatggttgaactagtttacagtctcaccaacagtgtaaaagtgttcctatttctccacatcctctccagcacctgttgtttcctgactttttaatgatcaccattctaactggtgtgagatggtatctcattgtggttttgatttgcatttttctgatggccagtgatgatgagcattttttcatgtgttttttggctgcataaatgtcttcttttgagaagtgtctgttcatatctttcgcccactttttgatggggttgtttgtttttttcttgtaaatttgtttgagttcattgtagattctggatatcagccctttgtcagatgagtaggttgtgaaaattttctcccattttgtaggttgcctgttcactctgatggtagtttcttttgctgtgcagaagctctttagtttaattagatcccatttgtcaattttggcttttattgccattgcttttggtgttttagacatgaagtccttgcccatgcctatgtcctgaatggtattgcctaggttttcttctagggtttttatggttttaagtctaacatttaagtctttaatccatcttgaattaatttttgtataaggtgtaaggaagagatccagtttcagctttctacatatggctagccagttttcccagcaccatttattaaatagggaatcctttccccattgcttgtttttgtgaggtttgtcaaagatccgacagttgtagatatgcggcattatttctgacgcctctgttctgctccattggtctatatctctgttttcgtaccagtaccatgctgttttggttactgtagccttgtagtatagtttgaagtcaggtagcgtgatgcctccagctttgttcttttggcttaggattgacttggcgatgcgggctcttttttggttccatatgaactttaaattagttttttccaattctgtgaagaaagtcattggtagcttgatggggatggcattgaatctataaattaccttgggcagtatggccattttcacagtattgattcttcctacccatgagcatggaatgttcttccatttctttgtgtcctcttgtatttccttgagcagtggtttgtagttctccttgaagaggtccttcacatcccttgtaagttggattcctaagtattttattctctttgaaacaattgtgaatgggaattcactcatgatttggctctctgtttgtctgttattggtgtataagaatgcttgtgatttttgtatattgattttgtatcctgagactttgctgaagttgcttatcagcttgaggagattttgggctgagacattggggttttctagatatacaatcatgtcatctgcaaacagggacaatttgactttctcttttcctaattgaataccctttatttccttctcctgcctgattgccctggccagaacttccaacactatgttgaataggagtggtgagagagggcatccctgtcttgtgcccgttttcaaagggaatgcttccagtttttgcccattcagtatgatattggctgtggatttgtcatagatagctcttattattttgagatacatcccatcaatacctaatttattgagagtttttagcatgaagggttgttgaattttgtcaaaggccttttctgcatctattgagataatcatgtggtttttgttctttggttctgtttatatgctggattacatttattgatttgcgtatgttgaaccagccttgcatcccagggatgaagcccacttgatcatggtgaataagctttttgatgtgctgctggattcggtttgccagtattttattgaggatttttgcatcgatgttcatcaaggatattggtctaaaattctctttattgattgtgtctctgcccagctttggtatcaggatgatgctggcctcataaaatgagttagggaggattctctctttttctattgattggagtagtttcagaaggaatggtaccagctcttctttttatctctggtagaattcggctgtgaatccatctggtcctgggctttttttggttggtaagctattgattattgccacaatttcagatcctgttattggtctattcagagattcacttcttagtcttgggaggatgtatgtgtcgaggaatttatccatttcttctagattttctagtttatttttaatggaggtgtttatagtattctctgacggtagtttgtatttctgtgggatcagtggtgatatcccctttatcattttttattgcgtctatctgattcttctctcttttcttctttattagtcttgctagcggtctatcaattttgttgatctgttcaaaaaaccagctcctggattcattaattttttggagggctttttgtgtctctatttccttcagttctgctctgatcttagttatttcttgccttctcctagcttctgaatgtgtttgctcttgcttttctagttcttttaattgtgatgttagggtgtcaatttgggatctttcctgctttctcttgtgggcatttagtgctataaatttccctctacacactgctttgaatgtgtcctggagattctggtgtgttgtgtctttgttctcattggtttcaaagaacatctttatttctgccttcatttcattatttacccagttgtcattcaggagcaggtcgttcagattctatgtagttgagcggttttgagtgagtttcttaatcttgagttctaattagattgcactgtggtctgagagactgttataatttctgttcttttacatttgctgaggagtgctttacttccaactatgtggccagttttggagtaggtgttgtgtagtgctgaaaagaatgtatattctgttgatttggggtggagagttctgtagatgtctattaggtccacttggtgcagagctgagttcaattcctgggtatccttgttaactttctgtctcgtttatctgtctaatgttgacagtggggtgttaaagtctccgattattattgtgtgggagtataagtctctttgtaggtcactaaggacttgctttatgaatctgggtgctcctgtattgggtatatgtatatatttaggatagttagctcttcttgttgaattgatccctttaccattatgtgatggccttctttgtctcttttgatctttgttggtttaaagtctgttttatgagagactaggattgcaacccctgcctttttttgttttccatttgcttggtagatcttcctccatccttttattttgagcctatgtgtgtctctgcccgtgagatgggcttcctgaatacagcacactgatgggtcttgactctttatccagtttgccagtctgtgtcttttaattggagcatttagcccatttagatttaaagttaatgttgttatgtatgaatttgatcctgtcattatgatgttagctggttattttgctcgttagttgatgcagtttcttcctagccttgatggtctttacaatttggcatgtttttgcagtggctggtaccagttgttcctttccatgtttagtgcttctttcaggagctcttttaggtcaggcctggtggtgacaaaatctctcagcatttgcttgtctgtaaagtattttatttctccttcacttatgaagcttagtttggctggatatgagattctgggttgaaaattcttttctttaagaatgttgaatattggtccccactctcttctggcttgtagagtttctgccgagagatcagctgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtatttcctgaatctgaatgttggcctgccttgctagattggggaagttctcctggataatatcctgcagagtgttttccaacttggttgcatttctccccgtcactttcaggtacaccaatcagacatagatttggtcttttcacatagtcccatatttcttggaggctttgttcatttcttttcttttttctctaaacttcccttctcgcttcatttcatttatttcgtcttccatcactgataccctttcttccagttcattgcatcggctcctgaggcgtctgcattcgtcacgtagctctcgtgccttggttttcagatccatcaggtcctttaaggacttctctgcgttggttattctagttatccatttgtctaatttttttttcaaagcttttaacttctttgccattggtttgaatttcctcctgtagctcggagtagtttgatcgtctgaagccttcttctctcagcttgtcaaactcattctccatccagctttgttccgttgctggtgaggagctgcattcctttggaggaggagaggcactctgatttttagagtttccagtttttctgctctgtttttttcccatctttgtggttttatctacctttggtctttgatgatggtgacatactgatgggtttttggtgtggatgtcctttctgtttgttagttttccttctaacagacaggaccctcagctgcaggtctgttggagtttgctagaggtccactccagaccctgattgcctaggtaacagcagcggtggctgcagaacagcagatatgggtgaaccacagatgctgctgcctgatcgttcctctggaagttttggctcagaggagtacccagccgtgtaagttgtcagtccgcccctactggggggtgcctcccagttaggctactcgggggtcatggacccacttgaggaggcagtctgcccattctcagatctcaagctgcatgctgggagaactactactttcttccaagctcagttggaaatgcagaaatcacccgtcttctgcgtcactcacgctgggtgctgtagactggagctgttcctatttggccatcttggctcctccccccatgtttaaatgtttatcaaaaaataaataaagtttacctctgatctcaccatctggaagtagctttcactaatgttttagtacattttcttttactcttctgtgcatgccagtacatacacacacacacagacacataacacattcattctttatggacgctaatcaacagtatgtacagttttacattgtgttatttttatgtaacaaaatgaagtttcgaaggcatggttttattcagtattatcccacttaattaaccgttgttctatttataatcattctggatttttaatttacacagtgttaattgtagcttcattagtgctatgattttttatttcttcatttagtcaacaaatctttattaattactcactctgtaccaaacattttgacacaactaaccaggaagatgtgtgtcttgaggagattacagctttacagtgagaaagactagtaagcaatactttcattcaattcaggtcactcaattctttgagggaaagggggtaagcaactacttcctagggggtaactgggtcttgaactgagtctcaatatatgaataaatgagaggaggatacatgtgaagtagcaggaaataaattagaaaggcaggcaggactcagatcatggggagggagagagagaaggggagtgaaggcttacttgccattatataaggaatgggtatcactgaacattgcaaatgtgcatggtgttggggggaggggagtaagaacatagtagatttgcattttttaaatgattatataacagtagaagatttatttctcaggcataaaacttaaagtgggaaagttacttgaagtgagaaatctactggaagagtccacacaggaaatgagatctaatattacactactagaggagagagattaacttatggctatattgagaagatagtttatgatatttgacaactagttggctgtcagaaggtgaagggtaaggagagactcaaattgctctcagtcttctggcttgctattattttatgaggtgtagaatataagaggaggggcaagttcagtagaaagtgtggatttgggtgtgtttggcttgtgttccctgttgatcatccaggtagaggtgaccagttgtcagctagtgctgccatcacagaatatcacagactgggtggtataaacaacagaaatttattttctccattttaggatctggaagtctgagattagggtgccagcatgggcaggttctggtcagagtctttttcctgacttgcagtggtcactttttctctgtgttctcacatgcaggagagagtgcaagttatcattctacctttctcttcttataaggtaacagtcctgttggattagggccccactcttatgacctcatttaaccttaattatctcctacaaaccctagctccaaatacattcaaaatgtttagagcttcaacctatgaatgaatttgggagagtagggatatttcagtccataacagctagacatcagtcttgaacttagtgacacctaagaattggaagtatagttgggtatgcctcatcatgagaatggataggtacacccaatcgagcatccggagaaggaatggaaaagggtcaagaactgaagcatttatgttgttctcaggagaagagaagatagcaaaaaagactgaaaaggtagggtgaaggagctggaggacaagcaggaagcaggatgcctctgcatgtaaggaagcagataattttatctagagtggaagattcaaaagtattaaatgatatgtagaatatcatattctttttacctatctaaacaactattttacctatctaaacaagtcagatcccaatcttttgctcttgacagcatatggtattgggaatattcactcattcctcacctcttccttgttcctagtttctttttagctattccatctgccttgtttatcactgttctgtgttacattgcttgtagtgaacaatgtcagtaacgtaacattggactacttaacaatatagaaacattgctttgtgtctgcttttccatattcagtagattgatatttttaatgtttgatcatttttaaaaaatgatccctgactagagatagcatgagattagcagggcaaactgtcgaatggacaacatatacctaattaatgaaaatatgttatagatgagtcacacttcagacattaatccataatgggtctctatttggagttgtttgaatgacatgtgagatatataatccaaaagaaataagcttagaactgtttaagcatgacctttcctaggagaaataaaaaataagttaaaaagttattttcagaaggaaatatattaaagtcattcctagagttaagaaaagaatgttaggaaaatatttacaaaataaattgtataatatctataaatatcatgggggataaataaataggaactgggaatatatctccaggtattttcacagaacagcttaatgacaaagacatttcctaaggcttaaatgtagcattattttgaattgtaaaaagacaacaaattaaacagtatttgttgtaaaaatgtatctcatatattattacatattgcacatcaagaatatttttaaataaagtgaatattatatactcgcttttttggtaaatattgcctaagtaaaacatacaattttggcttttgctctcaaaaacaagccttgatgtgcacacagttagagctgcgactgtagagcactattgccaaaggaggatggtaaacttttcagtaatgctgaacctactagcgtgtgagggcatttagcatactgatagtgatatgaactaaaggaaatgttgacactgtcctaaataatattctttttatttttaaagttacttccttgaaggcaaaatcataacctgcataagctcatagtacattaaggcttattattttgcctttgctatattgctaagaaaataaatttggttatcctgataaatttattcttcacaaggccatgaatattattttttcccaatagcttataattttattatagcttgcaagttgattgttttcttttgttattggcttcagtatttccccaagcataaaattttagataagtattccacttgggggattattgtgccatcctcttctttctacttaaagatgcactttttaaaacggcaatgtatttgtccttctcttcttccaaatctcaaaaatactcagtgaattctaataaataatagattaagttttctgtgattattttagccagttcattagggaattggggtcttgcagaagtatataaattttttaattgtttaacttgactcacatttttattagaatttgtttatattttaatcaaggcttttcattctgctgcattttgtggggcataattatgttttcataaggacatatatgatacaacatatgaattaataactaaacaggagacttagacttacttccaaatcctttttgaggataaaaaaataatgggaaagagcatcacttctagctgtagaacagcaagcaaaaaaactagaaagtttgcagattcacaacttttcatggagtcatcagagaactaaggtcgtagggcaaccagctaacctgaaacttaggaggagacatgagcacttgttttcctggagcagatactgccagatagcagtaagaatttagctgaatttttaagtcgaattggtaaagccagttgtgcactagaaagataatatagcaaccctattgactgcagatatgaggggaatttgcactgcagtcttttctccatagacttcaatgtatactcaatatctataatatttatagatattatacaatttattttgtaaatcaaaaaaaaaaaaaaaagatcgtctacagccctctgaaagcatctcttctgatacaggcatagcataagaagtacaggaatcactccgagaaaggcaggaatcatcacctggatccttctccccttccccctacagaagaaaagccttaaactgctaagtgtaggacagctattgtctgaaaaacagtgtaaaaggaagacctaaagttgagagtggagcagatactgagaaaagaaatggctatccatgtattacccatcctcaacacaagagaatactagaggaatttgaagcctgtgatgccaggtaactttggtaacaacaaatcccaaacctagcttaactcctgagtagaatgattcaaaccgcagatctagcagaaggacagtcattctcatttaaagacataaacactatttactcattctttaatgtcctacgcaagatatttagttttaaacaaaatgtacaagacgtgtacaatggcaagaaaaaaatgggcacactgccaaaataaaaagaattttataaaagcaaagatatgacttacataataaaactgtgagacagaaaagttttaattactgtcattaatattttaaagactcaaatggaaaaagtgaacaatatacacatcacataggtaattttagcaggcagctggaaagcataagaaagagtcagatggaaatactagaactgaaaaacatagcaacaaaagtgaagaatgcatttgataggctcatcaatatggttggtacacctgaggacagaattattatacttgaaaacgggtaaattgagagctgaggtagaatagtgtatttgcaatcttctgggaagtagtcttaaatatgtgtacttgtaatcccagatggagaaacagagaacaggaccaaagaaatatttaaggaaataatggcaaataattctctgaaattaatgacaaagaaattaaggaggatttaatgagaaaaaaatcaatgagagacaccaaaacaaattgaagaagctcagagaacgatacacacataaacacatgtataaaaaggaacccatattcaaattgctaaacaccgaagttaaaaagaaaatttggaagacatcccaagaaaaagacatattatgtacagtggacttgttatcagaaacaaggcaagtcagaagacaaaagggtgacatcttgaaagtgatgaaagaaaacaactctcaactccgaattttataaccactgaaagttatcatgatgaaggagaaatgaagatgttgtttgacatataaaaatggggagaatttattgtcagcagagcttctatataagaaatattaaaggaggttctttagggatatggaatgtaataccagagttaaacttggttattgatatggtttggttctgtgtccccaccgaaatctcacatcaaattgtaattgccacatgtcaggggagggacctggttggcagttattggatcatgggtgcagatttcccccttgctgttctcatgatggtgagtgagttctcatgacatctggcttttaaaatttgtagcactcccaccttcacttgccctctctcctgctcttctgtggaaagatgtaccttgtttccccttcaccttctgccatgattataagtttcctgaggcctcctagtcatgcttcctgtcaagcctgtggaactgtgtgtcaattaaccctcttttcttcataaattacccagtctcagttagttctttacagcagtgtgaaaacagactagtatagctatacagaaagaagtgaagggcgctgaaaataaaatgaatgaaggtaaaaataaaacatgtttctcatatttttagttgctctagaagataactgaccacttattaaaaagtaatagcaatgcgatatttatttatcttacatgtaaaaataaaatatgtgacaaaatactacagatgttgtgtaggagaagtattgggatatagtgttacaacattcttataatacatattaaacaatataacatttgggagttgactaaagatatgtaacttaaactagggtaagtattagacacattttgaaaaattatgtattgtaagtgaataccagaggtaatatggtatcataaaatatatttaatcaaaaaaagagaagaagaggaaaaaaataaacaacatatggaacaagtagagaacagacagaaagatggtagatttttaatttaacagtgttaataattacattaaatgaaaatagtctaaacacattaatttaaaaactgaatgacagattgggtaacaagagcaagatccaaatatatactgtgtacaagaaacccacttaatgtgtatggatatatatagaaaagtaaaagaatagagaaagacagattatggaagcatcaaccaaaaaaactagaattgctatattaatatcattagactttaaataacatatattaacaaggttaaacatgaacattaaataatgacaaagaaatcaattttccaagaagacaccttcagtcccaaaaaactatttaaatatatatgtacttaacaacataaattcaaaatatataaggtgaaaatgaatagacttgaaaggataaatagataaatccataattatattggaaggctgtaacagtcctttctcactaattaataaaacaaccaaataggaaatgagtaagtataaagaagacctgagcaacacaataagcacgatcagccaatttgatctaatttatatttatataacagtctaagcaacaatgcagctaaagcaactcttcaaggaaaactttatagatttgatgcttatataatatcagaacagaaaaaaactaaaattcatgatctaatctaccatcctaagatactataaaagtaagtgcaaattaaatccaggacaagcagaaggaaaaactaataaatatagaagcagcaatcaaataaattggaaacagactaatcaagagaatgaatgaaattaaaagctggtatttgaaaaaaggcattaaaatataataaacctatttttgaaagatatacaacacgaactttcactaaaaatataggttatgtgagtagtcctgtttgtatttaaaaatcacttaatgaagaagcctgtaggctcagatagattaactagtgaagtctattaaccttttaagaaaaaaataatataaattctacccagtcacttcccgaaaggagaagtagcactttcgatttatctaatactgaaaccagccacagacatcaccaagaaaagaaattgccaaccaacacaccaatacctctcatgaatatagatacaagaatcttcaataaaattttaagaaaaatcatctagtagcatattaaaaggatattatattatgagaaaattgtatttatccagaaaatccaaaattgatttaacattagaaaatcaatgtaattaatcatattaataaagaagaaaattcatatgatgatctcataaatgcagaaaaagcatttgacaaaattcaacatctattcctgttaaacttctcaaaatactaaaaaataggaagataattcgttaaccttaaataagacacttattatagaaataactggcatcatatttattagtggaaagctcagtgcttttccactaagatcagaaacaaggtatatgaacctacatttcctttttttttttttttttttttacattgtccttgtggcatgcaaccttactaaaatcacgtatttgttttaggatttgttttatagattgttggggattttctacatagaaaccattactgtatgtaaatagatattgggtgcgaaagatacagtcacagaacaaacctataccattattattaattaattttcttaaaaaggtgcagaaaattcaatagagaaatgtattttcaatgaattgtgcagaaagcaattagagatctatatctaaaaaatgaacatagacccatgattcacaccttatataaaggttaaatcaaaatgtattataagtctgaatgtaaagcaacatgtaaaacttttgaagaaatacaatatttgtaacttggagttcaacaaattcttagatatgataccaaagtcatcatccataaaagaaaatataaatatatttaactttaagaatataaatttttgctcttgagaagacattattaagacaatgggaagcaaaccacagactgggagaacatattttcaagtcaattaattgacaaaggatttatattcagaatatataaagaactcatacaactcaataataattaaaaactatctaattaaaacaaatgaataaaaaattaacaggtacttcaccaaaaaaagacatatgaatggcaaataagcacatgaaaatatgctcaacctcattatctgttaggaaatggaaatttaaaacaaaatgagataccactacacacctattattataactttataaaaactgaaaggggccgagcgtggtggcttacgcctgtaatcccagcactttgggatgctgaggcggttggatcatgaggtcaggagttggagaccagcctggccaatatagtgaaaccccatctctactaaaaatacaaaaaattagccaggcatggtggcaggtgcctgtaatcccagctactcgggaggctgaggcaagagaatctcttgaacccggggggtggaggttgcagtgagctgagattgtgccattgcactccagctctggcgacagagcaggactccatctcaaaaaaacaagcaaacaaacaaacaaaaaaaaccctgagtgctggggagaacctggagtgactggagccctcagacattgctggagagaatgcaaatggctgtcatgacactttgggaaacggtttggtagtttcttataaagttaaacttactttatgactcagccatcacactacaaggtatatactcaagagaaatgaaaacttaggttcacacaaaatcttatacgtaaatattatagcagctttatttataatcaccaaaaattggaagcaattaacatgcattcaaccagtgaatgcataaacaaatggtggtataaccttaaaatggacactcagccctaaaaactaaatgaactattgatatacacacacagggtaacaaactacatttttccatttatatgacatattggaaaatatcatgtaaataaaatgttttgaacaaaattagagtcagtaggtgcagttttggtttcacttggctttctatttattattatttgtataaatttaaggcatacaagagcaattttgttacatggatatattgcataatggtaaagtctgagcttttagtataaccatcacttgaatagtgtacgtcgtactcattaaataatttctcatccttcactaccctgtcacactcccatcctttcaagcttttccactgtccattatccacactctgtgtccatttattaatgtacacattgtttagttccgacttataagtgagaaaatgtggtatttggctttctgtttctgagttatttcacttaagataatggcttctagttcatctgtgttgatacaaaagatatgatttcagtctttttatggctgaatagtagtccattgaaaaaatgctcaacaccgctaatcacagataactgcaagttaaaaccgtcgtgaggtatcatcttacaccagtcaaaatggctattattaaaaagtcaaaaaataacagaagttagcaaagataaggaggaaatggaatacttatacacgtttagtgggaatgtaaattagtacaatgtctatggaaaaaaatatgatgctgtctcagagaactaaaaatagaactaccatttgatcaagaaacccactactgggtatattcacttgtatatttatcacagcactattcacaatagtaaagatatggagtcaactaagtgtttatcaatgaatgattggataaagtaaatgtgaagtatatatacacacacacatagacacacttggatttcttattgctcatctcgtctcttatggtatgtgcgtttgtatgtttgtgtgatgcttttattagtaagcattttacattaaaatattatttgccatataaatgaatgcgaataacctgtagcttaattatttttatgtggtataagtatttattagaaatcaaatggacgttgaaatttagtatcatatagaactttaaattaaccccggaagtaagttatatttcctccacactcgttaatgtcactgcaagttgtttctccatcacagaatataaatgggagtatatagcaaatgtctagcatgctatgtacaataaataatgtatgattaattagtcattttttaagtggaaaattattttaaagtagtttgaactatgatttaatttttaaatacacttaaacagtatgttagattagcaaaggcagaaatattttcatcactttgttatttattgatgcctagaccaatgtttggaacatagtagacctctgattaatatttgttgaattatttattgaatacatttggaataataatacatcataactaaatataacaaaaccatttttctaaggtatactttaggaaaatctagaataaatatgaattttggggttgtagcattgttatattatgaatatggattgaacactcattaataggagagagaggaataaagaataaataatctttgagatgaagatatttccatgtctaatattgtaggtaacaaaaatgatagacttatatcttttagaaagagttacctggctttctattatgtactgcttttctgatgatttcattgctttagtatttttaacttgtttctaataagagctgattggttatttctccccttagtatatataaatgtagctattctaaataatcatttattaacacaaattaaatttttatttcatttattgatacagtttgccagcgattagtgtccgagttaagaaatactgttatagcaacagcaatttccctagaggacttcttaaatcataaagtgagagtatttcaaattatatttgcttcacttaaatgtatctgttctgaaaatggcaacattgatcccatgatatacctgatatattctaattgcctagaacgtaaaccacaaattctgcattgcagatactatcacagtaaatgctgcttaacttatgcaaaatttatagaatgatgacaaaacaaaagcttctgagaggataagtgtttcaccacaagcggtttctgtatctgactccatttctaaactgtaaatcagccttaaattatcattgagtcctatgatagacactagtaatggtaagaaaatatgccattttaagctatattcttattgacctgtatgtttatatgagtgtgaatatgtgtgtacctgtgtgtacatgtttatgtatgcacaccttttttacacgttattttttaactaaaatattttttctttactttactttactttacaccatcatgcattgttactttgacctctacaacctaacaaatatctgccctctaatccaatgggaaggaacaaaatcctgtaagagtgtaggaaacctgaggatggtctacaaggttggctgcccattggaaacacttgtggaattttaaagagatatcgatatctttgttccacccaaggaattctgattaaaaatttattgtatgtacattggatatctgtatttaaaaaaaatctccccaagtgatcctaatatgcagtaaaatctgaaaatccttcctctagaaaacaaaaataaaagtgcctaataaacaatgattactgtgtattctgaaaccagaaacaaccattttcttaaccttttatggtttaaaaaagtatggtaggaaagttattttaaaaggaattaaaggtgattttatgtgacatatgtttatttttttaatgcaatcttcattataatggttttgaattaaggtataacctgtttttcttgtggagtgtatgcaatagaaaatcacccaacttaagagtcagaaaacatgagtgtgtgtggtggttctgccacttcttaaatatattgccttggctgggttctcctataagacttactttcttattgcccatggtagtacaattgttatagcatttcaaaaattaaatggtgtgtttataataaaggctatatataacaaacccaaagctaacatgggtttcccatactgaacaggcaaaagttgaaagcattccctctaaacactggaactagacaaggatgcctcctttcaccattcttactcaacatagcactggaagtcctagccagagcacttaggcaacagaaagaaataaaggtatccaaactgggaaagaggaagtcaaattgtacctttttgcacatgacatgatattagatacagaaaaacataaagactcaaccaagaaactcttggaactgataaatgaattcagtaaagttgtaggatacaaaatcaacatataaaaatcattatcattcatatatatcaacaatgaattagctggaaaagaagtcaagaaagtaatcttttttataaaagccacagcaaaaaattacatacctaagattacattttaccaaggaggtgaaagatctctacaattaaaagtataaaacactggtgaaagaggacataaaaatattgtaagatgactaggcacagtggctcatgcctgtaacctcagcactttgggaagctgatgcaggaagactgcttgagcctgggagttcaagacccacaacatagcaagggacaactctacaaattttttttaaaattagtcaggcctggtgtcatgcacctgtagtctcagccactgaggtggcaggattgcttgaacccgggaggttgatactgcagtgagccatatttgtgccacctcactacagcctgataataagaaaagaaagaaaaaatagtaagacaacccacgctcatggattgaaagaattaatattgttacaatgaccatactacccaaagcaatctcaggttcagtgcaatccctattaaaatttcaatgacatttttcacagaattagaaaaaatattaacatttgaattgaaccacaaaacactttgaatggccaatgccaagcaaaaataacaaagtcagagatatcacattacctgaattcaaaatatatgacaaagggataagtaaccaagcagcatgatattggtataaaaacagacacatagaccaatagaacagaatagaaaactcagatataaattcatgcatttatagccaactgaattacaagaaaggtgccaagaatgtgcgctggggaatgggtacccttttcaataaaagctaggaaaactggatatatgcatgcaagacaacgtaagtagactcctgccacttgtcaaatacaaatatcaactcaaaatgtattaaatatttaaatgtaaggcctgaaaatataaaatcactagaagaaaacataggagtaatgcttcaagacatgagtccaggcaaagattttatgggtaggactatgaaagcataggcatcaaaacaaaaatcagcaaaagggacattataagctaaaaaccttctgtacagcaaaggaaaaaaccgagtcaagacacaacctgcagaataggagaaaatatttgcaaattattagtccaagaagggattaatatccagaatatataaggaactcaaacaactcaatatttcccaaacaaatgattctattaaaaatggacaaaaaaatctgagtagacatttctcaatagaagacatacagatggccaataggcatatgaataaatgttcagcatcactcatcatcaaggaaatgcaaatcaaaaccacaatgaggtatcacctaacctcagttagaatagctattctcaaaaagacaaataataacaaaggctgctgaggatgcagagaaaaatgaagttttatactccattggtgggaacatcaattagtacagccattatggaaaacagtatggaagttcctcaaaaaaactaaaaatagaactaccatatgatccagtaatcccactaatggatatttatccaaatgaaaataaatcagtagatcaaagagttatctttacctccatgcttattgcagcactattcacaatagtcaagatatagaatcaacgtaagtactcctcaacagataaatggatcaagaaaaatgtggtatgtatacacaatggaatattattcagccattaaaagaaggaaatcaggtcgtctgcagctacatgagtgaacctggaagaccttatgttaaattaaatgaatcaggcacaaaaagataagtactgcatgttctcactcaagtggaagctaaaaaaacaaaaatgagtttatagaaatagagagtagaattacagttgttagaagctgggatgggtagcagggaggagaggagagggagaagttacctaatggatgcagaattacaactagatgggaggaaaaagttctagtgttctgtagcactgtagggtgaatatacctaacaataatttattgtatatgttaaaaatactagaagagaggattttaaatgcctcctacaaaaagaaatgagaaatatttgaggtgatggatatgctaattaccctaatttggtcattacacattgtatacatgtatagggatattgtatgctccatatatatgtacaattattatgtgtcaactaaaaacaaaagaaaaaagtgtctataattattcaggtataattttacactgttatctgtagcttactctggcctcttatgttgacaaactgtgttttttaagttcactttactgaatgacatatttactgttaactcatttcatgtagtttttattaaataattattcaatgcctactacatatctgtcagacacttgataagtgttgaatgcacagtgtcacgtgagacatggttcctgtctccagtgagttattgtccaatgcagaagaaagatacacacacacatgcacatgtgtattttggaggatagggtgaactaaaagtccaggattgcataagtaaaatgtgaaaatgctcaaatcaagaaggtcattgtgagttctttaaagcccaaaccaaatgtgttcaaatctaagtcatctttctgatgtatcttaggcattgaagttttggtgcactgagtagaatacatcgtgattatgaaatgttttcattgggacgtagtataaattaattgataatggtaaagactttgaaatcatattgtcttggttcaattttttcccctcaacacatcagctgtatgattatggataggtttttaacctttgggtttcactgtcctcatatgtaaagtaagcaaatagtgctaatacttcttggacttgttatgagaatgaataggtaatacctacaaaatgttttgagtgttgtccttacacatagggattagacaatatccactattattttaaagttactttaatgatattgcttatttgggaagcagattttttttgccttttctatatcagaatggttagttgaaaatattttacttttaaaataattattgaactgggaaaatgatttcatcagcaagatacagaaaaaagttggcaaaggtaaaaatacttttatttttcatcaaaatattaatatattatttttctgatttatggctcagacctattcattattattccttagatgctcgaatcctccatacaatgtggtacttttaaagagaacatctgtttttgtacaaagtgttgctatgaaacttcagtaggaaaacatagcaaacacatatacaaagtttagtactgcagctaaggcatgggattatattggtttggtttgttcattaaaaaaaggaaacaattattagctaaaccacacatttcagatgaataaggataagaaattcagggattatattgttctttggtaaaaaatctttgttttatagatttcagtgccttgaaggctcataggaaatgtagcttcttttatgtctaaatgtgttttgttatagaaattactcaagctatcttaaatgaagacctcaattgaagtttttagactatattattttgcttgtattccacaataactgtgttattacttccaatctttgattctgagaaatctggcctttattttttagagagagaaaatctcttgagagttttgagattagtgtagaaatatgcaattttttattccttctaaatttcacgcttttatattagaagatgttctgtgaggtttttttctggacagatattaagacagaatcaatcaaaaccaacgtaaacacactgttaaattcacacacaagaaaagaggtgtgtcatcaattaatttacataaattatctagctggctttgaaacctattgacatgtgagaagttcagagttccttcagcatagggcattctgttaagaatatacatgtttaaacagacaaaagaatttatatagataccatagacattttctgtaatgatatgaagtataatttgtatttactttcttcaaatatgggaatctctaatgtctttcaaaattaccatgatgttgaagacaatgtttatagtgatctcatatacaagtatagattttactgctctagtgatatcatttacaagtatagattttactgctctttcttctttgtttctgtgcaatctgttacaccaaccaaaaataagattgaaccgagatatgatttttagtaaacttggtgcttagtaaatttatttagatacttagtaaattaactaaaattaatttaggtgtttagtatatttattgaatgaaatctagcctaatatttataactggaatgttttataattgatttataaaaatcacaagtgatgttctttttatacagtatctatgtctttatcaagtcatagagattatatacttagtataaagagcaacatcaagattttgatggctggaaagaacactagaggaggacccctgaatatccattttcacttaacttatctgagtctgttaccttgagcataaaacggaaacgatgacattaccccagtaattatagttttgtgtttttccccagtcaccttagaaatatgtgctaagtacctcattatgtgctgctcataattttaaatactgtactgaggatttgctccctactttcaaagaaataccttatagtcagtgggggaaaaaaaactagcagacttttactacaaggtaatatgttatgacattataatttggttttatttgttggtcgcagcttaaatatcacctcttcagaggaatttcctgatcacccagtctaaagcagccttccagacaatatcataatcttttttaaagtgcacagcactatctaaattttctttcttatttgttcattatttttctgtctcccctcaaataaaatgtcagtcttatggctgcagatactatgttattcttttcacttctttaccctagtccttatcattatgcatatatatatatatatatatatatatattaggttttcattaatatttattgaataaatgaatgaaaggaaacttaaaaatacttgtgccatggcagcatagataaagagactttattaatttaaataattttttttctactatgttccagagacatactgtttgccccggggaatactttgttaatcttagtctggcgggaaggcattgatcagctttataattgcaaacaattgtaagtgctatggagaaatagtgaagggtggcatatgactatgttgaagaataaggtatttccctaatatgggagattagaagccttttgaggaagtttcacttgagctgaaatttgaactgtttgaactaaccaagtaaaagcaatgagaacatcatatgcaaaggccctgtgatgatgacagcagtagtctttgaagaaagtgaaagaaaaccagtatggattaactgtaatgggtgagcacttggtagagtgggagagatataactgaaatgctggacacagaacttgtaagtcactgtgctggtccatattagtagttgatatcggaaagcaaaatgtatacaggagaaacagtgtaaataaagcaaaagagtaaaaaaaagttagggatgcatacagtgtttgtcctttgacataactgggttactctgaaatatcaacattttcaaaatctcttctgtcaacactactataaggacttttatatatatatatatatatatatatatatatatatatatatacacacatgtatacataaaaacatgtattgcaaatagaaataaggtctctatttaaaaatctaacagttatttgctaatcacttatttttatacatataggcattagagaaaaaataaatattcatcaaagtgaattaaaaacaagtttacagtataatcagtagagaataggtcacattaaatacaaaatgtataattaagtcaaaatattcattgaatgtctgacttgcataggaagagacacaaggtctagtactattttcaaaaaatcagctgagacataaaacatacatgtgacaagcatcataacaaacatgtgacctacacaaatataaaaggaaatagctgagtaagagctaggcttggccaggtgcagtggcttatgcctataaccccagcacattaagaggcccaggttggtagacgggggcaaaacccagtctctacaaaaaattcaaaaattagctgggtgtggtggtggtggcatgtgcctgtagtcccagctactcacaaggctgaggcagaatatcacttgaacccagaaggcagaggttgcagtgagcagagatggcaccactgcactccagcctgggtgacagagttagactctgtctcaaaaaaataaaaaataaaaaataaaaaaatataagatttgggcttagtaaatatagaaggctttgtaggggatcaagtttgaattgcattttgagaaaagaagatgatgaatattaataaacacgtgaagtgaatgggagagaggctagtaatcaaaggcatgaagcccaagccatagaagtaagaactaatgaaatgtgtgaaattaacagatattaattttatggaaagataaagctcaagagtagaaaccttgattaaaaagatacctcgtcaattatctgaaggataagggaagaaagagcatttcagatggaggcactccctgtgtgaaagcttggatcattcagtgtcagtcatgtagcaagatgatgttagcttggagatgtagctatggtagaggctgaccactactaaaggagctaggtcattataggcctggtcatcttgctatagagctgtagtctggtgcattgaaaaagtactgagtgaaacagaagggagctaggacatgattacagagggctgggagggagatgatgaatataaaggaaaagggaagtgaggagagaaactagatgttagaggtatttagtcaattcagtaggatttaatgatttattgcagacagaatgaaggggaaggagaatgaaggataattcttatgtctgtttagctaattgaacacttaaggggaaccctgggccaacaaggtttttctttttttaatttttatttttttagaagagatagtgaattaaatgttatttgcatttaatcctaggtaattgagatacacaggatgagatatctagagggtagatagtcaggtccagccttggtgttacccatttggaagccatagcatcgtaatggattagattttagctgggcctaggaggatgaggtgtgttattggtcagtaccagggaaaaacagagggcttctgagctgcatggtgacatgtccatggagtaaggagaagacaggtatcactgaactcagcatgtgctggaataatatgtgataaggatgaatcatggatcagtaaggtgaggcaaatttatagatggaagtaacagaataagaggtgctacactttttaattgaagcaacttttagaaaaggaagatgaaattacacaatgaatgaactgcttaaggatgaataattgggtagacattggaagacaggactttatttcagtcaagtcatgtgaattgtggttactgtggttggaagatataggagaggtacataatagctgtcatataagagacaaagaataagagtaacatggaaatgtatgctcaaatgagacagatcaataattgtattcatgatttactgacacgaaatgctctttattgcctgtatcccaggtcttaccttgtttccagttagctgtgatttcaaagaagatactcctttgtgacccttgcttcagtcatctttccatttctttcttttctctttgtttctgctaacctgctgaggaggctgacagctctggacgcaagtgtttttgcttcaggagtagatgggagaaaagcatgtcctgtagttataatgctgctttttcctaggcagggagaagcagcccctaaattctagagaaaaatactgccttagttcaatgtagcagttctgatattcctgtgagtttaagaaaaaacaaacaaacccttcctccgctcaccaaacgaagcaataacaaaccaacaaaccagaaaccttaaagcagaggaaatccagattgtacttactcttcttctcactcacaaagaaaaggattcaccacatttttactgtcatggcattattgccgttaaagtctttttctttctctgtctagtaagtcttttttttcctgttcaatacagtttttttttgcttgttcattttttttccgatctagtggagagaacattgcaggattatgaataagaccctgagctggatgtcgtggctcatgcctgtaattccagtgttttgggaggatgaggcaggaggatcacttgagaccaggagttggagaccagcctgggcaaaatagtgagaccccatctctaccaaaaataaaaaaataaaaataaaaaaagaagaagatgggcatggtcatacatgcctgtagtcctagctacttgggaggctgaagcaggaggattgctgtagccaaagagtttgaggtttcagggagccctgatcatgccaccgagtacagtctagatgacagagcaagactttaaaaaattaaaattgaaaaaaggaccctgataaccatttgtagatacaaacacatttcaagttgggtctggtgggccgttttcctttagggttcaccacttgtggtgccatgttgcaaagacacagtgctatttatcatgtagctatcttacagatcttttgtctaatacctaacaaaccactcttttagtcctccaggaaaaagttctgggcactttaagccccatgccttgttcagaattatccttgctatatgctgtggtctaaactgtgattctccaaaattcatttcatgaagccccaaagcatagtagcttagaatgtaaccatatttggatataagactttaaagatgtgactgctttactatgagctcaacagggtggggccctaattcaatgcgactggtgttcttataagaggaaaagacactgtggagaaaagaaagaagaaaaggaagattaaaagccatctgaggatacaggaagaaggtggccttctgcaagccaatgagagaggcctgagaagaaaccaaacctgctgacacctggatcttgaccttctagcttccaaaactgtgacaaaatatatttctgttgtttaggccacttagtctgtgggtttttttttttatgtctgtcatagaaaacgtaatatacagtactttctggtgagtaagtttttattttccctgagtgaatttttagtagcacatatcttttctgtgctgaaaatgtgagacctctgatgatttgatgagcccttctcttaccctaacttgcttttacacttgtaatattataccaaaactaagtgctttctattcttattttcttgttagtgtgatgtttcacttagttgcattattcattttgctagaaattttgaatacatttgctaaagctggaatgaaaatctcaataaatgaataaataatgatttagtgacatctgccgtgtgcttgttcactcgttgatctttaagagtgaaattttccaaaagagactgatcattaggggtttctgtagatcttaagtatgatgctttttaaaaccttttatcagaaacacgcttctttgattaacatgaatataatatagtgatgtagttaagagtatatggtctggagttaatgtgctatggtttaaatcctggctcagcctcttggaagctgggtaacaatgagtgagataatcaattaaattagagcctcattttcctcatctgtagaacaagagtaataatagttgtgttcaactcatagtactgtgatgaagattgaataagttaataaatacaacagcacctggttcatcgtaaatgctccctacatttgggctattgttatttttctaaattctattgcttgcttgtctgaacatcatcttgggttaatattgttactactggaactttattgtgatattaacttaaagcagatttctcacctttggctctattgacatttggggctggataattctttgttgtgagtgctctcctgtgtatgtagcatgtttagcatctgtggagtttaacagcgtctataaagtctacctaccagaccccggtagcacactgcctcctcacccaagttgtgacaactgaaagtgtctctagatgtattcatccattttcacattgctataaagaaatgctagaggctgggtaatttataaagaaaagaggtttaattggctcatgattcagcaggctgttcagggagcatagtagcttctacttctaggaaggcctcaggaaagttttaaccatggcagaaggcgaagggggagcaaacacttcacatggctagagcagcaggaagagagagattggagagttgctacacaattttaaaaaactagatctcatgctaactcactatcacaagaacagcactaggggatggtgttaaaacattggacctccatgatccagtcacctcccacggggtttaggtgggggcccacctccaacactgggtattacaattctgtatgagacttggtggggactctgaacaaaaccatatcaccagacattgccaaatgtactctgggggtaaaactacccccagttgagaatccctaaaaaactttgattaacaaataaaatactgtttgggaaaatatatctaaaatctgcttcttacatgagctcgatttattttgactgatagtcttgggattttgtaaggtagcttttctttaaaaatattattaaaggaggtcatctacagtgtaactcataatttctctcactgtgtcataaggccagaatatcttgatatgtctaattctctaaattagaatgtatagccatgaaaaacataattgacttaaaaactgatcaaatatgttttcatgaaaacatctagtagctgaaataaattatacctgccacttattagagataactcagatgttatcacaaatggaattgtaattacttacttatatttctcatggtgctatagagatttgtctaaattagaattgggagtaggagggagaaatttaaatattcatgaaagtgtgatgtcatatttcatgattaaaggtatggaaagattaagtatatggataatttttaaagtaccatagaggtatttttctagagaaatgagacacatcacagtcaagtacatgtggatgtatattatctttataaattaagatattacgtggaacttactatggttcaagaactcagtaagaattttttaaaaaaataagtatgcttgcataaattccaaagtataatgacatcttgtctctgtcatccctttgtagtccatcaaaatgattaatgcctgtcagttgccattcattactcttttgctgactggaagttgcagtgcctcatctgatacactgatacactgatcaatgtggaataggctgaaagtacattttgcgggtctgtggaatttgtcttaatacttactctaaagtatttaaatacttaaatagttaatatttattttattttacaataaatactgttttataattatatgtgtgtgtatgtatatatgatatataatttaaagaatatatatcactatataatgatatataaagatatatgaatatatggatataatggtatatatactattcattgtgatatatatatataatggtatatatatatttcactgtgatatgaaatatatataaatatattttaaatattatatatatatatatatgtatcactacagtgttaaagtcaagaagcatgggaagcaaacagatccagaattcagggaatacaccacatataataaatgatatctagctctctttctccactaaaaaatacgattattgtagtttaatagcctaatgggattttccacatacttaatagttaccacatcatgttttcatgctaaggacaggttttctataatcctttactggcaaggtgacaagctggaaaagaatgggttgtctattactgattatgtagtctctaagaaatctttttcttttgttgacaatttgaatgccatgtcttacagtttttgtcagtgtgagaattttttaaattacttattttatttttattttgttggatgctttttctgtttgaccaataccagcaagtccttccaaaatcacaatatagctaaacatatcttcctttctcaattgtattaaatgtttattatattattaattgggtgaatttttgtattaatatgttatttaaaatacaccatttaaaattagattcaatatttatgtcagttttactttctttctctttgtcctgattgttttatatagtcaacattgaaactgagaatagagagaaagagaaacaagggattttaaaggataatagtaataagcctttgtataatttttttcatacatgactttttaaaatttcataatagtgaggtgatgtggatgtaccttctaacatcatcacattttgacagtgaggaaagtgagactatgcatgggaaaaagtgaggcttagtaagtgaagcaataaagtggaaatggtactttgtctagcccctctgaccccagaccctgtgctctcatgctacatcacagtgtctgtggaataaacttttatcacttttgttgttgagaaaatgaacttgaggtttcttattatgatgtataatttcccctgggaaaatcgttgatagcttgataaagacagccaagagttttggagaatgattaaataccactcttcactttttttttcttttaacaaggctttgaggatctcttcttctgatgctgaaaaacagcagccaactcaaggggggaataatatgaaaatataaatacatattttaacatatttaagtatcagatgttgtggagtactcaaagagtgtttttgcccggttttaacatatgcacatctgtatttttctttataaaacaaatgtagtgaaatagtttaatgctgaatattttattacctttttctacacactcaccatcttcaaaatcaatcaaccttcacttcaggcatactgtatgtggtcttatactagaaaatacataaatatattgtttaaaggattaaaagaaattaaccacatgccatttgtttcacgaaccaaagctgagtagtttatgtctgttttatagcgcatacacaatacttgacctccccctcccaggacttagaacaatatgaactctgaaatagaaagtcttctcggaaactttgggaacattgtgtcagacggagagatagtgctcagataagagccagtggtagttgtaactctcagtaataatatccatcatatcatctcgtggatcagtggttgtcttagtggaaatcagaagataatgccaaagagacattaaatgttcagaatgtcctgcactgtagagtataacttgttaaatttcacttctgtttaaatctcaattactggaagaagcaggtggtgataattatcttactccttcttttttttttttttttttttttgagacggagtctcgctctgtcgcccaggccggactgcggactgcagtggcgcaatctcggctccctgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatcttactccttcttgaagtttaagctatttaacaattaattattaatcagggttagaatcaagttaaataatctacttcatttagatttttccttctaaaccgagtataaattcccattagtactactgttattaaatggaacaatgacattatgatctatagatactttcctttctagataaacatattgtaaattcactccagcatgtgagctatatgttctaagtaaacaatgtgattctcctatttagcaaaatatttcattcagtgtattgtcttatcctaactctgagctttccaatgtatatttagaaatgatattcctttgtgaaagactgtatttctcagtgtgcatacctgttagaaaaatcaaacatagggtgcaagaaaaagtggtgaatttttttttttacttgttcctgcagttatactcatactcctctgctcatgtaaacatttcagctccccaaattcaacctgactgcttgaaaatctttactaataatcattacctcttgaataaaatccagattcctaatccttcagactaacctccatgagagcagacactttgtggttgtgcttgtggctaatatcatcagtgcttgctattgtgcctgtcctacagtaggtaatcaggaaatatttgtgaaagaaaaaaatatcataaccaaggtactatgctatctgacttaagtgtactttcctgaggtcatcttacataactcatctccatacattctatgttttaatccaatgagactatttttcttgcaccttcaaatgaccccattatctccatgcatgaaacaccagttcaagtgtactctcttcctaaagtttttcttatcacctcatttagatttttttcttctcaaactgtcttagaattttgtgtttcttttactattttttttcatttttcattgaatcacagttactaaatgtatcctttttcaactccttgaggtgagtgagtataagagagaggagagtatcttaactcttctttcttcaacagtgctcagcataggaccctcaagtgtactggtgtccaatacatgttggtgtgctgtgttggtgttcaatatatgattgttgactgaatggacacttctttgttcactttactacagaattgacttttttttttttttttttttgagacggagtctcgctgtcttgcccaggctggagtgcagtggcacgatcttggctcactgcaagctccgcctcccgggttctcgccattcttctgcctcagcctccctagtagctgggactacaggcgcccgccaccatgcccggctaatttttttgtatttttagtagagagggggtttcaccatgttagccaggatggtcttgatctcctgacctcgtgatccacgaggccgcctcggtctcccaaagtgctgggatataggcatgagccaccgtgcctggccagaattgactattttttggttatcactttttcctttagataaatcttaaaaaacttcccacagctgatgtaatttgatagaaattcagttgaacttagttcttaaagatatctgacaaacaacttttgacttgaaatataataagaaagaacactgaacttggaggaagaatcttgagttccaaaactggatttctgtgaactggttgagtaaatttgacatcaaaatcaattcttcgcattaacatcgtatgcaaaagaatttaatatggtacatggcgatagctatacctcaataaagcctcctttcatccttttcctattattatttcccttcacttaacttttttttttctttttccttttccttcttgccctctcctttaaaaatcataaatttattgaatgacttttaacattttatgacctaaaacttttctggcctggattttatattaaatcagttcagcctgctttattagtttatttgatttcccatatacaaaaattgaaaaaaaaattctatttgctttttattgaaaaacaaaagactaactaaacaatagtgccttaagctcctatgatgaaatatatagagtatttttaaaaacatcattggttagcaatatctaggtatgttgctagcatctaccttccaaatccactttggaatggctttgttgcttagattttaaagaaacaaaatttaaagaaacttatagtttgaatctgggctgacagtgggtgaaaggccaggactgagcatcttttgtaaggtgagtcaatcttcttaattgtgaaatgccccttttatgcagatttttctttttctttcaagtgcatctgttctgtgttttaggtggtgtttaaacacttttaacagaatggatagattttcctattattttatctacaaataaacacctggttcttgatacttctctttctccttttatcaccttttgcctaaggaaatctaatttattcattttgcctgtattttatactcacaatattttcttttttgcttttaccttctgcatataacaaaacattattcttgcacagagctctttttttcttgcaaacacatttactcttaatattttatcttttgagtctatattatgctgatgggaagtttttcatataggattgtttcatttttatgatacaggttcacttctttctcttcattgccttgtttgtagttttttttccctgcagaatgttttgtatgctacctttctctttactttttccagaatactttctaaacaagcagattgtgaatttcaaataattcatttttatttttatgttatgaactgacattcttttcctctgctattattcagatgaggaagaaagataaaagtgataaaaggaacataaattctgccatagaagttaccgccaagtgaatacatattctagtatataggagttttactcatgaaatattttgcctttacttaagaaacctaagttaaataggaaaatgattattttcattttaaaaaaattaaggtataaattgtgtgtgcaagtatatgcacagtctccccaaattatatttttctgtgtaaatatttacaaaattgaatatccttcttttttaatgactcctatgcagacaggagggagggtacttcataattttggttcataacatcccttaaggaattcattctagtggccaaaagagcaacacctttgtaggagggaaacaggatcaatcaagttaacaaaattattgttataagtttcttcacaggaagctttatgaaataaaaattatattcataataaaataagaaattatgaattatgaactcatcttaaaatggtctttaaatgttctgtatgatgtcagtgggccacacaacttgttcagtgtctaattatgttgataaaataagatatgggactttttttttaggtgaaataatttccattgtaactttttgcatatgtatgacaaattattctctttacgcaaagttaattggaggtttgatcaagaatctaggctctgtctggttcaataaatcctacataattatttattcatattatttccctcataagtaggaatttttgtcctatcattgttattttgctatgttgcctgtgtagatacagctatcagtttgaagcagcagttctgtctatgagaagataaaataatatctttgatgggtttctccatgtcagggttccttcaccttcaggcatgttttccaacatgtagttcttttttttcttcttaattgaatcagtattgctcataaattacaattgagtgcagattgaaggaaatgcaatgtcttcttaggagagtgtgtcacctagtatttataatgtaatcacaatgttcatagaaatttaaacgtattctttcccctacaacatttacactttaacagagacaaaacaaatatataatcattaaaactgttaaaggtaagcaggtaattataagattgcactgaatttcagctataagaatgggagtgactaattggagaaagtatcctacagctataattttaggggagaaagccctgtggatagagaagagatgctgttctaggtaaataaaatggtctgagtagagccaaggaggttcactcttaaaagtataaggagctagtacagataaatttcaaaggcaagccagtatccagattcaaaaacatcttcttaaattatatggttttctcgccacagatttagattcattctcattagaaatattgcatttttaagtatggcttttagaggcttgtggcttaaccagagcaaaggcagtagggtatgatctaaaggtcattctgcaattttagcagagtataactgtctcctgggtcaagatttggctattctctcaagaaaaggaggttaaatgacatctaaatggtattgttaagtaaaccaataagaagttttatctttgtagttataattctgtgacaggcttttcttcatgtcagaattactgatccctcataaagacaaaagcttaggtaagaaaatgttttcatctgatttagttttattgcttagagctgtgcaatttttatatgcctatttaaaaagaaaaaaaggaaaaaactcagaaagttatttttttctgggtaaaagataattggaaagcatttcaaccaaaagtcaatataagtctgttgagtttgtcattctccagatatgccctcagtttatttttaaaaaatcttaagttgacaatgcattttatttggctataataatttaagtaatattagacatctagacttatcatattcatcatagaaaaattttggtagcatctttatatttttaatctaaagcaaaatattgatcagcctgtcctaggatgtagttaatacattagctgatcaatttaaatgccatgataacttcagactcatagatcaagtgctttttatagtactttggaaacccttgagtttttttattctttcttggacttgaattaattttcagtctttcttcttactgtacttaaagtttttgacagtagagccatcattaaatgaatgggagtttgacctaaacttatagctgatattgataacaactgcttaaattttagtgaaacagtgaaatgtgtcattgataaaaacatcatgacctaggttccctgagtatgttagtaactccaatttgttagagtttatatgtatcatggtgttccatgggtgatagagtgccaaaacaatacaaacatttacatatttatggacattttggaaacagtcaattacctacttgtaataaaatatttaatattagaaaaattgaagaataatataaattaatttattttagttttaggttgagtttctttgactcaagaatttctacttatgtttttcatttctcttactacctaaaactaaagaaaacattaagaaaaaggcaggaaaggaacctaattctttttttaaactttttatttttattttattttattttattttttgagatggagtcttgctctgtcgcccaggctggagtacagtggcgcaatcttggctcactgcaacttccgtctcctgggttcaagcgattctcctgcctcagcttcctgagtagctgggactacaggagtgtgccaccacacctggctaattttttgtatttttagtagagacggggtttcaccatgttagccaggatggtcttgatctactgaccttgttatctgcctgcctcggccccccaaagtggtgggcttataggtgcgagccaccacgcccggccctaaaccttttattttaaaacaattttagattggcaatatgagtataaccattcaaagaagcaaaaacaaaatgtactgtgagattcaaggcactgtcttattccctttttctcttctttttattcattaaatatttatgtagtactgactttaagtgctggggaaactaaggtgaatataatagccgttgccctggaaaatttcataatcgattgtggaatagagacacattaacagataacccaaatcaactgtattaaatgcaatagcggaacaaagagaagtaggatcacataatccagctctgcagcagaggtgagggtggagagcagcaacaaaagagagcaatggcaagggaattctttatatttttgcacatgtgaaatgtctgtatagaaatatttgactaagatttactcagcaattagaaattgttttttgtttgtgcctatgtaattgtatcattacgatttcagtatcatttagactttatggataatctacacactaaatgtttattagggaaggaaaagtacttttagaatatgcaacaattctggtgacactcaatacatttttgttaaatatattaatttatccgtttattcaactaatatttattgaacagctgcatagtgctagtcattgcacttgagtcccaggaagatattgttatggactgaatgtttatgaccttccaaaattctatgtaggctcctgcccccaatgttatagtatttggagataggacctttatgaaggtagttaatgttaaatgagattataagtgtgtggtcttgatctaataggagtggtgtgcttataagaagagacaccagagagctcatactctctctcaaccatgtgaggacataagaagttggctttctgtaagtcagaaagagagctcttaccagaacccaatcatactgccattctgatctcctccagactccagatctgtggcaaaacaaatttctgttgtaaaagccaccaagtctgtggtattttgttgtaacaacctgagctgattaaaacagccataaataataagtgtaatacataaataaggttaatataacaattgcattattaacataaagtgtaatacaggtagaatattataaggcaacgacttgtggaacacaggaaaagtgggaaagagatagggaataggaagtggtgtgatgaagggaatcttacaacattaagtaggaggtctgggtaggcctaattgaaaatatgacatttgagcaaacacatgaagtttgtcctgtggatatttgggaagttcgcattctaggcagtgagaacagccagggtcctggccctagggtggcatcatgtctgctgtgtttgaagagttgcaaggggccagtttggctggaggagagggatactggaaattaattagcaggcaataagtttggagatctaataggagtgaggtacctcagggccttttaagctattatagattttaggttttactttgagtgaagagaggaaccattgtagggttttaaggagaagggtaatgtagtgaagggatttgactgactactgtattatgaatagatgttaggaggggccagacaaaagcaataataccaattaaaaggctattatagtaatccaggcaagagaagatggtggttctgactagggtggaacagtagaggtgattagtgattaaattctgtattttgaaataaaaaccaagtgtatttactgatggttaagatttgaggtatgagacaaatataggaatcaaggatgactccaggatttggaacctaagcaactgaaaaactgcggttaccgcaaactgaatgaaggaaaatatttgtctccgttcgcctaacctgctgttattcatcactggtagaattcaggtggctttggttgtagaatataaacagaatattttgagaaaaatgaaaggaagataaaaataactagggaaaataaccatgttatggtatttaagttgcttttagctattttaatcttcatttctcttgaatgaaccttaaggtcttcaccatggctgcaaggagcgtgataaaattcaagtgataataatttacaatataaaggcttgatcagaaatagcatggacttcattttgtttttaaggctgtgcttcctgtatctacatataaatatttaattcctaccaaattgtatatgcaccattatgttaagctattctgtaaaatcttttgagaaaatgtgtgatgctatcttaacacaattaaattagtttcatccatttttcatctgcaaaacagcccatggaggtatttcaaaatgattaatttttcatacttattcacaaagcagttctactaatagttggatttttgtaatatatagttttaaaaatatttccagtatgttaaatacattatatttttcatagtgttttccttcttattagcattatgtaccagacaagatgcctgcgggaaagagatgacacactcaaaaagagtgactaaggaaggtttaataaaggtaatatttaccaaggtgtgggcacggttaagagaagtcagcaagggatggtgaagcttggggagctggtagggactgaatttttgtgtcctccaaaattcatatgttgaaatcctaatccctactgtgatggtatttggagatgggggttttggaaggtaattacttttagatgaaataataaaggtagggcccctgtagtgggattagtgttcttataacaagaggaagaaaaaccagagctcccttgctgccctccacctatatgagtgaacatttgcaaaccaggaagatggctgccactaggaattgaatttctagctccttgatcgtggattttccagcctccagaacttcggaaaataaatgttgtttaagccacccaggctatgctactttgttgtaatagcttgagctgactaagatagtgagtaggctcacaagaccaagattgctgtcttggtttttcaggtacctggagatagagttatatctttattttttatatttatttttatgtttttaagacagagtttcgctctgttgcccaggctggagtgcagtggcgtgatctcatctcgttgcaacctccacctcccagattcaaacgattctcctgccttagcctcctgagtagctgggactaagggcacatgccactatgcctggctaatttttgtgtttttaatagagacagagtttcaccatgttgttcaggctggtctcgaactcttgagtgcaagtgatttccccggcctagggctcccaaagtgctgggaccacaggcgtgagccaccgcacctaaggccagttatacctttaagtgtagctgtatctgtattagaagaccattgaaaagaagcagtaaacttgggtagaggaacaaatcctggaacagagcttgacctaatggggctcacacatgctgattctgcttgcatttttaattgactaaacacaagaaagtatattaggaaagggaacccaattaatatagttcctacaggtcagcctccagggggacacagcaagctatagagacctgaagagtagatttggagagacacacagaaaaatctagccgacgtgaaattattatttataaagggaaaattgatttacatcaagatcaacaaatatatcaagcattatgagtcaacacccctaattgtgctaagtagtcttcttagcttatatatataaagtttttattagaaaatatgttcaaacttacaaaaaagtggccaaataagaatattacaaagaatatccctatcccctttaaccagattcacctattgttagcattttactccatatactttattatatgctctgtgtctctttttatcttagtaatatattttatgttatttttctattataaaagcattgtcagttgaggcgttgggctgagtccttgactgcagctcagtaattgcaatgcgttggctgtaaataccaagtctagtgtggggatggtagctttccgccatgtgacctgacaggtaaaagcctttgtaattgcctgtagttaggcctcaaagatctcacacaggattttgggtcagagctggactcctcaatcctttgtcagaaattataattttattcagattaatttttattcatcattcttcctctgttttagctttaattctaaaaataaacatggaatgctcaacatcagtccttttttaaagttttttcactcctcccttggttggatgaagctcccaccaggtctgtcccccaacggaattacaatttgacatgagatttgaatggggacacagagccaaaccatatcaacatttctagcgtagttttgatacttctaattcaaagtgtttttaatgaccccaaatgtttcaggatgtttaattcaacatggaatttttttatttccattttttggctttatgtttgtttttaggagagttttcattaggagaaattgctttcgtcataattttagcagtcatttagcatcgatgtgatctgctttttctaacattatttatattgtaagtaggttcctcactaagagtatatgtgtacaatatccctgggcctttgtacgttcaaatctgctttttatagacttgatatatgaaacacagtttgactgaatgtatctttggctcatactttcattttttttaactttcttgaaaatatcactgtacttgtaccttgctttgtatgttgtttttcagagaagtttgatgaaattcaaattattttgcatttgtaagatattttctctctttgcctaacagtgctgaggatggtatcttcaaactctaatagttttgccagacatgtgccagagtttagtgttctgagtcaatagaaatgatgtgtcattcctatgggtggaatccagtcttactttattttgggaatgtttttcattatagatgtaataaatttttatgtgattctattttctcttggtaatattttccttttatctttatttctgatatgagttattctttttctatttctttctgaagtccattacattctcttatcttttcttcttatttgaccatttgtattagtctgttctcactctgctaaaaagaactacctgagactggataattgactcacagttctgcagcctctacaggaagcatggctgggaggcctctagaaacttacaatcatgtggaaggcaaaggggaagtaaatacctctcaccatgcaggaaacagagagagaaggaagtgggaagtgctacacactttgaaacagccagatctcatgagagctcactcactatcatgagaacagcaaggggaaaatctgctcccatgatctaatcacctcccaccaggtctgtctcccagcggaattacaattcgacatgagatttgaatggggacacagagccaaaccatatcaacatttctagtgtagttttgatacttctaattcagagtgtttttaatgaccccaaatgtttcaggatatttaattcaacatggaatgttttttttttcattttttggctttatgtttgttttaggagagttttcattaggaggaattgctttcgtcataattttaacagtcatttagcatcgatgtgatctgctttttctaacattatttatatagtgaacaggattcctaattcaagagtattcttttttgttattgttgctgttttcttttttcttatttatttctttattttttacagaagggtgttggggagaggaaagagttgatgtgtttttgtcaccctttttgtttctgcagcaaatatgtatttccttatttttcttcactgcctcatttcaatcccttatatatatcacattctcttaaggaagcagtggtcttagaaggctgccactttgatcctgcataccatcaagggtcttctgtatagccagtgttataaccaaacaaatgctgacccatgtttagtattttagcatttaatgatgcagtttgtcttttagggactgatttggtctatgtttcattgataacctctactgtcctcatgtttttcatgacatctcttatgccttctcttttgcaaattccatacccacagatttgtaatactaggtgacttggtagaaattctgctggaattttcttcttcccttttctaaaggtcatatttttcttggtctcctagttaaattgaagtcctgggttatgcttggattattttgctattattgattttataatttatttggaagggtgtggaggagattcagaatcaatggccccatcattattatccaacaccagaggttgccacttatctgtattttgaactagagcaatcaaaaattaatttaaagctattttgtttaaataatcatacaattttactctcataaatgatgaatattaaatgagaggtctagtttcaaaagcaagaggttttttgcagtaaaatatgaaaaataacaacttttatgggaaacagagcaacatggctgcacagaagcctccactgattttccttcctgcagggacaccaaatttaacaactatctacacaaaaaagcagcaccttcataagaaccaccagtcaggtaagccatgatagtacctgatattaacttcatgccattgaaagaggcacagaagagggtaggaaagaaagtcttgaattgtggacatcactctacccctatctgctggcagcagcccagtggcagggagaatctgtgtgcttgcaggatggagaggccagtgattataggacattgcattagaacccagcacttccctgtcacaacagaaagcaaaaacttgtagaacttagccgacactgatggaaggagcatgtacaccagccctagacagagaagaatcatccatcccagtggttggaacttgagtttggcaagcctcactactgtggtctaaggtgctcttgagtcctaaataagcatgaaaagcagtctaggcaacaagaactgcaattcctaggcaagttctagttctgttctgggccgagagcaagtggaactggggagcatgtgatctaatgagacactagccagggtggcctagggaatgcttgcaccactcctttcataactccaggcagcacagctcacagctctgacggcttatttcttctgcttaaggagaggagagggaagagtaaagagtactttgtcttggaacttggataccagctcagccagagtaggctacagcactgggcagagtcatgatggtcccattttaggccctagcacccagtgatatttctagacacaccatgggccagaagattacccactgcctataaaggaaggacccagtcctggtaggatccatcacttgctgaccaaagaaccgtgggaccctgaaaatcaccagtggtagccacgtaatacacccagtgggccttgggtaagactgagacatgctggcttcagatgtgatccagcaattcccagcagtggtgactatgaggaaagattccttctgcttgagaaatgcagagtgaagagtaaaggggactttgttttgcatcttaggtacccgctcagctgcactggggtgaaacaccaatcaggatcttgtagtcctcaattctaggctttggctcttggatggcatttctggatgtgccttgagccacaggggagcccactgccatgaagggtgagtcctaagcctggcattcaacacaagctgactgaagatcccttgggctttcagtgaacattgctggtagcctggcacaactctttgtgggtctgtggcagtggggaccacagggagagactactttgcttgttgaaaggacagggaagagtggaaggactttgtcttgtggtttgggtgccagctcagctgcagtagaatacagcaccacatagatttctatggtcctgactccagaccctggtttctggatggcatttctggacctactcagggcctggggaactctccatcctggagggaaggacacaagcctggctggctttgctgtctgctgattatagatcctttggaccttgagcaaacataggtggtaaccaggtagttgttacagtggagcttgactgagatccagtgctgtcctgacttcaagtctgacccaatacattgccagtggtggtacctgccacccctcacccagctccaggcagcttagcacagagaaagattccatttgcttggtagaaagtaatggaagagaacaagcatctctgcctggtaatccagagaattcttttggatcttatgcagtatcaccaacgcggtacctctgtgagtccacaagagccatagcattactgggtttggggtccccctaatgcagatatggctgcagtgaccaaaacttagatcataacacacaagtccattcaaaatcataggaagtcttccctaaaaggacaggtatgaacaagcccagactgtgaaggctacaattaattctgaattctgtaatgcccagacactgacaaatatccacaagaatcaagaccatccaggaaaacattaccttctcaaatgaactaagtaagtcaccagtgaccaatcccagagagatagaaatatgtgatttttcagacagagaatttaaaagagcttttttgaggaaacacaattcaagataacaaagagaaagaatttaaaatcctatgagataaatttaacaaggagattgaaataattaaaaagaatcaagtataaaatctggagttgaataatgtaattgacatgctgaagaattcatcagcgtctcttaatagaattgatcaaacagcagaaacaattagcttgaaggcaggctatttgaaaatacacaatcacagcagacgaaagaaaagaagaatagaaaagattgaagcacacctacaggatctagaaaatagcctcagaagggcaaatctaacagttattggcattaaagagaaagtagagagagagatagaagtagaaagagtttttaaaagcataataacggagaacttccaaaacatggaaaaagatatcagtattcaagtacaaaaaggttatagaacaccaagtagatttagccccaaaaagactacctcaagacatttaataatcaaactctcaaaggtgaaagataaaaaaaaggatcctaaatgcagcaagagaaaagagacaaataacatacaatggagttccaagtctggcagcagacttttcagtggaaaccctacaggccaggagagaatgaaatgacatatttaaagtgctgaaggaaaaagcattttgccctagaatggtatatccagcaaaaaatattcttccaacatgaaggagaaataaaaatttttcagtaaaaacaaaagttgagggatttcatcaacaccagacctgtcctacaagaaatacgaaagggagttatttaatttgaaagaaaaggatgttaatgatcaagaaaaaaatcatctgaagatataaaactcactggtaatagtaagcacacagaaaaacacagactattgtaacactttaattgtggtatatcaacaatgtatatcttaagtagaaagataaaaaataaatcggtcaaaagtaataacaacaactttccaagacatagccagtataataagatataaagagaaataataaaaagttaaaaaggttggagacaaagttaaagtacagtgtttttattagttattgcttttcctgtttgtttgcttgtttttgttaatgtaataagtgtcaagttgtcatcagtttaaaataatgggttataagatattacttgcaagcctaatggtaaccttaaatctataaacatgcaacagatacataaaaagaaagaaattaaacataccaccagagaaaatcatcttcactaataaggaaggaaggaaagaaagaagaccacaaaaccactataaaagaaatggcaaaatggtgggattacatccttacttatcaatggtaacattaaatgtaaatggactaaactctccaatcaaaaggcatagagtggctgaatggattttaaaaaatgacccaacaatctgttgcctacaagaaacagacttcacctataaagacacatagactgaaaataaacagataaaaaaatgacattccatgcaaagtaaaactaaaaaagagcaggagtagctatacttacatcagacaaaggagatttcaagacaaaactataagaagagacaaagaagtttattatttaatgataaatgggtcaatttagccagaggatataacatttgtaaatatgtatgcaaccaacactggcacagccagatatataaaggaaatattagagctaaaaagagacaaagaaacattggacttaatctgcattatgtctcaccatatacaaaagtcaactcaaagtggattaaatacttaaagctaagacttgaaactatgaaattactaaaagaaaaatttagggaaactctccaagatgttggtctgagctaagatttcttgagtaatataccacaagtacatgcaaccaaagcaaaaatggacaagtgggatgtgtcaagttaaaatcttctgcacagcaaagaagataatcaacaaagtgggaagacaacccacagaatggaagtatttccaaactgttcatctgacaagggattataaaccagagtatataaggagcacaaacaactacataggaaaaaatctaataatccatttaaaaaatgggccaaagatctgaattgatatttctgaaaagaagacatacaaatggcaaacaagtacatgaaaagctggaaaacatcactgatcatcagataaatacaaatcacaatagcaatgagatgtcatctcatctcagttaaaattacttctatctaaaagacaggcaatagtaaattctggggaggatgaggacaaaagggagccctcataccctgttggtcagaatgtaaattaatacaagtactatggagaacactttgaagattcttcaaaatactaaaaatggatctgccatatgatcctgcaatcccacttctaggtatatacccagaagaaaggaaatcagtatgtctaagatatagacatactcccatgtttattgcaacactattcacaacagccagggagtggaagcaacctaagtgctcacaaacagatgaatggataaagaaaatgtggtatatatacacaaaggagtaatattcatccataaaaaaaagagtgagatcctttcatttgcaaatgaggttattatgcaaatgaattggagatcattatgttaagtgaaataagccaggcactgaaagaaaagcttcccatattctcacttatttgtgagagctaaaaattacaacaatcgaactcagagagagagtggaatgatgattaccagcagctgggaagggtagtggggctggtgggaagtggagatgattaatgagtacaaaaatatagttagatagaatgaataatctctagtatttgataacacaacagggtgactacagtcaacaataatttattgtacatttttaaataacttttagttatttagtatccagtattttagttatttaatataatcagattgtaatacaaagaaaagataaatgcttgaggtgctggataccccatttaccctgttgtgatgattatgcattgtgtgcctatatcaaaatatttcatgtgccccataaatatatactcctactaaatactcagaaaaatatttaaaaagtaaaaagcaaaaacaatgaaattacgtctttagagggccaaaaggaagaaaaagtcaatgtagaattctatactggataaaaatattcttcaaaaataaatattatttagacaaaactgaatgcatttatagcaatcttcattacaagaaacaccaagaaagttcttcggcttgaaggaaaatatttgtaaatggaagcacatagtatacagaaagaagagaagagttccagaatgttcaaccatagatacaaagtcaatattaaaaaaaataactgtactgttagagactagcagcaaatgattacataaataaacccttaaaaatgctatttataatagcataaaatcatgaaacaccaagagagattttaatagatgtttgagacctctattttgaaaatattaaaatactgcttagagaatttaatgaacagagaaataaatggagatcatctataaatttattatgattctaatctatatttaagcatgtttcttttcttttggtggacattaaataattttaatatttatatgaaattcaaaagacatagctagaataatgtttaagaagaagaatgcatattaccagtttttaggattcattataaaattagaatagttaaatgactatgggatttgcacaaggatcacatcaagaggtgggataaactagagtatagaatagaccaacacctatacattgaggaaaggataatgtttacatgaaaatagtaatttattctttccatatatacaaattaacttgaaatttacaaaatacatgtctgtagtagcattcatgtttgtccccaagtaactagcacatttcaaggcacatgatggatattggataaagagttgatgaaacagtgacaacataaacttcattactgagaaagttttattagaatgcactactaaaataaaagaaaaattaaatttaaagaatgcactattaataacagcaataagactgatcctgcaagttttcttcttgaggattgaagaaatataaatgaatgctcatcctactgatggttgatatgtggccctagatttaaatttaaggggatttacaactgacctccagtctaggaattcatagtcactcatttattgagcctatcacaaagtagagttctttatttggtgttgaaggggccagggaaagaaagaaatggaaaagtggtgttccatgttgcttccttattactaaacatgagaaactgcattatgtaaagtgatttctaaaatttctatagttccacatattatcagtatcaacatatcatactgtcatatggttccatgtattgataataccattcaaaatagttgacttgagaagttttaatctaaattagcgtaaaaagcaaacatggaaaaaacacatatggatgaaatattatggagctggtgtcttttagtgaagaacagaagagatcatgaaaaaagaaataaacaaaatatgttaaaattcaccaaaaagaaaaataataaaatgatctactatcttctcctcttttatattgtgataaacagagattcaagtttttaaaaagaaaaattgggccaggtgcagtggctcacacctttaatcccagcactttgggaggccgaggcaggcagatcacttgaggtcaggagttcaagaccagcctggacaacatggtgaaaccccatctctactgacagtacaaaattagctgggtgtggtggtaggggcctataatcccagctccttgggaggctgaggcaggagaattgcttgaacccaggagacaggttgcagtgagccgagattgcaccgctgagctccagcctagttgacagagtgagactctgtttcaaaagaaaaaaaaaaagaaaaaaggaaaaagaaaagttggatcacttagctatatataaggagacaataaaatacttatggatggtttaaaatggataccaataaggtttttctataagttggatttctgtatttggttgtcttttctaaaactcctggaactaatcaatcagggccatactaatttgctaaaaatgaattttcaaaataatattgaaagtttcaaaaatcttttctgattcatgacttatttcttgcaagttagtgctttctctttattaattcaagcatcatggcttctttgccaatattttattcaatcctgaaaactagcataactgacatctatttattttcatgagactgatatagggggttgacgccatttagatgaagagctcagaattaaaattttctagaatttctgggtctttgtgttacagcatgtgtaacaactactttaatatccttaatcctaatatagggtcacatgaccttaaatgtaggaaatttgtaaatgagtgcttttattgcagacagaaaaaacatacatgcaatttcatctttttgttgtggattatatttttataattctaaatatgtttgaactttaaatactatgttagcacagttagtcctcattatttatggatttcatatttgtgaattttactactcactatgaaatatgttgataatccccaggccaatactcatggtgtgtttgctgtaattcacggacatgtacagaacattgaaaaatgtgaattgttcaaaccacatattccagtcatgtgagaagaaggcaaaacagcagtctgccttcttgtttcagctctcatgttataaacgagtgtcctttttgcagcctagttagtgccaagagctttgaattttcatccttttacttggtgattttacttttaagatggtctaaccatcttaacccaaccagtggtgaagtgctgtttatgatgaaatagacaagaagcacaagaagactatgatgtgccttacaatgagaaaatatgagtgttagacaagctttgtttagcgtgaattatagtgcttttggctgtgagttcaatgttaatgaatcaacaatacgaatatccagaaaaaggaagaggaaatttgctgagctgtatatgaagttgcttcgtaaagtgcaaaactaacatctgtaccacatgataaaactatggaaaacatggaaaagtggctaaatctgtggattcatgaaatgacaggcaagcgtagagaatagcattattttgatgcggatagccaaagaaatttatgctcatgttattcaggattttaaagatgctatgctaaatccttctggactagtgctacatggcccacatgtttcaaagagtgatagcatgaacatgataaacttgcaggtgaggcatattctgcggataggaggctgtgaaaaacatttttaaaagaattctgaattctttataattatgtttatgatggaacacatttatgtttagcttatagtttgtttttttatgatcaaagagactggagctaattgcatcttactctcttttcattatagtgtatataagatttggctcaaaacatcaatgtaaccctctagctcataactattactggttttccagactccagactaatacctccctgtttcatgctgtctcctttacagtgtgtcacccaaaagattacaaaatgttttgaaaaacccctaggacattgctgcctggttatatgtagtagagtactgatggtacctatctgtctactccttacagcaactggtggtagggctgcaactacaagaattagataaaattgattaatgatactgtgatctgctaccaagtttgctattggaaaatagttcactgattgtaaggaacacaaagaattaaatgaagacaggagaaatttcttctaaaagaataaaatgaagtgtaataatttcctgcatacctcagggagatagggatatgaaaacattttcatgacttcaggatattaatgtggcctatgtcagcgattctcaaattgtgatgtatcccttaaaccctttctgaaggtctaataggtcaaaactttttaaaaataataatagtatgatggttttgtcttgttcactttgttgacatgtgcactgattgagacaggaagtagtggttaaaatttctgatgtctacatttgaaggaagacagtgactacacatcatttataatgaaatgcaaagtaagtgtaaacaatactggcttcatcctcatgtgtgatgaatgtgtagagtaaaagcacttgtgcgactgtttgagttgcaaaataaagtagctagtttttcgtagaacatcatttttaactgaaagaattactatgggtaatttaactgaaagagaatctatggatgttaaaacttgggtattttgcagacattttctgtgaaaatataggaagtgagtcattcgaataaaacaagtaactatttattgccaatggtaagtcaaactttcaagtgacaatttgaattttagaaaacttgtatccatgttcactgtgaccctgatagttttccaataaagattattctgagaaaagttataaacaaacgtattttcatattgcatttgaaatgtgtaaaaatttgctaaatctgcatagcccaaataaccagtattttccaaatgactaatgcagaatgttacaaaatcatgaagaaatttaaaaattcattcaaaatgcaagataaatcaatatatttaaccaattagagtatgaaatattcattgtcagggcttttattttcacattgcaagtaaactgtaaggaactattacttgctgagttttgatgtagtatcaaagcaggatatctcaattatctgaaaaatctgccagaatactattccaatttctaacggaatatatgtgtgaaacaaaataacataacaaaaacaacatactatagcaaattgaattcaaaggcagatttgagaatctggctagtttctaataaggcagatactaatttttttaaatgaacaaaatgccatttttcttactggttttttgataataaaagtatttgatatttaaatattttatgtatattaatgttttaggtttattgtttttacattcaaaattcagaaatgtttttaaattatactgttaaatttaatacaataaagtgtttatagatgtagcccaaacaaatgctcttataggccttaatcatttttaagagggtaaaagtgtcctaagataaaaaattttgagagctgctataccacattttgaaaatcatagtataaggtttcattattatcttaaataagttatgcttaaaagtgaaatggtagttaaaaaggataatcaaaaggaagatctcagaacttgcttgagatttggagagccagtcgactggtataacatgatacaaggactcattttcaagtgtgaattacaatggtaacatttattgaggacaattaggtttttacatacataattttgttttcttttcacacaacttgttgaggtagatactattaccataattttgtagatttgaagaacatagcccactgaattttggtaactttactgcacacagaaggagagatttgagaataagataagggacacctccctgactaattcattctatgaggccagcattctcttgataccaaaatctggtagagatacaacaaaaacagaaaacttcaggccaatatccttgatgaacataaatgtaaaaatcctcagtgaactactggcaaattgaatacagcagcacatctaaaagctaatccaccttgattaagttggctttatccctaggatgtaaggttagttcaatatatgcaaatcaataaatgtaattcaccacataatagatgcagaaaagtcctttgataaaattcaacatcacttcatattaaaaatcctcaacatactagccactgaaggaacatacctcaaataataagagccatctatgacaaatccacggccaacatcatactgaatgggcaaaagctgaaaacgttccccttgagacctggagagagacaagatgctcactctcaccacttctattcaacatagtactggagatcctagccacaacaatcaggcaagagaaagaactaaagtgtaaacaaataggaagagaggaagacaagctatctctcttcatggatgaaatgagaggtgagaggatcaaaaaactaccttttgggtactatgcttattacttgagtgacaaaataatctgtactgaacccatgtgacatgcaatttacctatattagaaaccttgacatgtacctctcaacctaaaataagagtttaaaaaaagatactgtcaaaacaacacagttctttctatttctgttgtaccactttgtaatatcaaagggtcctttcttttcctctttaggtttcgagataacatccataccatacataaaaccaagtatagttgatttttatactactttttcattataaaattaatgcatgtaaaaaagtatcattaaatattcctctataacagttttagttactaagtagaatttaactgtatggctataccataagttatttaattcctgtcattgttgatcaaatatattttcaacattttgttatcgtaaatgatgtagcaatgtacactcttcaattataattttgaatatatccgtaattccttcacaacacgattaaaactagaactattaaaatgtacctctagattgtactgcagaaatattgttgctgttaatattaatctagtctaatatttattgtcagttccctactggggtaaatacttttgttttatttttgtttgtttttatctctagtatcactaactaactttgcattgtttcatgtgatcataggctatttgctttgtaaaagttattcactattgaaatggtatgtgtcagtcattgctctaagtgttttatatatatacacattacatatatatacatatacatttatattgacacatttatttctgaaaacaaccctttgaaataatgtaccggtcagattaggtgaagatatgctgatataatgagcaacactaaaatctcagaggcatgcaacaacaaaattttgttgttgctcacattacatatttattgtgggccaacagcagctctgctctccctcttcttcattatagtacccaatctgaaagattaattcctattggaatttttaaaatcttacggcaaatggaaaagggagggggcttaaccacaagatgactcttaacatttctgtgtgtaagtggttcccatcattttagtgcacattgctttgaccaaaagaattcaaatagttaaacacatcttaatgggattatgatttttagttcctccatatggagaaggatcagaaatcgcagtcatgatatcaatgagcaacagaaagtattcttgcacaaagagggtggcaaatatttgagaacaaagacataatccacattttgtagatgagaaaactgagatacagagagtttgagtaacttacccatactgagagatttaataaatggtgcagctgggatgcaagcctgagcactctggtttcaaggagtgtgctctggtccaatgatagaagataaaatttatccagaaaaagttacctagcacctcatagtattttacaaatatgacaaccctagaaattattgtccaaagttggaccctttttcttggataaatgctaaactgggtgggatatattaactagttttaacctgggattgtcccaattaaaccaagatgtgaggtaaatcttgaggcaaattttataaaacattatactattgggtagtaattaagggttttggcaagcttgtttaagaagtaccaaccaaggaaacacttattatagaggcttcactgcaaaatacgttatataataccctccaatgcacactaagtttctgagttggttttgcttctttgctatattctgtaagtgaaacttattaacgtttgcagcatttcctaaggtggtctctaaaatctgctctattttagcacttttaaactaccatttgaagtaacaaatatttctaaaggaggccaaataatagttgtaaagtttgaataaagcaggataaataacaaaacacactaggaatttattagtataacagtgaaaagaagcaaaacttctagacttgagcttatatgcttattgttttgtgtgcttagtggaggaatgtataaatgcggctgagtatacaaactataaaatctctaattttaacattgcttgtttatatattaggaacttttaggggagttttgatttgcaagtttttataggtttaccagactcattaattgcctgggaagaactttacaggatttcctttggtttatgtctaatctttgaaattggaaaacttaaaagtgaaatataaattcctcatggagaagtgatcatgaggtctgaatagaatcaggtaattcccaagagacatgcaagataataataaagacacaaaaaattattccatatcatttgtgcccttatttgtgagtaaaggggtggaaaataaaataagatgtcattttcatctattgaattggcaaagattttaaaatataatattgaatggttgtaagggattggtcaaatgagcattctcttatatggctggtgagaatttaaatagacacaaattttgtggcaagtagtttaaaatgaaaaacacacaagaatttatacatgttcttagtcattgacatcaaggaatgtatgctttggaaatacccacagattttaatgacatatttatcttctagaattatttttagtgttgaaaaactagaggcaataatgaaaggttaagtaaattatgtctgtccacatgggggaaggttacacagcatttttttaaaatcatgctttcaaataatatatcttaggaaattttaattattcaatcttgaatgaaaatagcagtctgcaaaattgttaaacagagaatggtcacaatttttaaaaacagaaggaaatataatcatgtatcagattaacagcagttgtaaaccgtgttgtagaaaaatgagtaatgtttgcctttcaaaactatggatattttccaaatactctgcagttttctaattataatcagaaaacagttattaaacaaagtgaaagaaattaaagtttaaatttaccagtataagttgcttctttggagggtatattttaacttattgactaccatcagatttactaaatatcatagcacgtaatttcatttaaattcaccacacattacttttctatgtagttcatttaccacaggtataatattgccatttgtattactagtagaaattatacttaatacattgaatttatgccataggaaaaagaaaattaaaattatgttcttattgtatatgcacatattttcttcttgataaaggatttgtctcaaacagattgtaatgacagatgatagctatagatagatagatagagtaaacatgtaagctactacaaggatccaattagagtgaatttaggttggaagaaggttctttcttcatctttctttatctctgaataatttcaaagttgacagaccatggttgctgacatctttattgagaaaacaagagttttgcccacgcttatttaaatgtacttatattttcctgtttgctttacatattacatatgatgaacttttgaggatgggggtcataatttcctttttttctatctttctgaactaaaatatatatgtaaaaactcaataaatgatagagaattaattactgaacatatgtttgtattcacacagaaaggtggtaaatatagaagttgataggcagcttctagagccagatcacttgtgtttaaatcccagcattgctatgtggcttcaagaaagttactcaatttctctgtgcctcagtgacttcaattcaagtataacatgaagaaaataatgctactcatctttggagtggtgaagtgacttaatgcttaccaaacacttagaatatgctggcatatggcacatttagctattatcatttcaagataatttccttgctaagtgactataatgattacaactcataactgtagctttgaggaatacgtacacatattcaaagctgggaattgtttgttggcagctctactggtatatggagggatacagaagaaaatcatcatatgtacagctaatcaccaagagatttatggatataaagaaatacatggtaacaagaatgtttattgatgaatttataattagtgagataaaatttacaaatggtatgggatatcattaaaaagcttttagaaaaggaaattcttatggggtacacaaaacaatatgaagataaatatttgtgaactggaaaaagctggcctttcaatctagacaggatatattatgcaagtagtcacttaattgagcctttcctttttctgacttagataattgataaaaaatatatatatttttatttcagagcaggatggaagtttatttaacagctttataacaggaaacaaaggaaagtactcttggaagagaccacacaggcaccttggaggtcaagtgacctgtttaaccttgcacctcaaattttatatgctggactacttctttcatcttgtacccctttccctttattcgtccctcatgatgagtcacccacatgcatggtgccctccttatgctccagagatgagcatgcagagtgtgattacgaagttgcttgcatacttacctcaggcttttttccatgatacaaaggatatttttgaaatacaaaaaataaccttttaagtaatttgccaatgtaaggcattatgattactacttttcttattaataatcatcatcgaacatagaaaattaaagcaaagtaaaattaaattactttgcccctccattggagaaggaatattaaggaaaatttacattacattttattcttttgtttattttttatatagttcttgggattgcattttttgaagttgagtatatttgggtataatgtgctttaatacattgaacttcttccacccctttgttttctaaagggcttttttgttgaattttaaaggaagtttagatttttaaaaacccaacattgttgttaatagagttgaagatacgtgcgtgtgttatttcaacaaaggctgctgggtggaatgtgtactgtgggaacctttatttaagcaattttgctgctttagttgcatcctttattcattctgcaaaaaattcactagccatgagctggagtacggctactcttttcccattcccccactgttgatcaaataaagctatggaaaaagaaggagagggagaagtaaaaggaaagagaagaaagaagaaggattaagtattaccttcaggaccaaagagtggaagtattttctttaacatttaatgaagtaaataaagggagtacaaagtcaagtagcaataagaaaaacttgaaatgcacgagggcaggaaattgctctgtaaatatgattaaattctagacccaacattcagtggaaacaagttttagaatttttccattagagatcattaaaaacattatttctctcaaacaaggtgacaagtggaagagcgtgcacttgatttctaaattgccaccctccttagattcttctgacatactagcagtggccaaattccaatatacattcatagttcaatgcaccttttcatactgtggaggcacctgcatatccactttctccctaatcctttgactattcaaataatattatcaatgcacaattatgtcagtgatttttcttcatgaattgtaaccctgtgctagctaaagtatgtcaccatcatatcagtgctagtaaatattgtggttccttgggtgaaactcaaagacttgtattcaggatccttaaacatgttatccatctagtttctaagagggaggacaggaaatgtttagttttaaagtttagttttttgtgtttttcatggcctgtagcataagtccccatgttgcatagtcacactgaaacttgatattatattttgtggttgctgtgcatccaagattcctttatactcctcacatataaactgagttttatgtccttactgcctgaattttccttagaagtcctgtaatccaaatgattttagcatcaactccacagagaagtcatgaagcctgtagaccatactctatgtaaatctctggttcatttctcgttgctaatctccaccctcgtacccttcccttgactttgtcacttgtatttttcttttaaaccctttccatatttaaaacaccacaatattgacatgtgagccatcttctcgagagagaatcaggtattctcttagccttctaccttctgttgccgttccaaggctattactgtttagagcttaacttcttgtaataacttgcatcactccccttgtgtcctcttaacaaacaatcacatcactgctcactcatcatttccctcaatgtgacagtatgaagaattcaatttaatccttgctatatgggagtgacagtagaaaactgggccatgatggatcaagcattatcaattccacagatgctcttacccaaaactcaggtcataaatactgtgaacgtgccctgaaaatactttctacttgtatcctcacccaaattatacgcatttataccatagcgcaatatattcccccatactactgaggaaattcctatatctatgaatgctacaagagatccaaatgtagtttgctttgaaggtagaccattgtcaaatgaccgttgattaatcttatttatgctttgataatatgtataatgtttaacagcttgaagtagcctcaatctttaatggacatttgtggtgaaaccacaataaaacagtgcttgagccttgggttttcatagtctctaggctctaattcaagcaatttcctatccatacaaccaatagattcttcaaatatcttgtgaatatgacaaatttcttctaaaatagcatagctttctagttcctagcttctgtttaaaatctagaaaccaatttattattccctatccaaatagattccctaggtacataaccctatatccaaaggttacagtgtaaatataaagagaactttatcaatggttttatgatgtgtatttttaaaggaattttctcctttgttttttaaaacaatgtaacctatatgaattttgttttcatcttaaaccaaatgaaactgaagtaatatatcttacctagggtcagaaaacaaagatacaatggagttgagatttggcttggtggtgttgtcttcacattagggattttcctctgtcttatgtgccagagcagttgagaattctatatgacattaaaaatctcttaatttttagttcataaatattgaaaattaatttgattattgattctgttgattaaggttgttgcacataaacgtgcctaaaattccttagtgctcctactttctgagttagctggaatgcttgtgctttgggcataccttatgtgcaactctattgtgatgaatattatgaaatgtaactgtttcttcactgaaaggaacaaatgataaatatttcatcgaatgaatacgtactattgttgttgagctttctgagttggagaaagagcagactttcttgaggaagtggtttcgaatcagaactagaaagatgagaaagacatcttccttccattttccatggccacctctgcttcagactcaccttttttctgttcatatcctttgcccactttttgatgggtttgtttgtttgtttcttgaaaatttgtttaagttctttgtagattctggatactagccctttgttagatggatagattgcaaaaatttcctcctattctgtaggttgcctgttcactctggtgatagtttcttttgctgtgcagaagctctttagtttaattagatcccatttgtcagttgtggcttttgttgccattgcttttagtgttttagtcatgaagtctttgcacatgcctttgtccggaatggtattacctaggttttcttctaaggtttttgtggttttaggtcttacatttaggcctttaatccatcctgagttaatttttgtataaggtgtaaggaaggggtccagtttcagttttctgcatatggctagccagttttcccaacaccatttattaaatagggaatccttttcccattgcttgtttttgtcaggtttgtcgaggatcagatggttgtagatgtgtagcattatttctgaggcctcttgtctattccactcgtctatatatctgttttggtaccagtaccatgctgttttggtgactgtaggcttgtagtatagtttgaagtcaggtagcatggtgcctccagctttgttctttttgcttaggattgtcttggctgtatgggctcttttttggtgccatgtgaaatttaaagtagtttttcctaattgtgtgaagaaagacaatggtggcttgatgcggatggcattgaatctataaattactttgggcagcatggccattttcatgctattgattcttcctatccatgagcatggaatgttttttcatttgtttgggtcctctattatttccttgagcagtggtttgcagttctccttgaagaggtccttcacatcccttgtaaggtgtattcctaggtagtttattttctttgtggcaactcacctttttatgacttgcaccacggataattaagtgatgtctttgtgtcttctcaccagacaaccatgtccctgcctgacctttccttttatgtgacagtagcagcagttgtattttagttcctgctgaagtgaagaaagtgaagttttaaagaaagtaatggtttgtgaattgggatgatatgacagactttagtaataagagtagtttgcctgtgttggagaatcctagaaaatgagtaacaactgtcatgaagaatgattcaaacgtgatgttttcattgataggaagagagaatgatcatatctgcaacctaaggactaaaagagctgatgtcttgggctccgtatccacataggctacctctggaatactaaaacaaatgtacttctcaatttttactggagaagagatgcagtttaaacgctgccacagagttagtatttttagtgtcccaaacaataatggtccagatgtgttatttcaactataaatttcactttttattgtaaaaggttaaagaactttacaaaataatttttattaagtttcttacatttgtttttctggccattctctctatagttttctaattataaattaatgatgggaaatttattaccaaactggttcacaagattctttgtttacatagtttctactataccagtttgacttgaattataaaaattaggttgatatatctcgagtatgaaaggaccctttaaaattcaattgtgagctgtgaaacaatattacaactctaaggtaagcctactaaattttaggaaattgattttaagtagagtataatgtaatccctaaattatttaagtctacttggaaacatattttatactgtaaaactgcttactacaatactaatgctttcacttgcctctattacaaatgctgaaaaactcatattaaaacaaatctatctttcatgccaactataatacagatattgtgtcttagttaaaataatagggaagcgtgttagtgcccaggtaagatttcatgctaacagtgctgcctaagaataactttatataaaggtttccttcttctttctgaaagttattttttaattgctcaacataggccaatccttagtgacattgtatttgaaattgtttaagaatctatttatattttgagtaacttatcatgattaacaagtttgaacatttgccttaaatttgttaagaaggaaatttctatattctctttcactgtttacttttttcttcctcagtaaggcaatttaattgctttcaagtaatttcaaggtcatccttagtttttggtcttgtgcatgttcccaagaacttaattatagaagtttttctgtaatgaatatgacagagaacccaactctacacaactgatctatatttatgttcctactgaggcatggtagtcctccttccccacacttgcctgcccatgaaatcgaaatatttggcaggattaattctcaaaagataaaaacactctaattgaagaaaagtatcaattcaaatcatatcttttaagaagaaatatattctttactttcctgcttaaatttgaaatagtagcagttgaaaattgtggattggaactaattactgattaaaacaaagtacacctatgagttttaatagaagcagtaagagtaatgtgtaaatgacttttctttgttcatggaaaccattgtggttttcaggtgcagcttaccttcacaaaagctaattgtagagataattacatccaaatgcacaaattggggaaaacacagagaagcttcattcagaattcactgacactatgaaagacaggatggtataaaagagttagtgtgctctgaaaaaggaagttcttaaaaactttggaactccagagtcttgggtttgatttctgcttccatcatttaattgaatttcaggcaggttatctaaactctgcctcagtttgctcattgttcatgcaacagagtttctatgcagactacacatagtaatatattttaagctttagacataaatagagttcattcctcactgaccgattttcttttaataaataaatcattcttaaaatttcttttcttgaagtacgttataggtcagatacaatagctcacttctgtcccagcaatttgggaggccaaggtgggaagatggcttaaggccagtttttcaggaccttcttggacaacagagtggggctccatctctacagaaaaaattaaaataaaaaataaacgtaaaaaaataaagtatgttgtaatttggcctgtttaatttgacaatgccattagtagtatacactggaaagctgttatactatggttgttgcccattgtcagtaggcaacatttcaatgagctgtaatgttaaactgaaaataccctttttcttgagcaattatgtgctatttatatataatatatattatgtgattatatatcatataataaagtatatattatatagaatacatataatacatttacatataatatgtataacattttctataatgaatacgccagagaacccaattctacacaactgatctatatttatgttcctactgagtcatggtagtcctccttccccacacttacctgcccatgatatcgaaatatataattatatgttatacatattatatagcaattataggcatcacacaattttctttatatatcaccaattctatttatattatatttacattatgtaaatatatagagtatatttatatgtaaatatatagaatatatgtaaatatattatttatataaatcttaagatataggtatgggcaattttgattttacaaacttcttcagggttctgtatatccatttgcataaagttttgattgtatgcatttttatatgggacactgacttatttttcatccaataaatggtaaatttctatccattagaggatttacctttgatttcattttggtgatactttaaatcataggtcagctattagaaaaccaattacaaattacaacgtggtaactaaatgatatttactaaagcaaagcatatcaattgatatttttaagttatatgttagcatacgcgcacacacacacacacgcgcacgcgataggatccagattgatgccctaataaagtaacaagttagttaaagatgaagtgaatttataaacataccgttatataaaactgtctagatagaacaaacaaatatcacttgtgatgaaatacttgaaatttagttcaccacatgcactgttgccatcatttttttttatgagaggattcagctattgtatcgagtgtttgcaagcgtgaattcagaatcttggtaggaaaaaggtaaaagacaaattgctatcttctgaaaggaggtgtgaattgttcatatgtgcagattttacattaacgagaaaccttaactttctcaaaagaagaaaggcatttctaacaatgttacgtataacatatttttgttcttctgaaaacttgtgtttcattttcttttaggaaaaaaaaaagatcagactcttaggccaatttttcagactcttctgtagattacttgagcagatatgaaatcaataagaccttaggtaaacagtatggtacatattttttttaagtctctgatacattgagtctcaaaatatgttgcacattaaccgaagacatgtttgtagaattcatagcacttattatatcttgattatactgaaacatttttaactttgacaattataaatccatcttgcagtttctccaaattcattttattttaattagctatgatttgacatcatagtccattatacacttacttgactaagtctatgctatcagtttttctacaaccaccacttcctatcagtaaataattgaaaggctttattcttataaagcacaattatgtttgcttgatcagtagtcttcaactatatctgctcatgtgtcccctaaaataattgagaaaaatagtataaaatcaataacttttgaattcaatacattcaagcaatgatgtcattatatatgtggttcatcttcctgacacacgggagatgtttctcttagacctcagtgccagaacagtataatttcagagcaacaatactattttcttggaatataagtgggaagctcacaactattcatatttctctctttgtcaagaaaagttataaggtttaacacaattatgaaagccagaaaacaaatgtatttttgtagcacttttgtagaaactcctggctttatgttactgtctctcactttccaataatgctttttttaaataatggaatttgttatgtgtttctgcaaattgcatgatatcctttgtgaatgaagtagatactaattaactatttctaaacagaccgctacaatacagtgtgaaaagttttaccataactgaaaatgtgttaataaagaagtggctacaggctgtgtctcatacactgtaattcttttcagtagccttgcatctctaattgattttgcagtactaaggccttcatttcttctgttacattccaatattcttttctcttgttttatctttagcattaatagatatgaagaaaaaaactatcctgtactttaactagattcagacgctatttccttttgttcattaatcctacttaaactctctatagtgtgtattttaaaaaatgtttgtacatgctttttggaaaagtgctatatatccagctaatcatttctatatacagttaaaaagtagaggtaacagtgcttatttctttatttatatatttagaggcggagttttgctcttgttgcctaggctggagtgcaatggcacgatcttggctcactgcaacctccgcctcccaggttcaagggattctcccacctcagcctcccaagtagttgggattacaggtgcctgccaccacacccagtttattttttgtatttttagtagagatggggtttccccacattggccatgctggtctcgaactcctgacgtcaggcgattcacccaccttggcctcccaaagtgctgggattacaggtgtaagccaccatgtccagtcagtgcttattttaaaatgaaacatcaggaacattttgaaaaacatttttgcataaagtatcagggctatgtttttgttcttgataccaattgccagctgattgcattattgtgtttaaaattatcctggggcataaatttatccagagtctgatctaattaatttcaggctcctttgcagatagttttagggaccaatcatctctgagattttttgtgaacacaggagggctcttcttgattttctctttacctgattatctatggtgaatgaatagctgacccacagtttagcttgatactctcatggagctactatcctctcttaatctcacttccaaaatctctattattattcagagtgccttcaagtttaaccttccccacactttattccaaacaagtgagttcctttcaggagagctttggagctctgttcttatggactgcctactccatgggcaaaattcctgtgtctccctgctctgtagttggctcctggacagtggtctacttctctcagagtgatactttggctttacgggcagggtactcggtggagtgataacatctggtcttcctcttatagcttgaaactttcctcttatagcatgaaacttttgccctttgagtgagtagaggcaagggtgatcggggcccgcccattcgttttcttggcttgccatacctggagtagagctttcaccatagaagtggggggtcagacaaaggaataaagcctagacctctcagccattgttgcctggaagagattctgaaacagagatttgggaatgggggctgagaaacactggtgctctgcccttgaagagaagataccacctctcttgactaggaatggacggatagggagccctattgttcttggctgcacccatctggagtggcgcttctctcatgctcagctgtgggtgagctgtgggtgtttgtggctcaaattccacagactcttgctgctcttgctaagatttagcagaatttctaaaataaatgtttcttcctttactgtctgctcttaggacaatttccagatattaccctttttttttttttttggtataaccttcaccacttatggttgttttgctgtggagaaggtccacagattctagattctgccatcattctagaaaccatctctttgctgcctacattattaacatcatttattgtatcttgtttaaatgaatacatatatttatgtgtcagtaattgggccagatactaagaggaaaaagatgactttgtcatgagtgtgccttgcgagaagcacaagtttaaactggaaaaatgtaaacaatattatcatttgtgtaaaatacaaaatgatgtgagtacataatatcattgtgaaagatatctatgcataacaagataaacactgggtgataactttagtgtggaatactcctttgaagaaatcaaaatatggggatatttatgtttattggaaataaggtgaaataactttactaatatgttattttctggaaataggtgaaagtctacatcattctatggttcccttattttaacctgtaatgtcagctcaatttctattttatgaaatgcagatatgaattaatcagcttttattttataatagtaagaaaatatatagattttaaacattgttctaatagaaattgctatttttaacaacttaaaatttatttcataaatgtaagcccaaaatatcagcacaaaagaaatgtcaaacttgatttacccattccattctttggaaaacctagattttctatcctacagaatgtaccttcagcacttttctcagtctgttttaaaataacctctgtgactgagcttctaccacagtctcaggaacctgttccataattcatttattgttcagagtcaggaaatcgcttcagatattcaactcaaatttccgttaccattatgaaaataactttcctctattaggatattttatatttatcctattcactgcctctaagtttttcccatgccacacaaacatgtatgtcacaaatatttatatatttgtgtgatttaagatattaaaaatctaaaatacaacatttaaaaaaccgaatctacagtattgggtaatatttttggttatagaaagcaatcacagaattttcacattggactcttttgcatgaggatttagggttcttaatttgataagccagacaaattattatcaatattatttacaaagatgaaaaaaaaacctcaggaaggcccaattgtttgcagtagctataaaaatggcctaaattatcttaaactgcataaacaggttataatattgtgataatatgcagtaactgactctttgtgtattttactactagggctatatttgaagtctagtgctcagatatttgatgaaggctcttacaatattcttgttgagaagatctccatttgggagtgcagacaatgcagtataagctggattatgttatgttgtaaaattttatttttaatgtgtataaatttatgtacttgtatagccatataaggaaattttatttatatttaatttttaacgttctgttcttactactgacttgaatgaagacaaagagcatttttattatgtgtgtaaaacatggtccattttgaaaggatattgattatgatggctaaaaactcaagactcaaaataatttttacaagctaaagaaaataaccttaccaatataaataatttgtattaaacattacaaaatatactaaattaaaaggatgagttattaccttttattatttttataacatacatcatactttctgaatatatttcattcttaaatgtatgcctttgttagttctaaacactagaaatgaaggtatttatcaaattgtttatgtcattttcagtgtcttctgtaatatgggattattgtattaaatcacttatttaattcatttataaaaatgttagtaaactgcttattcagaatcagtcatttctgttagaagataaaagtaatggttaaactgaaaggccttttatttttttccactatattgaggtaattttaactattcattgagataagagatattaactaatgactttgatgaaatgaaacaaatgactagttaaggtagactctatagtcaaaaactaaatagatcatttaaattacagaactgctttaaactaatcggatattttattgtaccctgagagtttattataaaaatttagataggcaaaagccccatctggcaaccgtgttactacaagctaagtacagagaatcttgctgccagcagaggcatttcatgcttcatgtctggaaaaaaaaaaaaaaaaaaaaaaaaaagctataatttagttgtgtacgcttgttcagatgatttcaagttggtgcttttgatagtgcaagttccagctgctcaggcctatgagtcctcttgtgaaaaattatgaaatcccagccaagttaactgcagtcgtttgatagatctcatgtatattggtaggaattgctgtacgttgctgtctttagagctaatgttgttttaaaataagaactatttaaaatcattaagaagaaaatctgaggcaaatatttgacattttgtatgcattaaatggctctgtcatttttgaaggtattttgctagactaaatgagatgtgcaaaatgcctgttataatatggatcttttggaatttaaaagcatctacccaatttgaaatgtgtactccatgtaggctatagctcctttaatgctgaaaatatcttccccaattaacttaattaactggaaactgtcactgttggcactgcactggcatagccaaatacttaaaaatgtgaaattattcttgctagaataagaagtggcttgaagggtaaccaggaatgtacttaggggctagttaacagtatcaagcctaagagaaatttacatttacagagaaacatcatttactccatcatcatcatgaacagtggtaactgatgtgagatcaggtgaaggagcacgttatttgcaataggaaacatatattgagtgttcttgtgaagtaagaggcatgaagtacgactacagggaatattgtggggtgcaggcagctgagggtaattctttgctttaaaggatttcatgcagagaaaaatgactctagattctgtgccatgcccaaggaagaagctggatttcatcccagtgcttgttcaaaaaataaatgtaaaacgcacaacacgtctactttgaaagcactaaatagaaaaaatttaaaatataaatttaagtacttgaagtgaaatactcaaaagatttcatgtaccattaaatgaaaataatgtagccctacttatgtctcaatagaatctcaattgtaggagaaataaaattatatgagtaaagaaaatgagatgtgaaataggtagtaaatggtgaatattcattttaaactgtatctttttataaattatttgattataggggattctcttttactttcttcttctatgattactttttgtaatatctataactagaatgccaatgattgctgagtgttaaaagaaattcaaacatatgattaatgtttggagtaaagagtaattaatgcccataagcattttttcaattttaaattttagctaagtacagttcaacaatatttatgtagcatctctaatgtacctgcactacactctaccttcacaaaaatgaatcgagcatagttgtggtgtgtggtgagtgtccagcatactgtggcaccacaaagaaggaaaacagttcaaactgacagtttagaggaaacttcctgcaacagctgccacattaaagatgaaatagatgaataaaaaataaataagttaaatgattaattaaatgacctaaaacgtttaaagcattttgccacacattatttcttttttttttttttcatcggactcttatgggaattccagatgcttcacaggatatttttctcattttgcaaatgagaaaattgatagtaatgcagtgaacactcttgtctaatgttcatataatccagtgtacaactagtgtattaaagagcataactcaaagccaggtaataatcttgctctaagtatattctccctccttcccatcccccatcaatctgcttgttaaactcgataaaagctgtcatgtaataggcagtaagtcagctgcctattgacttgtcatacaggtaagatcttttggtatgatggttttggtgcatatttcctatctgtggagactgtcactgtttagagtttggcatttaattttcacaagatactgcatagttatctcagagtttataaagtacctttaaaacatggtttatgcagataagttgttattactgtttttcccaggccgatttcttatgtttaatactcagtgtagttgggcagctcattaaagccaactggacaaggtcctatgaaactaggccactaggcagtttccagggtagcaaagtatagttcctttccaatgagtaaagcaataggtgcagatcgtgaaaggaaatatctgggccatgtcctgttcacctctcaggttgcttgctcagctgtaagctttggtgcaatgctatacagattcaacatatattctcgtctatcctttattactccaaactcttatggttactaaggcactcattttataacacaatgggatataaaataaataagaattatttgccagaagtaattcctgccttaaattggacaactcagatgaattctaaatgcttatttttgtgagaaaatagtatttgtccaaataaaaaattaagatttaccatttaattaatgtatattcaatattctaattaatcaatcctcctctttttctatttttgtctccttccaaacaaatttttatatttaatttagcactgagtagtcatacataatatttaattggcagactacctttatttttaaaggcaaatattattcatttaacacattctctttgtttaaatgtcaactactcatctcccagttagttatcttgcttaccttcatcttgaatatttccattttcagatttcttaatcttatgcaacttacttcataaagtcctaattcatgtgttggattaaggagaaaacatgaataaattaatttttgaacataaataatatgtatattattatttttgtcaccacataatgccttctattgattaagttcccaatacctatatttttgtattgaatccaggtccagtttaaaaaactgaactcttttattttcaatagagaaaatacttacatatggaagatattctgtctttatcagctctgcttgatacataattgactaatgttagaaatgttttcaaaggaagaattcctactgcaaatatccatggcttaataaatctggcatgtattgttcatatacagccggttaattggtgtcctgacacatagcttctgcataattccttcaggtgttagttcattgtccagatgatttaatatctttgagtatcattcggtctcatccctactttaaaataactggaattattagatctgctactagatgatgctataggagatatttacatagaataatatatgttactgtatcacaaatttgtgttttaaaaatgtttgtgataactgtagttcaatgtaattgggtgttttttgcaaccctacacattttcactggaatgcccaagggatctatggaacaaagaaaggtcaagaacccctattttaaaattgccaataacaagctaacgttcacacatcacccccaattcattcttatccttaactatttttttaattatgcttaatgcctatggtttccctacagaagagaaacagaaaacaacagtttttttcttaatatgtgaatagaatgtacttctatatttattcagtctttacttccaaatatgctaattactaagcttaataagtaattgcatagttttatctgaatgaattttagggcattaaataattcacacattttaaaatatactggctttaatatttaaatcttgaatacactggttttgattttgtcctatgttaaagatgtcagtattgataatgaactcctgaaagttcaatattgtgattttcaaagtgtgctcatcagctcctataaaccacaaaatacatagattaaagtaatctctggataccacatctataaaacatggtcttgtggtcttattagcaaagtgctagacaaagtagcgatatgaagtttctttcgactctgagaacaggtattatattctatataatgccaacatatatgtatgtataataaggatgaatatttatatttattcttaatatatcacttttagtatgatacatatttttacacaaacaaattgaaattgaatttgaagtcttccagtggaacgtacctaacatattcaaataaagtaaaatctcaagtcctggtaagtgtttcttcatccccatcaccaactccattactggtatttggtattaggtacatatccactcctcttctggcttctggctctgggacatacccagctggcataattggtagtgtggagaagggagacaaatagtcttcctacaaaccagaagaggttcttaagaggcattccacctttccaaccactgtgacattgagatggcttacagtaatctcatgctcagttaaaaatgacaaaaatatttctcaacactaaaatgattctcaaagccttctcatttcttgtatatacaaagactcagagacttgcatacacagataaatttatcatctcttacagaatcttctcaactgatattcttgctttttgatttctatcagaaacaaccatttcccttgctattattgattagttataaaatgccatcctttcaccatatagtccagatactattaataacttcttgttggctccaggacaaattcaacattagtagcatagttatcaaatccttggtagtaatgactatgaagagcaccaataaatagcatgcttcttccctatacaggttctaaaaaattaaaatatctgaaaaggtcttaataaaatgtgacttttattaatgataaagatgaagttggaagatacagcttattaagagggcaaaattgccctgttaattgaatcagagaatcaggcagatttagccaatatgacacagggtatttttgtcctttgggagaaaaaattccacatcatcaaaataaactagtaagtgaataagaaaataagtaagtaagtaagtaaataaataaatattttaaagccttaaaagacataacatcacattctgaatttactgccaattttaagaagtctttatttttatagaggatttgccataaatacatacaatttttcctttaaattaatgctaaactattgtttcaatgaagtgttatcgagtgcttactatgttcaaagcattagcctaggttttaatggagaaacaaagaccaggaacatctctgtcctcgcttaattcataatctagtgggtaagatgaacacataaataaaacccacaataacccaaaacctcttgaattatgctaaatatcagaaatgctattacaggttaatgatgtgctacaccaataggtgggaagaaaagttaattttctgttcagcaacagatcctgcttaaaagaaatatgttaaaataaattataattaagatgaagcctgtttctgtacttatcttgataaacctaacataaagataatatacactgtttattaaaacaaacaaaattattaaaacatatctccagaaatattttgcaacttaaaactttggtaatgatttaattatgacacttcatccgataatgcagtactcataatttttattaaatatacatgatccaataaccattagactctgaaagctcctttgaaactagaccttggctcagaaaaaaaaatacatattaggaatttaacaaaatgttttctgaaaaataacttttcacttctccttaagaaacgtccattactagaatgtgaaagacaaaacaaatattttcattttacagcataagaaagagcaataaccccagtaaattttttcatttccctcagtttcttcattagcagtttctttaccatgtgtaatttaaaaataggaaggtaacctaaggataacaactaatttaatcctgcatttttaaagctgagaaatctggtgctcagagggagtcacagctagtcagtggcagactggagacgtgaccaaactctggagtctcccttgagttcccttcctaggaggcagtggtgctctagggctcagtgtgtttctctgcttgtctttcttttttttttttttttgtcagcagttttaaatttgaatcttaatgtatctggaatgtggtcaaacattattaaatattttgaacggcactgacctgccattaccatatgatgatgttaccagctgagtgataattcagatttggcacatggttatgaggttaacatctcaagatacgacatgtaaactaaggtgtgttttatcccctgattatctccctcctccttctattataaaaccttttgaatggattatttttttttcttcgtactcttttcttaccttttaagttgactttattcaacttctagaacttgtttaagccctcttatttttcaatgaaaatggttttgtttacttatttttagtattattttatatttgggggtacatgtgcatgtttattacatggatatattatgtaatggtgagatttgagcttctagtgtacccatctacaatagtgagcattgtacccaataggtaatttttcaacccttataggtacttttcagtacctattatttctgtctttatgtttatgtgtacccattgtttagcttcacttataggtgagatcatgtggtatttgattttgcgtttgagatattccacttaggataatgactttcatttccatccatgttgctgcaaaggacatgattttcttttttatttctgtgtagtgttccatggggtatatataccacattttcttcatccagtaatcccttgaaggacaggttgattccatgactttggtgttgtgagtagcgctgtgataaacaaattagtgcaggtgtctttatgtatataatgattttttttttcctttgggtagatacacagtagtggagttgctgagtcaaatggaagttctctttttagttctttgagaaatctccatgccgtttcccatagaggttatgccaatttacattcccacctacaatgaaaagtatcccattttctctgcattcataccaacatctgttgctttttgactttttaataatagctgttctgactggtgtaatatgtattttattgtggttttaatttgcatttgtctaacaattagtgatgttgagcattttctcatttttattggctgcttgcatgtcttactttgagaaatgttggtttatgttctttgcctacttgttaacgggattatttgttttttcttgttgagttattttagttgcttggaaattctggatattactctttagtcagaggcataatttgcaaatattttctcctattctgtagattgtcagtttactctgctgattatttcttttgctgtgcagaagcattttagtttacttaagtcccatctgtctatttctgcttttgttgcttgtgctatcaaggtcttcatcgtaaattatttacctagtccaacacccagaagagtttttcctaggctttcttctaagatttttagtttcaggtcttaccattaagcccttaatccatcttggttaatttttgtgtatggtgagtaacaggggtcaacttttgttcttctgcatatggctagccaattttcccagcaccggtcaggcacggaggctcatacctgtaataccagcactttgggaagccaaagcaagaggattgcttgagcccaaaagttcaagaccagctcaggaaacacagtgaaaccctctctctacaaaaaattttaagaaattaggcaagcatgatgattcatgcctgtggtcccagctgcaaggggagctgagactagagaatcacttgagcctggtaggttgaggctgcagtgagctgtgttttccactgcactccagcctgggcaacagagtgagaccttcaaaaaaattccagcaccattaattgagaagggagtttttgccccattgtttatttttgttgactttgttgaagagcagttagctatagttatgtggctttatttctgggttctttattccatttcattgatctctgtctctttttgtaccaataccatgcagttttggtaactatagccttgaaatataattttaactcaaggaattatatgcctctagcttttttcttttttcttaaaatttctttggccatttgggcacatttttggttccatatgaattttaggattgttttcccaacttctgtgaaaaatggcattggtaattggatatgaatttaattgaatctgtagatttctttgggcagtgtggtcattttaatattgattcttgaaatctttgaggatgggatgtttatccatttgtttatatcatctatgatttctttcagcagtacttcgtagttctccttgtagagattattcacttccttggttaaatatattcctaggtattttattttattgtcagctattgtaaatgagattgagttttgaatttggttggtagcttgaatgttattagtgtacagaaatgctgctgatttttgtatgttgattttgtaccctgaaactttactgtagtcgtttatctagtcaggagtcctttggaggagtcttttgggtttctaggtataagttcatgttgtaagtgaagagagataatttcacttgccgttttccaatatgaatgccttttatttctttctcttacctgattgctctggttaggaattccagtactgtgttgaataggagaggtgaaagtgggcctttttgtctctttccagttcgtagggggaaagttttcaacctttccccattcggtctgatactggctgtgggtttgtgatacatggctgctaatattttgaggtattttctttccatgcctagtttgttgagagtttttatttatgagaggatgttggagtttatcaagtgattttttttatatctattgaggtggttgtatggtttttgtttctaatcttatttatgttgtgaatcacgttcattgatttgtgtatgctgaaccacccttgcatcgtgcagtagaagcaaattgatcaggatgaattatcttttccatgtgttgttagattctgtttgctagtattttggtgaggatttttgcatctgtgtttatcagggatatttttgttgttgttgttgttgttgttgtatccttccctgattttggcatcatggtgatactggatttgcagactgagttaggaaggaatgtttcctcctcaatttttttggaatagtttcagtaagattggtacccgttctttttggttgtaataattttattacaagttcaattttaatgctcattcttgctctttttaaggtttctattccttctttattctatctaggaaggcggtatgtttataagaatgtatccatttctttaagttttctagtttgtgcacatggaaatgttcatagtagtctttcatgatgttttgtatttccgtggtatcaactgcactgttatttttgtcatttttgattgcgcttatttgaattttgtctcttttatctgtagttaatctagcttgtagtctattgattttgcttatcctttcaaaaattaactttcaatttcattaatcttagtatcatttctttattctcaatcttatttaattttgatctgatctttgttactccttgtcttttcttagcttggttttggtttgttcttgttttctgttttcttgaggtgtgacattaaattattaatttgatatctttctttttggtgtagacatttaatgctgtaaattcttagtattgcttttgctgtatcccagaggttttgatatgttgtttctctatttttactcatttcaaaagatgttttgatatccactttaatttccttgttcacccaaaagtaattcaggagcaagttgtttaggttctgtgtacttttttgaattttaagagttcctcttggtgttgatttctcattttagttcaccctgcttcaataaggtacttgatatgattttgattttttaaaatttaccaagacttgctttattgccaggtatatggtcaattttgaaaactgttacacagatgacaaaaatgtttattctgcagttttggggtagaatgctttataaatgtccattaattagttccatttggtctaaagtgcagtttaaatccagaatttctttgttgattttctatctctctatgataatctatctggatatcccccttctacaaccacagctagtgctctcttgaaagcaccaccgcctggctggaggtcaaccaactcaatccattatagcaactcagaagagaacaaccctgctccaaagaaggagaaaacaatagctaattccactgccagtaacaccctggctaaccagaggtcctgagtctgactacgtgacaactttagtgctagcataattagcatttaagaaaaccagtgcactaaacatgaggacacaaaggcatgagaatagtataatggactctggagacttgggtaaaatcgtgggagtggggtgagggataaaatgctacccactgggtgcagtgtacactgtctggtgatgggtgcaccaaaatctcagaaatcaccactaaagaacttatccaaacatcgtaaccaaacatgacgtgttccccaaagaactattaaaattaaaaaagactaaatattgatttaacaaaaaaaaatccagtgagattagtgaagtgttgaaatctccccctaatattgtcttgctgtctcttttcttaagtttcgtaatatttgttttatgaatctgagtgcttgggtatagagtgcgtatgtatctaggatagttaaagcttgttgcattgaatgctttattgttttataatgccagtttagtatttttatactgttgtttgcttaaagtctgttttatctaatataataataggtactgctgtttgctttggttttccatttctgattattgccttgttgatgtttcttttgtatagtattttccaggtgttctctgtctttcttgtatatgatgtctatatctctagcaagatcaagtatttttttttcattattccttcaaatatatttttcaaatttctttttcttattatccctcaggaatgcctgtaagtcataggtttgatcacactacataatcctccaaggctttgttcattaaaaatattttttctctatttttgtatgactggctcatttcaaaagactggtcttcaagttcttaaattatttcttctgccttttctaatctattgtgaaagctttgaactgtattttgaaattcctatagtgaattttccatttacagaaattgttttttaaaaaacatatctgtctcatcctttatattatgaattgattcatttattattttgtgttggttttccactttctcttggatgtcttgtgctttcttatagtccatgttgtcaattctttatcatttcagaatttatattttggttgggatccattgatatacagcttgcatcatcattggagatattgaaacactttgtctttttgtactgctggagttcttgggctgactctatttcatctgaaaaagcagtcacctgtttttgaaattggtattgatttgataggacttttaaatttattattcttttctcccctgtggatatcactgtagggtatgttatatatgagcgtttggcattgtttctaggagctttcagagagccagtgttctgtttgagttccttggttattatcttgtacagtggctttctcaaattctggttgttgtggcaatgtatttggcgtatgaacccactcacctgctgtgggaatgagagtgtggatgtctcacaaagcttctttcatactctagcatgattcccttctgtcatcagattttttattttgtgttcccatttggtctccagttcagttgtaggcaataaagattgggtaaaccaatgatgagtgaaagcaccctccctgacccctgattggagtagagtagtgtgggaagttcatggtgagatgtgctgaggcccaggtgcgggaggagactacaccagcttgggtgcagacggacacatgatccacttctctatcatgctcctgtataagggcttgccatcttccattcacagagacactgtcctttatcttcagggcatgatgcaactgagttccatgggggtggggggatggtggggaggggtgtggcggggaacctatctggcagcagtaaaatggccaggggaagaacctcttcagtcagtccaaaacagatagatttgcagctggtctgccctccgatgcaaggacacttctgctgtgtgtagagagggagaggtgagccttgccctctgtgtgagcacaggcagcggacacacttttaatgaatgtgcagctattgtgaataccactgggaaggttgttttcaagtgcagtcatgccagcctccagagggaaaaaccttggctacatccatagcatggacaggggaagagggggtgaccctccttcacctccttttccaggcagccagtgctgcctatcctctgggacaaaacaatgctcccctcttttgaagacttggactttatctgtgtttcctttgtctcaggaggtgctttggcagcttgccctctcattttccataggaatggcacatgccatacactagatctccaggtatcccacagctctccgggacctactagtccctgtgtttgccaaagtcagagtgtgttctagggtgtgtttgtgggagatttagtgatgcagtaacataaaggctgagattccctggtcaaagcagtggcccagaatgggtacacaaccagtatggcacacactgcctcagttcaggctgcctcagttcaggcttgtgcagagtataaccacacgtgtgcaagcaggccatctggtgctctgcccccaagaagttctcaaactgccacagtgttgcccagacttgtgagggcagaggggctctctgacaatttggtactcagtaggctgttgcagggtgaaggggccaaagaattacttccacctaccctttttgagggactccaggttccttgcggatcagtctgccatattcttgctaccctccttttctgcaccacagatgcttcttgtgggttttccaactggttttggcactctgccctcagctttccagtagggccgtgattgttcacctatgatctcgtatctgatggaggagaacttgtatctgatctctgtagctagtgattttgaataaaaactacttttgaaaatagtcatgtaccacataaggacatttcagtcaagaatgggctgattatatgacactggtcccattagattataataccatagtttttctgaaacttttattatgattagatatgtttatatacataaatgccatttcttacaatatcctacagtattcagtaaagtaacatgcttgtagtaaagtacaggctggtagtctagttgcgacaggttataccatatagccatgatgtgtagtagtctatcccacctagatttatgtaagtacactctatgatgttcctagaatgataaaattgcctaatgacacatttgtcagaatgcatactcattgttaagtgatgcatgactgtatttataataaactttgacaaaaatacaagtttgtttggacaacattagagaatcaagacagtgctatcccttagaatattttgcgttgatagaaatgtcctaagacttatattgtccaatacagtagcccctagccccatgtgaatattgagtacttgaaatgtgcagtgaagagactaaatttttattttatttcaattaatttaaattaaaatagttgtctctgactagtacctaccgtagcagacaacaactggatagcgtatttctgaaaattagctgtggcactcatataatcagtaagtcaaggaagcaaaaaaatgacaaactaagagaaactaaagagacttatgttagtctttgtcactcactcagctctcattctcccctttcagtgctattttgatcattctttgtatattttgggtagatgtcctttgtcagatataggttttgcagttatgtcctcactgtcagtggcttgtctttttattcttttagcatggtatttttgtagtgcagaagtttttaattgtgataaagtgcaacttatttcttatttcatggatcatgcttttgttggtatatttacaaactcataatcaaaccaaaaatcatgatgattttaccttactttttgagaagatttttagttttgcatttttatattttagtttatgatgcattttgaattcatttggtaaaacatgtcagatctttatctaggtttattttcttttgcatatgtatgtccaagttctctagcaccatttgtgaaatgactatcttttttccattgaattcatattacttctttgtaaaaaatctgttgaatatatttacatgagtatatttggggttctatatttctttcttttacctatgtgtctcttctgcctaataccagagtgtgttgattattatagatttatagattattacagatttattatagattattatagatttatagattattatgattattatagaagtcaggtagtgtgagtcttactttttttctttaatgttgtgttcctttttgtgggcctttccatgtaatcatttttaaatttccagatgttttactgtaaattgataatttataattatatatatttatggggtacaatgtgatgttatgcttcataagttcaatgggatacgtaagtcaagctagttaacatattactctggtttggatatctctttcaaacctcatgttgaaatttgatccccagtgttttaggtgaggactaatggaaggtgttttggtcaagaatgcagatctgtcatgaatagattaatgtcttccattagagagtgagtgagttctcactctattagttcccaggacagctggttttttttgttttgttttgttttgtttttccatcttttgattcttctcttaccatgtgacctttgcacatgtctactcccctttgccttcgactttgagtggaagcagcctaaggcatcaccataagctgagcagatggtaacaccatgtatcttgtgcagcatacagaacatgaacctaataaacctcttttctttataaattattcatctttaggtatttctttataacaacatgaaatagattaagacaaatatctgttaactaaaacgcatttgttatgttaaaaaattgaaatagctgggcacagtggctcatgcctgtgatcccagcactttgggaggctgaggtgggcagatcacgaggtcagattgagaccatcctggccaacatggtgaaacctcgtctctattaaaaatacaaaaattagctgggcgtagtggcgcgtgcgtgtagtcccagctacttgggaggctgaggcaagagaatcacttgaacctaggaggtggaggttgcagtgagccgagatcatggaactgcactccagcttggcaacagagtgagactacatcacaaaaaaaaaaaaaaaagaaagaaaagaaatatactctcttatgaatttccaaatatgtaatactctataattaaccatatttatcatgaggtgcaatagatattttttaaaacccacatattccttctgttcatctgagattttctaccctttgaccatcaactccaattccctccacgctccaatttttttttcctgtaaaagcactctgttctctgcctctatgagttttatttctatagattccatatgttagagagaacatgtagtaattgtatatctatgcctggcttattttacttagcataatgttctccaatttcatgtagtcaaaaatgacaaaatttatttccttttaagcatgcatattttgtcattgggtatatataccacatttctttattcatttgtgtgttgttgtacacttgggttgattccatgacttgactattgttaatagtgctgcaacatacatgggggtgccgacattcctttgacaaattcaaatcttttggataaatacacagaagtgggattgcttgatcacttgtaattctattttttggttttttttttctttttttgaggaatctctgtaaagttttccataatagctgtaataatttacattcccaccaagagcgtacaagggttcccttttctccacaaccctgcaacacttgttatcttttaactttttggtagttgccaattctgaaaggtgtgagataatatcttattgtggttttaatttgcatttttcatgattaatgatattgagtattttttatatttctgtttgctatttttatttcttttttgtgagatgtcaattcaactttcttgcccatttttttgtttttgtgctgttgagttctttcaatttcttacatattttagatattaaatccttctcagatgtgtgccttgcacaaattaacagtgtgattttcacactgttaattgtcttctatgctgttcagtagcttttaaatgtgatgtaatcctatttgtctatttttatttggttgcctgtgcttttggggtcaaatccaagaaaaataattggccagctctttcttatgtaattattccgtgatttttttttcttcttttagttgaacaatttctggtcttatgtttaaatcttctatccattttagggtatgagttttgtatacagtattaggtaaggatccaatttcatttttctgcatgtggatattcagcttttccaacactatttattgaagaaacagtttctttccattgagtattcttggcatgtttattgaaaggcaatagatcatacgtgtgtgggttcatttctggtgttttaattatcatagctctgtggtatacagaagtttgtaattatgtagtacaataacttcagctttctttttttaactcatgattaccttggttatttgagggttttattggtttcctatgtaaattaggcttaattgtatttatgtgaaatatgatattagaattttgatagagatcgcattaagtgtttagatcactttgggtagtatgtgcattttaataatattaactcttccaattcatgaacatggaatatgttttcatatatttgtgtcatcaatgtctttcatcaaagtattttaagttttagtatactgatttttcctctccttaattatttcttgatttcttttttagatagtttgttcttagtgtctataaatgctactgatttttgcctgttgaatttgtatcctgtagctttacagtatttacatattatttctaacaatatttttggtggtcatttcctatacgtaagatcatgtcatcagcaaatatcaacaattttacttcttccttttctattcagatgacttttttttttctcttatcttattgctctggcaagggtttagagtactttgtttaatagaggtggtaagagtgagtattattgtcttgttccagatctcagaggaaggacttcaattattcaccattgaatataaatgttagctgtcagcttcttacatatgggcttcactgttgtgttgaaatgcatgtcttctatacctaatttagtgaggttttggtgatgaaagtttgttgaattttgtcaaatgctttttctacatttaatgaaataatcatatggtttttgttctttattctgttaacatatttattgatgtgtgtgggctgaaccatctttgcatcccatggataaatctcacataatcttggtggatgatacttttagtaagttgttgatttggtttacatttgttttgatgattatttttgcatctgtattcttcaagtatattagcctctaatttgtgcacatgtgtgtctgttttgtccttgttctggctttagtagcagacagttcttgcctcttaaaaagagtttggatgtgttcatttcttttcaatttttttggaagagtttgagaaagatagatattgtttcttctttaaatgtttcgtagaattcagcagtgaaggcatcatcaggttttctttgctggatgaactgattcaatctcatttgttattgatatgtttgcattttgtatgtcttcatgattttgtcttttgttgttgttgttgttgttttagtttttatttccaaaggtttgggggagcaggtgtggactagtgagggttctctagagggacagaactaataggatatatatatatatatatatatatatatatatatatatatatatatatatatatatatagagagagagagagagagagagagagagagagagagagagacagagagagagagagagagagagacagagagagagaggagtttcttaagtattaactcacatggtcacaaggtcccacaataggccgtctgcaagctgaggaagaaggagagccagtctgagtctcaaaattgaaaaactaggagtccgatgttcgagggcagaaagcatcgagcacaggagaaatatgtaggctgagagactaagccagtctagtcttttgacatttttctgctgattttatattctagctggcagctgataagatggtgcccaccctgattaagggtgggtctgccttctccagcccactgactcaaatgttaatctcctttggcaacaacctcacagacacacccaggatcaatactttgcatccttcaatccaatcaagtagacactcagtattaaccatcacaagtccacgccttctcaacgtgaactcatacacatctcctgaggttatacataatcttcaaataaagacaagagtaaggtcataattactcctaacataataccttgtacatccagaaatgcatcaatccggaacccaaatactattacataaagttagcaatacttaaatactgatataaagtcaataaatcttatgtcacatgataaaggagaaagaaaatgaaatgaagatattttcgtagtacaagtatacacaaacatgtttttaacaaaagaaggaggaaatactcatgacaattccagtccttgtttcttcagctggtcatgtgttcgtaggtggtattgatgactaccttctcctactacccattctgtattctatttgccttcagcaagtacctcagcaggtcatggtttttttcctggtggagtgacccaaactttcattcttgaagggtctgggacatttgtagtcctgcctggattgggctgttgtagtttcccattgaccttaatcacagggcatggtaatattaagagacaccctgatagatctcctatatatcatgcatattcttccttacctctgttgtagagtagtaaactgatttcatcttgatagtccgggtcaatcaccccagccaacactgtaactcccttcttggcctgttgacctaaaggtaggaggagcccaaagtgtccaggtgccaatgttaacttctagtttaatggaatcattgtgcttcctggtggcagcattcctccctctggaactaagacctctaggccagcaaaacgtaaggtcacgggagcaggaagcaaaaattttgctagtagatcactagaggtgatggtcagtggtcccacttccacttccaccccttgattcctggaccgatgaatcctggctttgggagaaagagcaccatatattggacgctgattcagagtatacacagccttctggagaactttgcctcagccctgcaaagtattgtcacctagttggcattgtaattgtgacttcaaaaggccattccactgttctataaatccaggtgcttcaggatgatgggaaacatggtaagaccagtgaattccttgagcatgagcccactgccacaattttttaggcataaagtgagtgccttggtcagaggcattgctgtgtggaataccatgatggtggataaggcattccatgtgtccagggatggtagccttggcagaagcattgcatgcaggataggcaaacccatatctggagtaagcatctattctagtgaggacaaacctctgccctttccatgatggaagaggtccaatataatcaacccaccaccaggtagctggctgatcaccccaagtaatggtgccatatggaaatctcagtgttggtctctgctgctggcaaattaggcactcagcagtcactgtagctaggtcagccttggtgagtggaagtccatgttgctgtgctgagcccacgtataacctcagtacctgccaccatggccactttgttcatgggcccattgggcgataacaggaatggctggggaaagaggctgagtggtgtccacagaacgggtcatcctattgacttgattattaaaatcctcctctgctgaggtcacccattggtgagcactcacatagcatacaaatatcttaacagtttttgatcacttggagaggtccatccacatccctcttccccaaatttctttgtcaccaattttcctatcatgcttcttccatgtccttgaccatccagccaaatcattaatgacagcccatgaatcagcatataattgtacatctggccatttatctttccatgctaagtgcataatcaggtgcactgcttgaagttctgcccactgggaagatttcccttcaccactgtccttcaggaatatcctagaaagaggctgtagtgttgcagctgttcactttcaggtggtgcctgcatatcgtgcagaaccatctgtgaagcatgtcctagttttctctttctctgtcaactgatcttagggaacttcccataaggccactggtgcaggcttggggagagaaggcagggtggccggagtacagaccatgggcatttgagccacttcctcatgtaacttccttgtgccttcaggacctgttcaagcctgatcacatatataccacttctatttaatgatggaatgctgctgcacacaacccactttatggctagatgggtcagaaagcacccagttcatgataggcagtacaggtggcatggtgccttgatgacccgtaggcaaacattcagtttccaccaaagcccagtaacaggtctagagctgtctctcaaaaggagaatagttatctgcagaagatggcatggccttgctctaaaatcctagaggactctgctctgatccacctatgggggcctgcaaaggctccagtaagcctccctatctgccactgacacctcaagcaccatgggatctgctggatgatatggcccaagtggcagagcagcttgcacagcagcctagatctgttgcggagccttctccgcctggattccactccaaactggcagcctttcgggtcacttgataaatggcccagagtaacaaagccaaatgacgaatgtgttgcctccaaaatacaaatagacccactgggcgttgtgcctctttcttgcttgtaggaggggccaaatgcagcaacttatctttcaccttaggaggaatatctcaacaggccccacaccactggacccctagaaattactgaggtagaaggtccctgaaattcagttggatttatttcccatcctctggcactcaaatgtctcaccaataagtctagtgtgtttgctgcttcttgctcactggatccaatcagcataatgtcatcaatgtaatggacaagtgtgatatcttgcagaagtgaagtgatcatggtctctctcaataagattatgacacaaagccagagagttgatatacccctgaggtaggacagtaaaggtgcattgctggccttgccagctgaaggccaattgcttctggtgggccttatggacaggaatggagaagaatgcatttgccaaatcagtgtctacataccaggtaccaggagatgtgttaatttgctcaagcaataaaaccacatctggtacaacagctgcaattggagtcaccacctggcttagcttatgataatccactgtcattctccaagagccgtctgtcttctgcacaggccaaataggagagttgaacggggatgtggtgggaatcaccactcctgcatcttttaagtccttgatggtggcactaatctccaccatccctccagagatgcaatattgttttttatttaccatttttctaggtagaggcagctctaatagcttccattttgcctttcccaccataatatccctcactctaccagttagggggccaatgtgggggttctgccagctgctaaatatgtccatgccaattatgcattctggcactggggaaatgaccacaggatgaattcagggacccactggacccactgcaagtcagatctgagctaaaactccattaattacctgatctccacaagtttctactttaaatggaggcccacaatgacgttttgtgtcctctggaatcaatgtcagctcagagccagtgtccagtagtccctgaaatgcctatcatttctctttcaccagaagtctccttggggaaggatggaagaaatattaacagcataaattgtcagtagtgtagtggggtccttccttaaggggaccgggactccccttcattcaaggggtactgggtctgtaaactggatcaagtctggaaattgattgaggggccatgtttctctgtttttataatccaaattggtcttttgtccatttgacctagaagttttctgcttatgtaaattaaggaggaatgcaataggcttcctattaattttaattctaggaacactgtgattaattagctaatgcccaaactctacacaagtcagagtatttttaatgctgctttgcctctgctgtttattacagtagctatgctcaccttgattttgatggttcagtgccaccacttggcttctgctgcctgggatccaattattcccactgtatttaaattttgtagttgagtgactgtggttcccaccgttagatctgacatatggagaagagcaattacagggttttttaaagatgcagatgctgccctcataaacttatttcacaaggcattggtcaagggtatgtcttctagacactcccagccgggatgagtatgtctaaagtgactaacccacttcatcatcccaatctccctaagtcttgggatctcttcctctacattaaaccaagggagatcagacattttcagctcactcagtgtgggacatattttaatccatattttagctaactaagcaaataaactattaggattttttatttttatctatttttattattattgttattattattatactttaagttttagggtacatgtgcacaatgtgcaggtttgttacatatgtatacatgtgccatgatggtgtgctgcacccattaactaactcatcatttatctatttatttttttttgagatagagtctccctctgacacccaggctagagtgcagtggcacaatcccagctcactgcaacttctgcctcccaggtttaagtgattctcctacctcagccccctgagtagctgggattacaggcacccaccatgacacatggctactttttgtatttttagtagagatgatgttttcccatatcggttagtctggtcttgaactcctgacctcaggtgatctgcccgtctcagcctcccaaagtgctgggattacaggtgtgagccaccatgcccggcctattagaatttatttttaacttcccgatctgcaacattaaatgcagagtccctacttagtgggcccaaatcaatcagttcagcctgatccaactcaatgttccatccatcattatctcacacccttaatattcattcccatgcttgttatccagatttctgcttatatatattagaaaactcaagcagttgttttcaagtgtagcatacctcctcatgggtcacactctgaaccttacctctaggagcccgctgggactctattctagttataggtctagaggcaaacaggtattagggttggcttgtgaagataatcaacattatcttgcctggcaactgcctcaggggaggccatgactgttgcctcaggcagaacagggtttatttccttagacaaaggtagaaaggctgatggcagcatgggtcggggaggggatgttgccactactagggatggggaagctgtttcttttggcaaaaaaggtgcatcagtgtttacaaagtcagcgttcccagcttcatcagggtcctcccacacatcctcattccaagttttagggtgccattcttttccaatcaatgccctcactttaacagtagaaacctggtgaggctgtgcatgcacctttcactgcaggtcagccacttgcatgataagagctcgtgtcctgttttccacaatttcagctctttctctataggaggtaagactctcactcagggcaatctaagcagatttgaggcttagtgtctgcttctgaaacagggagttgcaatccctgagttcataattttctttcatcactttgtccactgaactaggagcaaccaaccagcttcattgttttttggttctctacatacagtcaaagatattatgtgcagagtcactaaactccttgcctcacatgagctgtgaatctggaatgtcaaatgcatttagtttgtataactctccaaacagtttacaccaaggactatcagtgttctccatactattagaagtagagtccttagcattttggggtttaatcatattaagcagtcaacttcagaaacccccgaaccaatgaaagaacaccatccttaatattctgtttctctagaaccactcctggtaccaaaatctgtattagtcagtgttctctagaggaaaagaactaataagatagttagatagatataaaggggagtttattacgtattcactcacacactcgcaatgtcccacagtaggccagctgcaagctgaggagcaaggagagcctatccaagtcccaaaactgaagaactcagagtccgatgttcaagggcaggaagcatccagcatgggagaaaaatgtaagctgggaggctaggccagtttattcttttcacatttttctgcctgctttatattctagccacactggcaactgattagatggcacccaccgagattaagtttggttcacctttcccagcccactgactcaaatgttaatctcctttggcaacaccctcacagacacactcagcatcaatactttgcatccttcaatccaatcaagttgacactcagtcaacacttaatcatcacaaggtggtatttggttacatgaataagttatttagtggtgatttgtgagattttggtgcacccatctctggagcagtatacgctgaacccaatttgtagtcttttttccctcaccctcctctcaccctttaccctgcatctccaaagttcattgtatcattcttatgcctttgcatcttcatagcttagctccaacatatgagtgagaacatatgatatttggttttccattcccgagctacttcactcagaataagtctccagtttcatttaggttgctgcaaatgccgttaatttgttcctttttatgactgagtagtattccatcataaatagacacattgaccaatggaacagaatagagaacccagaaataaacccaaatatttacagccaactgatcctggacaaagcaaataaaaacataaagtgggggaaaggactccctgttcaaaaaatggtgctgggatcaatggcaagccacatgtaagagaaagaaactggatcattgtctgtcaccttatatgaaataaactcaaaatggatcaaggacttaaatctaagacctgaaactataatgtcttcatttaatcttctgaaatttgctgaggcttgttttgtttcataacatatgatttattttggggaatgttccctgcagtctttagaagaatttgtattctgttgttatctgttggttggaagattctatacatgtctgttagatccattttgtctacaatgttttttgaaccaattactcccttattaattttctgtttataagtagagtattgaaagtagggcattgaagtcccaccttgttatttaattgtgatctatctctcttttcagttcttttaatgtttgttgaatatatatttagcttttccaattttgggtgcggtgcatatatatttacaactgatataactttttgatgaattgacctcttatcattatattatgtccctctttgtcttttttttttttttacaattttttacttaaagtctattttttttttaagtataactatgctgtctatcttttgagattcacttgtgtggaatatcttttatattccttcactttcagttatgtgtgccctttatagtgaagtcaatctctttttagtaacaggtaggtattttttttaatccattcagtaactctatttctttttgttgagaaatgtaataaatttacattccaggtaattactgacgagtaaggacttactactgtcactttgttttctgattgttttgtaggttttttttttctttctctcttgcagtctttctttgtggttccatggttttctgtagtggttcatgctttaaatcatgtgtgtaattcctgctttgaatgcaggcattcatgctttgaattcattctactttttttgtttgtgctctactaaagatttttgcttttttattaccatgttgtttactagaacatcctgtacttattgcattctatttcagtctgataagaacttaaattttattgtatacaacaactctggactgttactcctcccttcacagtttatgtttttgatgccagaattggtaacatttttattatgtatcccttgataatttattttcgctatagttgttgttttgcattttaatgcccatactaggaataaaattgcattacacaccttacacacacatcattaaaatcctagagtactctgaaaatgttgttttacttataccattaggttttgtgcttttgtatgttattgttgcaatttaaatattaataactcccattaagattcctgtaaggcaggtctagtgatgttatactcccttagcttttgtttgtctacaaaagttcttatttccccatgactctgaaaagacagttttactggataaagtattcctcattcgcagttttcttttttcttcagcactttgaatatattattcaaatttctcttggcctgtagggtttcttctaagaaatatgttgacagttctattgccattcatttgtgtgaaatgtttgtcttgtttcttgctactctcagaatagtttctttgcttttgatagtttgattattatgtatcttgttgtagtcctctctgggttgaatttgactgagctctgtgcttcccctacctgggagtttacatctatccttagattagggaagtcttcaaccattatttctctaaatatgatttctggctgctcttctctttcttctcctcctgcaactcttattatgcaaagacttgttctagtgaaggtgtctgaatttttaagaggctttctttattcttttttattcttttgtctttttgctcctctgactggattatttcaaattgtctgttttccactcactgatcctttgatttgtttgttctattccgctgtttgagctttctgttgagtttttcagttctggtgtattttttatctctaggattcctatctgattcttttttattgattctatttctttgtcaaactaatcatttttgtgtattgttttccaaactttattacgtttttcatccatatatccttgtactttactgagctttttaaatgagcattattgtgacttctttttcagtcatttcaatgatatttatttcttttggatttactattgtagctttattgtacatttggagatgttatgactccctaattcctcataattcttgtttccttgcattgttgtctgtacatttgtggagacttccctctcttttgtttttaaggttttttgtttgtttgtttgtttttttgtcagggatagatcttaactatttaatatagcctgtgattctggaatggcactctggtaataaccctggcctggtagagcttgctgtcggttttccagttggcttggctgctactttagctgtgatgtcaggtggagcttctggttgggctctactatcaggcatagcttctgtctcaggactgcagtgtcctctggtcaggctggtcacagcatatattacctggctgggcaattctgctctttgcaatctgcagttgggcagggctgcaggctgggctttgagttaggtgcagctgctacttggagggacaaataggaccagagtctatgctcattagaactggaagactgagaatagttttcctgttaggttgaagccatggggtgagcttttggctaagttgagtggctgtttgactttccaggtcaaaccagtgtagcccctttatttctctggaatgtatggaggtagaagtctccctggctcagcaaggtcattgggtgggcttttgtgctgagtggagctactgcataacttcccaggtcaaatcagtttagcctttgtgctttttgtaaaatatacagaggtgggagtcttcctgtcttggtcaatccaagggcatggacactagctgcctagggacccaaggtaagttaaacttcccaccatatttttgaaggcaactaggtcagttttttaagtgcactgagaagttgacttgtaactctaatctggtgccacaactggcaggaaaacagagcaaccaccaagattcatgcgctagtcactatgacctgcacttccttcctttgtttctgtctgagtctgagtattcttgccattctgttttccctagtgttctccatgaggtgaatttagcatggacttcctggaaagaatgttggaattctagggaagctggatgactgcctgtcattttcttcttcctttgtagaaactgtgggtcaggaaaatcctctctgtctggtattgtgccgacttggggaagggaataaagtggtttagttgaactaagaccattcttcttacccttctaagtcagatttaattctgttctatggaacatatggatgtttcagacatatttccaagtattggaattttcagaaggttattgtggtctgtggaaagttgctaggtgaactttctgttgggggtggggaagtggaacttgagactttctattttgctatcttgctgatgccactatttatttagtcttttgtatcagtattaatgtatatacaatagcgtactgacattttgattggaattgtgttgaatttatagatcaagttgggagtaatttattccacagtgttgtcttctaatccatgaaaacactatttctaaatttatttggatgtttgatttgttttatctgaattttgtagtctaacatatatagattttatacatattatgtaacatttacacctaaatgtttaattttttggtgctattgtaaatttaattgttaaatattaagagtacatttactaaatgtttattgccatattttgagttttgtgtattgtgactttgctatagtcacaatactatagcaccaaatacacaatactatagcactatttgctatagtcatttattggtttcgggaattttttttttctattgtagatacattgtgattttcttcatagacaatatgtcatgtgcaagtaatgacaattttatttctttctttccaatccattaaactgatctttctctttcttgccttattggtctgagatccagtacaatgttgactagaagtggtaggagaggaattccttgccttgattccaatcttgtggaggaaaccttctagtcttttaatgttcattttgttggtttaggtttttgtaaacatttttattcaagtcgaggaatttctacaatagtaattcttgatttctattgtctgaaagattttatggtgaattgctgttggatttcgaaattttatgcattagttaataagttaatatgtgaatttttttggcctgcttatgtggtggatttcattcatgtttcaaatgttgaatcggccatacatacctagattaaatgtgtgctacatgtttatttattatattttttttgtgatggatagattgaaataatcttttttattataaataaatttaagtaatctaggataaaaaatagcttcaatttttattcaaattgggtttagattgctgttttagtaccattttgtcaaggatttctgtgtctatcttcataagaggtattggtccataatttttctttttgtactattttttctggtttggtattaaggtaatgctggcatcataaaatattttaggaagtatttcctctgcttcttctttctggaaaaattgtgaggaattggtattcttttttcttaactatttggtagaattcaccaatgaaactactgggcctggtgctttctttgttggaagtataattattgattcaacttctacaacaggtataggattattcaggttatgtatttatccttgtgtattttggtagttttgtgtgttttgatagttttgtgtgttttgatagtttgtgtatttcaagaagtttttttcattgtaactaagttataaacttgatagatgtagccttgttcatactatttctttattgtccttttgatgtttataacatcagtagaactaatgattttctcaaactacagatctaagtagtgcaagaaacactaacaggataaatactaaaagtgtacatttagtcacttcgtattcaaactgtggaaaactaaagacaaattgaaaatcttgaaggcatccaggggtggggggtaaatgaaaaggtacctcacctctacaggaacatggataagaaatacagcaactttctcaatgctaactatgtgaacaagaagagaatggaatggattattgaagtatagaaggaaaaatgaataatttcatatctaataaaattatctttcaaaactgaagaataaacatttttaaacaaaaagctgaaggaaattttttctagcagacttgtccataagaaattttgtaatctatagaaacttctgagatcaaggaacttggaaatgggactatggtgaacagaaacacagagatgcataggtatgctaccatgatgtcagcattgagaaagtatttttttgttcatgtggacatagtgtgtatttctataaagttatatctaaaactgttcaagtaatgtttccttgttgatgctactattatggttcagtctagggtgaccctcaaatatttgcaggatggggatcaagatgacaaaatagacactcctattatttgtctaaatatttcctatttataaaatcaatagaaaattattaaatatatattagacccttttaaaaaggcacactgaataacatggctacacactcaataacatggctaaaattagaatgaatgataatatcttgccctgtgaaaggtgtgtggagcagctggaactctgacacatttctagtgaaaaagtgccttagagaacggtttgtcatttcttataaagttaagaaatgtactaccatttaatccagaaaatgactattgatactctcaaaatatagatgactcttaaaaaacactatgctgagggaagggaatcaggcacaaaaggctgtataattctatgtgtacaaatgcgagaagaaaaaaatataacttatagtgacaaaaggcatatatcagcaggtctgagaatttgcgtgggcttcacacagaaggagcacaaggattcctttagagtacaatgcatattttctacattttaattggagcagtgtttacatgggtatatacatttgtctaaactcattgaactgcaaacaaaaaatattttttattttattgcatttgaataatactttaaataaaggtagtttgaaaaaatgtttcttaactaagagggccaagaattagcattaaattagtgacagatctgggttttatattttcccctacattgcttgaaggtgcacataaatagaatctacatcattatattttaaaagagatttaatcattcagatgagaccaatctggtttccatggatgataaggaagctgtatatctgttatacagatgtgattaaaaaaagaagttaaaaagagagagatatgtccttaggtttctagccaaaaggaatatgttcatagtctttgaacaatggattcagaatttgaatcgagtatatttcctattttatattaaattactctgatgtagcaatgtttgctgttttatattttgttatagatctgcgtacaacaaataatattgcaaataaagccagtattaagtggacttcatttcctacagaaataattatagttattaaaaaatgacttcttttcattagatgagatattttgattttttgatgcctagaccacctgttttctattctaaccaagaaaagtcatggaattagaaagtagtaaaatatatacactattcttgtaatattacatacctctcacttgtagggaaagtttaattaattttaatagatatggattctatgatttaatatgaaaaataatcagtttggtattagagacattttaaatcaatgaccatgaggttaagttaaatcgattaagaatatattgtgctctgaaaattcttcaatgaaatgtgatgcccttaaattaattttaaatgtataccatagttttgattagatgagattctgaattgagttttagattgctgtagaacaaataatgaaagtaactacatcaaaaggaatactacataagcctttctggagagattttgaacatttagtggtaaatattaataacaaactctgagggtaggctgcctgggtttcattagaatgtcacttagtaactgggaaagcttggaagatgagtgagcacaaggggctttctcttttatcacactgagatgattataaataatgcccatcccatagacttgttatgtagcttaaatgagttaatatatggaacattttagaacagtgcctagcacatgagcacagcataagtgttacctctttcgttattgtatatgttggatgggaacacaactggtcattgaaattttctagtggtactagcgagaaaggatatcagagaagaaaatgaaaacttttggtaggtgaggtagagctatggaatatgttaatatttaggctaagatgcaagaaataaaggtaaaggttttgtcagttttcttactagcatactccaagaatcacaaatagaggcaggcaaatagtagtcaacaaatacttgttgaattgaattgatctttcccaaaacttaatgttcagttatatctgaatagttataattaaatgtgtaatttacataaaaatagaacttggaactatttactgaaaggctactgcaaacttaaaaggaaattatgaattagataatctgcatgtacaaaaacgcaaaaaagtggagcaaagaggaggtgacaataagtcattctcattagatgggaaaaaatagaaagggatggaaaaactctaaggaaaaagattttttgtcaatcttaatgaattaactgttaaacttgacgaagtttggtttcatcttccctgtttcctttttgtaatgtgaatcactaaaagatgaccagtaagaatggaggttggtaaataactacaggaaaactaaattttataactgtgctttggacccccactcatagcttgctttaaagtcccaggaaaaaatctttttataagagtagaatgccttcatttaatgacctcagattctttcttacaaagggtacaatctaccttctgtaatacctcagcctggggatccatgactgtttttcagtgggtgaatatccattcaggagggagcacatgaggtctgttaatagccaaaacaatagtaagttgctactatcatgtggttctgtttagttgggtgtggttactgaagacacaaagccaatttattgcatcactctcccttccctgctctttcatcaatctactttttcccaagaccacataattttacttttggaattatcataaatgattactaaaatcatggagatgaatttgcaagactgaattgcaaggtaaactcaactttattttgtaactaaaggacagctagggtaaaaaaaaaatactggtgccaaacaattctatattcaaaacatgtttgtgcattagaaataaattaatgggccaggcgcggttgctcacgcctgtaatcccagcactttggaaggccgaggcgggcagatcacgaggtcaggggatggagaccatcctggctaacatggtgaaaccccgtctctactaaaaatacaaaaaatcagctgggcgtggtggtgggcgccggtagtcccagccaccagggaggctgaggcaggagaatggcgtgaacccgggaggcggagcttgcagtgagccgagatcgcgccattgcactccagcccggacgacagagcgagactccgtctcaaaaaaacaaaaaaaaaaaacaaaaaaaagaaagaaaagaagaaataaattaaagactggtaaatccacaatcttgagattttgtgattttctaattctgtaagatgtatatgtatgtggtttttgaagaatgcaaggtaatgtgggcttaacatgcaatgcatgtaccaatggaggttgacttttttttattcacttgggggtctcccatatgggagtgcatgaaataccacagtacatgggaaaaaagaggccagagtgaagaaatagcgatatgaggcaaaaaaacaatatctgagggacaataatgtttttattatgctgcaatggaataagaacccatatttgatcaataagcaatcttaaaggtcatttctaaaagaatactcagctgcagcttaaaagataatttttaattactatttttacgtctctggactataaaatttaaaaaaaagtttcatattagtttagtgatgcaaggagaaaatattaaccgaaaatttaacaatataatgatatatattagagttttccctccccagtagcatgaataaagagccactaagcataaattgcaatggtacctaatgggtagtattaacccataatataaatagatattaaagctgttttaaaaagtgaccactgatacgtatttctgtagagatcttaactgatttctagacgttggaaggctactgtgccataataaactacttttttcttgcttgaataaattcacactaaacattcctcagaaggttcatagttatcttgaaagtcaaacattattgcagaatcttcagaagtaaattaaaaccacattgattttgtttaaagtagcacaggatttaaactagcagtgtttatgtaaggaaaattaagtacctccataagtagttgtgaagaggtgaagaggaaatatcaaatattataaaacaaaaaaaggagagtcaataaagatattttagaccttctaaaaatataggaagaagtttgggtatgtgtgtgtagatatggatatatatggtcatacatatagtcatatatatatccatatccacacacacacgtgtgtgtgtgtggatatggatatatgtgtatatgtgcatatatgtatatgggtatatatatccatatacacacacagaaacttttagatttgcatatatttctgcatacatatgcagaaatataaacctgcattcatatatgtatatacataaacatatgatatgtttattgcatataatcaggtaaaattttaaggattttaagaggaaactataaatagggcaagtttattacttatccttagagcactgtgttatttcatattggtttacaattctataatgtaatcttttctacaaaagtaagtacacacgatatgcccttgaccttatgatgtaaccgaaattattttattaaagcaaggcttacataaaaaaggccagggtatgtttgacaatgttctatataggtctgatgagttgtgagaaagagtatgttcatttaaaggtgtacctactggtaatttagctttgtgttgatgtttataacagcaattaagttttggaactagcatatttctttggcatactcagtaaacacttattaaataagtgttgacttattgttttgaattttttagttcctagaatatttaaatacttgaaaaaggatcaggaatagtatatgaccaatttcttaatttttaatggcatgcttgcattatttagttagcacattcaatttaattattttgattattaaagtaggttttccttcttatggtgtattattagtatcctggttctttttattagtattaactaacagaaaatgtccagaggcaatgaaaaacgcaaaacccagtgtaaattaataatgaacagcaagatttataatgattgtgagtaaatacaaagatcagcagctggtttatacagatggtcaataaaatgttggaatgtccaaaacataaacataaggggtgatggtaggaggcgggtagtgattagatatgtgatcactgaggttaactgttagttttggtagaacatggagcttttttttcttccactagaaatttccttcatgaaaaaaattatcaaaatgctccaattcaaattacaatgcctcttacagcatgtatacctcagtttattttgatagcctgaaatggctgctagagcatctgaaaaatatctgatttaaaaatcaagtaatcatttaggtcataagacatttaggtccattatttgacagctaaattgaataattgatataatttcatatttctgaatttactggtaaaatatgtgggcttcctctcagaattacatctagtcatttggaaatgcaaatcttacaaatatttattagccttattttattgtttttttagcatcacagagatcagtgatattttaaccctacctcaagcaatatattctgattaatatataaaattaaacaatcaaattgtacttttaggattccactatatgtgcctcaccatcctaaactaccttttatggtttttgtatccccgccatcccaattaccacacacaccagagtacacgcatagatacagtaccttagcaaaccatattctatgaaaactgacaaagtgattatcaggaaagaaagcaaagtatgctggtcatttgaactttatccctattttggccctcagaaatgtcatgcagttaattttttcttcttcttgatattgtgccagtaataataatcagtaagaaagtcaaccccatgcccagcatgaataggtgagtactaaaataaaataatacctatataacaatcaatgcaatgtaacagcgaaatgtcttgagacatgtaaaaatgtgtgttatcatcactttacctatagcaattttcaaagtatggggtttgcaacccaggaaatgtggaagatgcttcactgaagtgggaaaaatgaaacacttttattttatttttatatccttatatattatatataatacgtaaagatacacatcatctttatatttatctttatattttaccttttaattttctatttttgagttaaagtgatacctatgttaattcccagcaaacatgattcattacaaattcatactcaaacatttttaattgattaatgaacatggggcctgttgcgagaggactgttaatgtactcctccatgagatctcctgatcatcaactttccaatcatgttctttgcagttcccttaccagctggcgaacctgttagctactgctcatggtttagttcaggttcctacctcaagccatctctcccttcacacagtgctcagtcaaatttcccctctaaatttctgcctgatggaacgatttcctttcactcactgacttgcaggaccatgcatcagtagggttataaagaagcaactgctagcagttgctagcatatcggtgaattcttatttaatctaagcttgcaatttttcttcctttattaactggtcataaggtactccctgtgaaattatagttgtggttgagagagccaaccttagcaaccccacagagaagaactatggaaataaatgccttgacctcattcatcttctgtctcctaatactccatcattgccttaccaaccaggagtcaaagggaaagggaccctggctggtatggacatagaggtcagcaacccgaagcagagagctggagatggtgcagtcaggcctgtggagccaaataaatagcattcagcacaaccgccctcaacaaagtttcacagtccagcattagatttaattttataaattaaaatactttagagtatttgaggtgatccatttttctcttcacacttagtccagtattattttattgataattcgtaattgcaaattttgtgaaagatatatatattttttacttccaaaaaggacttgttagagcctgctaatacttgcctcatgctttctgtgactaaattaatgtttggagctctgttagatattttatgaaggtttataataaataaaatgttacatccagaaattattttaaaaatatatgtccacttcctaactagatgcatagtcaatgaatgcagtactcttttctttatgacaaaagtgagtatatttttcaaacatgatgaatccagcatgctgctcaaagcttactattttctatctgcggaataactcacaatgaatattggattatgtaaacagcttctgtaaaatggcccttgttttacttgagatgtcctcttccaaagggcttctcaaaacatctggcagccagattggtgcttttgtttccaaagaattcatggttatttcaaaaaaaaattttttttggcaaaatgggaagaatggggaagataaggatatttcctgtataaagctgaaactaaggccattactggagccattgcaagataagggccttttaaatattttttattgaggaagctcattcttaatacagaagaaaataatttcatatttcagcataattttattatcttagtgaacactttaaaagttgggtcaatggtttccaggaaacatttgtgactgtaacatgtgccaaacaacctcttattgtatataagaagcgtatgagcttaatgtgtattagtagaatatattataaggatgattgtgaaaggattggcaaacatttttatagtaatataggagtatgctttttcctaaaaaggaaacaaggaccttgctacttattttttctcagctactaaatattttccttttctgtaaattgtaatgaatttcctgtgaggaacttatatcctagaacaaatcgtattcctttataggtgctcctctgcccgcttctcatcttatgtccattaagaaactgtctcttcatggaactctgatcctttctttttcattccccaacatctactgactccactttgtacctgtcactataaaagccaggttatattcattttcactgaagccagatttttcgttaatacctagctaaaattaccctagtgggtgtattagtcagggttctttagaaggacagcgttaataggatagatgcatatataaaaagggagtttattaaggaatattgattcacgtgatcagaaggtgaagtcccacaataggctgtctgtaagctgaggagcaaggaagccagtccaagtcccaaaacctcaaaagtagggaagccaacagtgcagccttcagtctgtggccaaaggcctgagagcctcttgcaaaccagtgatgtaagtccaagagcccaaaagctgaagagcttggagtaccatgttcgagggcagaaagcatccagtacaggagaaagatgaaggctagaagactcagccagtatagtccttccacatttctctgcctgcttttacctaaccacgctggcagctgattaaattgtgcccacccagattgagggtgggtctgcctttcccagtccacggattcaaaggttaatctcctttggccacaccctcacagacacacccaggaacaataatttgcatccttcatccaaacaaatcaagttgacactcaatattaaccatcatagtaggtaatgtactgatttagaaaatatagataatgcaaatgaaagatgtaaaaggccctttaattaaatgaaccactgctaatcttcattgctgatatatgcatatacttcatttaacttgtttttccaaaaataggcttattttataacattgttttataatcctttttttttacttagtataacatgaacatctcccacatcattaaatattcttctatgcatcattttaatcactgcatagttttcttatatgaatgcaacacaatttatgcagtactgtatataagatatttgtgggggtgatgatatgtacacttataatgggatccatgcacaaacacacatgcatatacaagctactttaatcatgtatgcagggctgggcacagtagctcatgcctgtaattccagcactttgggagactgaggcaggtgggtcacctgaggtcaggagttcaagaccaagctggccaacttggtgaaacatgaaaaaataacatgaaaaaataaaaaaaaaaattagctgggcgtgcttgtgcacacctgtaatcccagctacttgggagactaaggcagaagaattgcttgaaccagggaggcagagcttgcagtgggccaagatcacgccatggcactccagcctgggtgacagggcaagactctgtctcaaaaaaaaaaaaaaaatcatgtatgcaggtaaatctttggacaaatctatatatgttttagaatatatttttaaaaggaatttgtgagtcataagttacaagctatgattcacttgcttgtatagaatagtatgggaaggtgtgatgtgggcatccactgtagtgcctattggctttggcatataaccttccatctaaactaaacggtgaaattatttaaatatcttatttaggaagagattgtgagcaagaaaggcagaataagtgatccatgattgtacagcaaatagctgacaatatttaataagccccagtttgtgttgaggtattgttgagactcctttgtagtagttatacaaaatattatttttattaaaagttactattggggcattgaaataaattaatcatgggctttttaaatttaaatggtgatttgctaaatctctacttatgatctaatttgtgatctaattaaacccattaagtccatagtgtccacacattttcattgtgagttgctatgattaaagatttttgagcttgtattaacacatatcaatttatttataatgtctatacatatagtaatctcaactcaattcatctaactttttttcagtaacataacagaccattttatatatatatatatatatatatatatatatatatatatatatatatatatctgagatggggaaaacccacgttaaaaacctctattctaattacttttttatcagtcttttgataatagaactagattgtctacaaattgccttctactttaaaaaaattattcactgattgaatgcacagtggcaagtactgggatgagccaaaattgatgcacaatgcttcggggagtttcatagactaacggaggaatgaaataattatattaataaaaataacactgacaagtataacaaatagacccaaaattctaatggtttagcaaaataaagttgttgttttgttttgtttttcatgtaaattttgcaatggatatttctcatgagcaaatggctctcttccaagcagtgattcagacatctaggttactgttggtagtgtcgactgctgttttccacacatggcttccaaagttgctacagcaggggaaagtacatggagaaccacacacgggaagtttttatgagcctggcttgaattggcacatatcatttctattctcggttaaggaccacacctaactgcagggcaggctggaaaatgttgcatagctatgtgtccaagaggaacaacaactacattagttcaatagttagaatctgtgtgataacatgcaaaaaatggaattgcaacattatgaaaagtataatggaatgatgtaaaagagctataaaattatgaaagagagttatcttacctgaaagttgaaattggtcttcagagatgaacaaggattatttgagtgatcagaggttgaaggaactttctggcaaaagaaatatacagaaagtcaaagagatgagaaaaggaataattctaatacagcatggttaattttcaattcacccattaaatttccactactttttcagaaggtattttcaggcaaatttacaaagatgtatacataaggaagaatattaattgcattgctgtttataatagatgtgattgaaaccaacataaatattcaaagaaaaagcattggttaaataaatgatggtatatccaaactttggaatattttgcacccattagaaaataagtatggattcacatatttatttggaaaggtttccacaaatgttttttaaatgataaaaattagcatgtacaggctgcgcatggtggctaacgcctgtaatcccgacagtctgggaggcctaggtggaaagatcacctggggtcaggagttcgagacccgcctggccaacatggcaaaacccagtgtctaataaaaatacaaaaattagctggtgacgggcacctgtaattccagctactgaagaggctgaggcacaagaatcgcttgaacccaggaggtggaggttgcagtgagctgagatcgcaccactgcactccagcctgggtaacaaagggagactccgtctcaaaaaacaaacaaacaacaaattggcatgtacaataatgttgaatgaaattataaaattcagcatatatgaatggtcctattttaaatacatatgtatgtttatgtacagattattgctgactgttcattcaagcagtagtttacttgatatttcactgtttttctatagtggcttcctcctttgctttcttccttcctgcctgcctgccttcctgcctaccttcatccttgtaaatgagcatgcattatttttatcataaaaataatatattttgagtaaaaaaaaatgttggtgatcagtgttctcttgtttctgtggataatctctcttagctagctgatgtaaaatgctaccttattgattatctaatagatgacacctttctgagaagtagtagctaatatatgctagacttgatgcagccggggcttgctatttacaactttctacataagaaatgaaaaacaaatcttactgtcagatgtgtcagatttataaaagttgtatatagtttattttcaaagggatgctaaatgaattgctacttgtcatacattaaatagaataaatttagttgtttaatttataggttaactatcatattgatatgtgaagtctatttttgtttctaagagaaatgggccaaagcaagtatatactgaatccccttattttattaagaattaaccctgagccacgtgtgatggtgggttcttgtagtgtcagctactcaaggaggctaaggagggaggatcccttgagcccagaagttcaaggttgtagtgagctgtgaccgtgaaactacacttcagtctaggtgacatagagaaaaccccatctcttttaaaacaatgaaaaaagcaattactcaaataattatccttgataaactagagcctttggactggcaaaagagcatgatctgggtaatggtgagtggagggtaaagtggtttttgtggtggggggtggtggaaaaaccagtatggttttcttatcttctgagtcatctataaacagataattgattgacaagaccaaaagcattgttttagggaaactgatttattggtagcagagtatgaatattcaaatatgagagggactaaaagtcagtgtttctaatttattacaattgtaaaattgaaagtaatgaaagtgaaagatctacaatgccaatgaaaagaaagattttaaaggaaaatatacagaaagtaacaactgagtagatctaagactagaaatacaatttgaaagatttttttgacaagcaaggcatatgggatattattcagattttgattcaatgttatgcttgtaccattattcatcacatattactatgttctctaacagaataaaattattactttaaaatcaatcaacttgaaatgttttttgttgtttgtttttgcttcaagctttttcctagatatagactagttcatttctcttttttcaaagagacactgcccactaataaaggggtaattctgcaaataagaaaatgttcacaatgtaatatacataagcaaataatgcaattgataaatagtgttctttttggtagatttatcagttgttttgtttataatatgatcatcttctttaacactgggaattctaagattaaaataaatgtaaattaaattttttaagtaggttctgtgttagagaaaatgaaaggtataaaatgattctggttttatcatatttctaaaagctttataatgtcattttgagtcaaactaattatttttttaaataatttcactatataattaggaagaaaatagctcatagcataataaattaatctctttttgaagtctacgccagctttggtatttgaacatttcatccatattcaaatcaacaataaaaaaaccacaatgtagatttgcttgccttctgcattacatttgcctattagagtagataaatagcacacatatttagatgacaagtggttttttttttcctctgactatggggaagcatgatattttgtgagtacatgagtctctttgtgtgtgtgctatgtaaaggaaatcaacaggtgagaaaaatgtatagaaactgatatttaaaggtgcttaagaccagtgataagtcacaacacccaactgcttattctttcccatttgttatttatgctatttgaagaattagaaaagtgttttcttctggtaagatgccttcctccaggtaaaagccagaaaaagtaaaaggctcgttccccactataactacttagcattctttttgcttgagcaaagtgaaaaacaccaataggcctgcttatacacaggcaaaacacacacacacacacacacacacattttaaaaatgtcaaatatatattcattagaagctgtaacagaagaatgtatttaactctggggagaagacgcttaacctgatattctttaagttgttacctattctccactaagaaactgagaataattaggagaatgactacatgttgttgcaagtagtcctaggtatacggacactgtttatgaccattttaatttcattgattatgataccaaaacatggcacaattactcctgctaccactgacaaaactataacttacataatgtgaaaataaaactgtcatgcctttgaatatattgcaaatatcaaatacttctgtgtgctttaaattgaccttcatagcttaaggtgttagagttgagcccatgtcttttccacagagcgaaattttaatcctatctgcttcctagtcttggaagcattgtgttgattatggtgactttctctgcagcatgtctttttatcagtttacagacggtgaaagggatcagaacatgcatccccaaatatgccactttgtcatatgggttattttaagctgcaggctctttcttaagaaagagcacatgcaggaagctgtttctgatctccctgtttctgcctaaaagaaggtcacaaagtttcccatgatacaaatccccccaccccttcccactgtattagaaagcaaaaattgttctcgtcaccagaagttatgagtcaacactggaatggacctatgcaaacaagcttactaaaataaccctaatctcctcatagttttccccatacatttcctagttacaaacccacaatttactgcccctagctccctacctaaatctcctttgtattatcacttactgacaatttattattctttgtttaaagtgatatataagcttttgggcctaaaaggttctttgaccttcattttccttctgaagactcctgtgtacacataaaaatacatttgtatgctcttttcctattaatctgtattatgccagtttaattcttatatcaccacagaatgtaagaggataaagaaggttttgttcccctacaaagatattgtaaacaactgtaaacagggaatttctttcttaatttccaaaaattatttttaaaaatgtaccccaaattatttaaccattcaaaagaatcacaaattttcaaaatgttaagaatcagaatattttttataccagggaaaaagtatctcttttttatggaattaaagttacagtccaagatatgttaaaaaaaaaaaaaaaacctaaactgaatatttatggttaataggagcgcccatgtcacctgtttatgttcttatttcagaattagaaagactcacaaagaagccacatataaattcatttaatactttatgtagactaaaaaatttttttaatcttacaaatgaaagataccttaatgtcattgtctcaccgacatcacaaattcatccaaagccaaatccaataacgtcatctgagtttagggatattacatatactaacacctaaagaaaattatttttattggaattttatttcttaaatttagaaaaatacaccttctcataaaatttctgccattgtttctatttttgctttttaaagtgaatgataatctttgtaaactttattttgatgacaactttttaaatagtttgaaattgaatacatatttttttctatattcaatgtttccagttctaactatttttatatatgtgagaggatttcaaggccaatcacttttttttacccatatctaaaggtccttagagatgcctattctcttatatggtttgactcatgccattacaaagtcatcaactggatggtcaactgtgtattcatgctaataataccagttttgctgttttgtggctatgatggttggctcagagcaaaatttgctggatgtgttctatcctagtttttaccatattcatacattattttagaatttatgtttttaatgaaatgttctaacttaaaaattattttcatatgcattatagtccttattttttttcagtatttcaaggtatgctgtgcctaaatatgtgccttttaatttatatggaaattaaactcagtaagattaatgtgttaggaactataatatagcagaacattggaagagtcgagacattggaagagtcgagaccagaaccacattcctttcactttaacctaatttaatatcactctgaagagtaacttcaggatgcatttgggccaactggcactttgtcttattactatatattagcatgcatacaggtatgtgtaggcaacacacacacacacacacacacacacacacaccccttgaaacgtatactttagatctagaagggactttagtgtagtgataacttgggagaagtggcgagaaaattagcctatatatcaaatcctgcgttctcttcacgaatattcaagcccagaatattattgtgaagtttcaattatagagcacatagtatccaaatttcaacttgacatttgaagttatgtgtcaccactatgaagcttcttttgacacaattcaaaatgtttagttttgtttgcctttataaagatgtaatggcagtagatatgtgaaatatcaaaacatttaattggatgtgaaaataaattaatcttagtattctttaaagttcttttattttgcattattttgtctgcctagtgttcaacttcagttttctctaatagtgtatgaaatatatgacagaagttttaagattgggtattttgtacatttagaattattgtcttaatgtttagtcatcatataatttatctaaacttggaagataatacgcagaattgatgtttttctttagcagagtgtgtggtttataatcagtaaaatcttgatcattatattataaaacctgtatgtaaataatatgcttcagaatctaatcagacacacaagtttatttattcagttcattatctgtgtgtttgtatgtatgtctgtatctctgtatgtcttacagctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaagggtaagtttgcatttgttatataatcttttatattcataatcaccatatttcagaatctcagaacttgagctaactcagattatatcaattctagcaatgtgtggttctgagtacctatcacatagcaggaatttattgtgcatgcatatgctgaaaaaggcgaactattttcttccctggcaaagaaaaatacgttacttgcaaagatgctgcaaaatactcaggccaaacaggtttttctatgtgagatgttttttgttgttgtcattttgttgtgctttctttatcgtaccagattcagagcaaatatgctctttagtagattacagtcgtatattgcttaacactgcagaaatgttctggaaaatatgtcattaggcaattttgtcattgtgtaagcatcataggtgtacttacacaaacctatatggtatagactactacatttctaggttatataatgtagcctattgtttctaggctgtaactctgtacagcattttactgtactgaacactagagataaatgtaacattatgttaagtatttttgtatctaaacatagaaaaggtatagtaaaaacacggtgtaacagataaaaatttgtatacttgtataggtcatgtaacatgaatggagcttgcaggactgaaagttgctctgggtgagtcagtgagtgtgtagtgaatgtgaaggcttagggcattactgtacgctacttgtagactttataaacactatacacttaggttatactaaatttctttttaaaatttctttcttcagtaatgaattaaccttacattactgtgatatttttacttcataaagtcttgaatttttttcacttttaaactgtttagtattaatacttaccttaaaacacaagcatactatacagctgtaaaaaatattttctttctttatatccttattctattagtttttttccatttttaatgtgattttcaattttttcttttaaaaacgaagacacaaacatacacattagcctaggtctattcggggtcaggatcatcaaacatcactaggcaataggaatctttctgattcattataatcttatgagactctcatcatatatgtgatctgtcattgggtaatgcatggctgtatttgccttactgcataaaaaggtccatatactttgcttataaaaagtatacctgcattgcttttccagcacaaaaatagctcattgtctatatgactctttcaccctataaaagtggtttattatggtttccagcaatttatactgctgtttataattagaatgcttaattatcagctatggaagaaatatgcacttggaaataatattgcacgaaaaatgatgttgaaaaattcaacttttatgtgattaactgtaagctatgctctagatagttgaacatattttaaacagatgtaataaaatgaaagtatttagtggcagaattgtaattctaatatatggtcctcgtaaaacaaactcttggcattaataaaagatgtgtcttgagattttagaaaatctccaggtttacaaatatactgcaggacacacttccatgtaaatagaaattgttcttttaagcacttagtgatttttctctacatgcaatagaacataattaatgcaaataaaatttgccacctctagtgggctacattacactactgtgtcatgatattagcatcatatttactaactcttatttttttctttctgaattacttcatataatatgaaaaccttggctgggcttggtggctcatgcctgtaatcctagcactttaggaggccaaggcaggcggatcaccttaggtcaggagtttgagagcagcctgaccaatatggtaaaaccccatctccactaaaaatacaaaattagccaggcgtggtgttgcatgcctgtaatcccagctactcaggaggctgaggcaggagaattgcttgaacctgagaggcagaagttggagtgagccgagattttgccattgcactccagcctgggcaacaagagcgaaactctgtctcaaaaaaaaaaaaaaaaaaaaaaaagaaaggaaaagaaaaaagaaaaccctgttgagattccagggcttgtaattgtcagaggtttatttggtatcttagcaactgctttgtgacaaccattgtatacttttgaaatgtctctctcaacaaaatcacaagtaattacatattgtggacatttttggcccctggggaatagttcaacatttaatattaaatttgtgcattgcaaattattatgtaaaaataattttacatgtagtcctgtgcatatgtgtgtgtgtgtgtgtatatatatatatatatttgtttgtatatagatacatttaaaagtacatacaataagcatatacaaaaaatatatacaataaacagtcttcgaagcaattttgagcattttagatgctaagtttataatgtttaaacattgcatttattactttgttttatatgctgtagtatgctgtagtgcaatggtccccaaccttttggcactggggaccagttttgtggaagacaatttttttacacatttggaggtggtggattgggggttgggggtgatttcaagacgaaactgttctaactcagttgatcaggcattagattctcataaggagcacacagcctagatccttcgcatgcgcagttcacaatagggtttgtgctcttatgaaaatctaatgcagtggctgatctgacaggacactgagttcaggtgataatgcttgctctcaggcagctcacctcctgctgtgtggctgggttcctataacaggccaggaccagtactggttttcagccccaggaacctctgctgtagtgtgataaaatgagtggctatgatacttatatattccagaaaactaggtaaacactatttcaagtttttaaaaaatctcgactttcaactgtcagaatacaaataaatcagaaccatgaattaaaaaaaaaataagtcttcactgagctaatgtttaaaatattcatagccagtgattttttttttttcttttaagaatctctgccaggcacggtggctcacacctgtaatcccagcactttgggtgggaggctgaggcgggcagatcacctgaagtcacgggtttgagaccaacctggccaacatggtgaaaccccgtctctactacaaatacaaaaattagccaggtgtggtggcccatgcctgtaatcccagctactcaggaggctgaggcaggagaatcacttgaacccaggaggcagaggttgcagtgagccgtgattgtgccactgcactccagcctgggtgacagagtaagactctgtctcaaaaaaaaaaaaaaaaaaaaaaaaaagaatctcttagctctagtttgttgtcttactctaagaaaaaaaggatcccttggcatactaagtttatgagtaagtcttaaactgtggagcaatccaacattttaaatgaataattcaagttgcttagcatgtaaagtacataaaatcctgtatatactgtggttattattgcttgaattttcatgttttacaaatagtctctgaaataatattaatgaaaaaacttttcattttatttttatataaaactacagtatatgttataagtaagaaaacagtaataccatccaaaattcctagacaagtcacagtgtatgaggtttaccagggacatttgcaagtcatcttgaatgactcaattgtagaactgcctgggaacaactaatgttgaaaaacttaccatgagtcacatatccaaactgttatttaaaagatgtagaaatgttaatactcatttgatctagaaaatatttttataatttgattatatgccagttacagttcagtttttggataattatatcttaaaaagatatagatacattaagctagcacaagtgatgactgatgtaaagatgtaaaaagaataggattctaaaataattaatttacgaagaagctgaatttattttagtggaaaacttgagttgatacttagaaagtgtctgagtcatccaaaatgtgaattcattcaaatatctaatcatattttactgcgttatacctttaaactattttggctaaattcagaaaattgtccaaaaagtttaatgttatgtttgacgctaatatcaatttacaaatattggaaaacgtattcggggaataaatctaagcatatatgctatgtttacacagagaacagactaggtaaaaatagtttttcttggaggcagttgtgaataaccatcaggacaaattgaagttctgttctgtaatatctatccctaggaatgtttaaatatttataaaaatttacttaaagtatttaatattttaatacacgcaacacatttgtatgtaatcctaatttttttgatagaagatgctagttacaaagaaattatgttacttttatattttaagtacaattaagggcagatgccttatgaaatgttttaccttcttgaaggcccttcattcctgggatatttatgtagttctctctctctctctctctctctctatctatctatctatctatctatctatctatatatatatatatatatacacacactaaaaatttacatataaatttatatataaattttatttatatgtataaataaaattttagacagctgtaaccagccctctctctcctttgcccattcccccacaaataaaatttttaaagtaaatatcttaatagcctatctgattcagaatgttgagaaaaatgactattaactaatggctcagcattagagatttgttagcatgtttctcatcaattatggggctaagatttgtaaatttgtatattttggatttcagaagagcagggtttaaatgcttctgttgtcagaaagtaaataaatagatgccattttgtttggcttttaacctaaagtcctttagcatttacttgaattcagtcatttaataacacttcaagggctggtattgagtgtttttgaaggttataatgcagctagcatttaaatatttttcatcaggaaaaaattgagaaaataggaaatttattttagctttttatatcctaggccaaataactgcttcttacatatgcacactttcaagtcaataaagaggaaaagactctagcagccttacattattagtggaagaggagctgtagcatacaaattttgaataagttgctctcaaaggacaaagaatttatttactacataaagtaggaataagacatagtatatattttttctgtgctcaatctcgtgagtacgtgctcatttataaggtttgcctttcccatgaattaaaatatgataaatgtagcattgattgcacaaaggagaaatagaaaatgagaatattaattggatttccaatctctgttccacatcttttctttttaatttgagaattattgcaacatttatatgctggtaaaaatcttccctgtgaagatactaataatttctttaataatttgatttatgtaatgtgctcatgtgtagaattaatttcactatccaaattaaaagtggtatgttagaatgcctgtatgtttacatatgcacaatgtatgtgtgtgtgtgtatatatatatatatacacacacacacacgcatacacatacacacacatatatacatacacacttgaggaatgtggatataagtattattatcatttgggggataataacactgttacactgtaagtttcctttcaaataagaaagtagagtaacacatgtctaggcatgttctcagagacacatttaagtacgttgtatgcagaaaacatgccacataacctttatttacacttgaactacccctccatagtttcattatgtaatttaattttctgacactactaccttcaacttctaaaaaaaagtggtattatatacataacataaaattgacaattttaactattttaaagcacatagctgagtaatgttaagtataaaggacatcagaatatgctaccctaaaatatgcgaatttagcataaagatccttttgagctgaaggcaattaaggaaaagcaggcacaggaaacctctctactcttccccatctacctaaaagtagggcatacatttgacttataaaagcatcccccactctcataccaggaggagaagagcaacctttattagcagaaatagaaatgctgtcaggataagccagcataaacaaatctcactaaataacctttattatccattagtttccctcctgcattacagagtttcccaccttagaagccccaaacccttttcctttgtcttgccacttctccacaatttatcacccttttttaaaacgtcatataaacccactgagtgtcactacttgtttgggtcttcacttcttttctatgaaggtctccgttcatgtgaaaatcaaatgattataatcaaataaaatgtgtatgccttttttccggttaatctgttttttgttagtttaattcacaagccccagttatagaacctaagaatgtagaggaaaggtttttctcttccctgtaagtgaatttacattgttgtgcaatgaatctttagcattattttcattttgtaaaactgaaactctatagccgttaaacaggaactccacatttctccagcccctaccaaccaccattctatgttctgactttctaaagttggtattttcagcatttatcgggacctaattgtgtaccaatgaaaactaaaatatacggttttacattagagaatggaatgactatatacatatatatgtatttgaatggaatatatatatttgaatggaatatatatatatatttgaatggaattttatatatatatatatatatatctcctagtatgtggcagtgtgaatttagaagtgccattgtatcaaggcatgatgaaggacagttttacaggaaggtgtatttggaaccaagctttgtaagatgaatttgtgtagaatcaggctgacacagaaaggagacagcagaaaggagagtgtagacaagcaagccagttctggttagaggagggccaatgaaactctttgctaggaatgtgcatcataggtaaacaggtatggagcctggctactattttatttatacacttaataattcatatattcaagtttaccaaatacctatttgtttgtttgtttttgcaaattctaattgagaaagcagaaaatctaattttcactttctaaatctacctggtaatcatatttttacttatgtttttcctacttgagttatgtaggcctgaaagggtttttaaaatattatccactatcatggttgttaatgtgttcttatatttctttctttttttttttgctgggattttgcttttattttttatttttattattattatactttaagttttagggtacatgtacacaatgtgcaggttagttacatatgtatacatgtgccatgctggtgtgctgcacccattaattcgtcatttaacgttaggtatatctcctaatgctatccctccaccctccaccttcccccctccccacaacagtccccagagtgtgatgttcccctttctgtgtccatgtgttctcattgttcagttcccacctatgagtgagaatatgcagtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcacgtgtctttatagcagcatgatttatagtcctttgggtatataaccagtaatgggatggctgagtcaaatggtatttctagttctagatccctgaggaatcaccacactgacttccacaatggttgaactagtttacagtcccaccaacagtgtaaaaatgttcctatttctccacatcctctccagcacctgttgtttcctgactttttaatgattgccattctaactggtgtgagatggtatctcattgtggttttgatttgcatttctctgatagccagtgatggtgagcattttttcatgtgtcttttggctgcataaatgtcttcttttgagaagtgtctgttcatgtccttcgcccagtttttgatggggttgttttgtttttttcttgtaaatttgtttgagttcattgtagattgtggatattagccctttgtcagatgagtaggttgtgaaaattttctcccattttgtaggttgcctgttcactctgatggtagtttcttttgctgtgcagaagctcttgagtttaattagataccatttgtcagttttggcttttgttgccattgcttttggtgttttagacatgaagtccctgcccatgcctatgtgctgaatggtaatgcctaggttttcttctagggtttttatggttttaggtctaaagtttaagtctttaatccatcttgcattaatttttgtataaggtgtaaggaagggatccagtttcagctttctacatatggctagccagttttcccagcaccatttattaaatagggaatcctttccccattgcttatttttctcaggtttatcaaagatcagatagttgtagatatgcggcgttatttctgagggctctgttctattccattgatctatatctctgttttgataccagtaccatgctgttttcgttacagtagccttgtagtatagtttgaagtcaggtagcgtgatgcctccagctttgttcttttggcttaggattgacttggtggtgcgggctcttttttgcttccatatgaactttaagtagttttttccaattctgtgaagaaagtcattggtagcttgatggggatggcattgaatctataaattaccttgggcagtatggccattttcatggtattgattcttcctacccatgagcatggaatgttcttccatttctttgtatcctcttttatttccttgagcagtggtttatggttctccttgaagaggtccttcacgtcccttgtaagttggattcctaggtattttattctgtttgaagcaattgtgaatgggagttcactcatgatttggctctctgtttgtctgttattggtgtataagaatgctcatgatttttgtacattgattttgtatcctgagactttgctgaagttgcttatcagcttaaggagattttgggctgaaacaatagagttttctggatatacagtcatgtcatctgcaaacagggacaatttgacttcctcttttcctaattgaataccctttatttccttctcctgcctgatttccctggccagaacgtccaacactatgttgaataggagtggtgagagagggcatccctgtcttgtgcccgttttcaaagggaatgcttccagtttttgcccattcagtatgatattcgctgtgggtttgtcatagatagctcttattattttgagatacgtcccatcaatacctaatttattgagagttaatagcatgaagagttgttgaattttgtcaaaggccttttcggcatctattgagataatcatgtggtttttgtctttggttctgtttatatactggattacatttattgatttgtgtatattgaaccagccttgcatcccagggatgaagcccacttgatcatggtggataagctttttgatgtgctgctggattcggtttgccagtattttattgaggatttttgcttcaatgttcatcaaggatattggtctaaaattctcttttttggttgtgtctctgcccggctttggttatcaggatgatgctggcctcataaaatgagttagggaggattccctctttgtctgttgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcccggtttagtcttgggagagtgtttgtgtcgaggaatttatccatttcttctagattttctagtttatttgcatagaggtgtttgtagtattctcagatggtagtttgtttttctgtgggatcggtggtgatatccgctttatcattttttattgcgtctatttgattcttctctcttttcttctttattagtcttgctagcggtctatcaattttggtgatcctttcaaaaaaccagctcctggattcattaattttttgaagggttttttgtgtctctatttccttcagttccgctctgattttagttattacttgccttctgttagcttttgaatgtgtttgcccttgcttttctagttcttttaattgtgatgttagggggtcaattttggatctttcctgctttctcttatgggcatttagtgctataaatttccctctacacagtgcttcgaatgcgtcccagagattctggtatgttgtgtctttgttcttgttggtttcaaagaacatctttatttctgccttcatttctttatgtatccagtagtcattcaggagcaggttgttcagtttccatgtagttgagcagttttgagtgcgttttttaatcctcagttctaattagattgcactgtggtctgagagacagtttgttataatttctgttcttttacatttgctgaggagagctttacttccaagtatgtggtcaattttggaataggtgtggtgcagtgctgaaaaaaatgtatattctgttgatttggcgtggagagttctgtagatgtctattaggtccgcttggtgcagagctgagttcaattcctgggtatccttgttaactttctgtctcgttgatctgtctaatgttgacagtggggtgttaaagtctcccactattattgtgtgggagtctaagtctcttcgtaagtcactcaggacttgctttatgaaactgggtgctcctgtattgggtgcatatatatttaggatagttagctcttcttgttgaattgaaccctttaccattatgtaatgtccttctttgtctcttttgatctttgttggtttaaagtctgttttatcagggactaggattgcaatccctgcctttttttgttttccatttgcttggtagatcttcctccatccttttattttgagcctatgtgtgtgtctgcatgtgagatgggtttcctgaatacagcacactgatgggtcttgactctttatccaatttgccagtctgtgtcttttaattggagcatttagcccatttacatttaaggctaatattgttatgtgtgaatttgatcctgtcattttgatgttagctggttattttgctcgttagttgatgcagtttcttcctagcctcaatggtctttacaatttggcatgtttttgcagtggctggtaccggttgttcctttccatgttcagtgcctccttcaggagctcttttagggcaggcctggtggtgacaaaatctctcagcatttgcttgtctgtaaagtattttatttgtccttcacttctgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcagctttggtgaatctgacaattatgtgtcttggagtagctcttcttgaggagtatctttgtggcgttctctgtatttcctgaatccaaatgttggcctgccttgctagattggggaagttctcctggataatatcctgcagagtgttttccaacttggttccattcaccccgtcactttcaggtacaccaatcaaacgtaggtttggtcttttcacatagtcccatatttcttggaggctttgttcatttctttttattcttttttctctaaacttcccctctcgcttcatttcattcatttcatcttccatcactgatactctttcttccagttgatcgcatcggctcctgacacttctgcattcttcatgtagttctggagccttggctttcagctccatcagctcatttaagcacttctctgtattggttattctagttctacatttgtctaaatttttttcaaagttttcaacttctttgcctttggtttgaatttcctcctgtaggttggagtagtttgatcgtctgaagccttcttctctcaactcatcaaagtcattctccgtccagctttgttccattgctggtgaggagctgcgttcctttggaggaggagaggcgctctgctttttagagtttccagtttttctgctctgttttttccccatctttgtggttttatctacttctggtctttgatgatggtgacgtacagatgggtttttggtgtggatgtcctttctgtttgttagttttccttctaacagataggacccttagctgcaggtctgttggagtttgctagaggtccactccagaccctctttgcctgggtaacagcagcgatggctgcagaacagtggattttcatgaaccgcgaatgctgctgtctgatcattcctctggaagtgtctcagaggagtacctggccatgtgaggtgtcagtctgcccctactggggggtgcctcccagttaggctgctcgggggtcaggggtcagggacccacttgaggaggcagtctgcccattctcagatctctagctgcatgctgagagagccactgctctcttcaaagctgtcagacagggacatttaagtctgcagagtttactggtgtctttttgtttgtctgtgcccagcccccagaggtggagcctacagaggcaggcaggcctccttgagctgtggtgggctccacccatttcgagcttcctggctgctttgtttacctaagcaagcctgggcaatggcgggcgcccctctcccagcctggctgccactttgcagtttgatctcagactgctgtgctagcaatcagcgagactccatgggcatagaaccctccgagccaggtgcaggatataatctcctggtgtgccgttttttaagcccattggaaaagcgcagtattagggcgggagtgacccgattttccaggtgccatctgtcacccctttctttgactaggaaagggaactccctgaccccttgcgcttcccgagtgaggcaatgccttgccctgcttcggctcacgcaggatgcgctgcacccactgtcctgcgtccattgtctggcactccctagtgagatgaacccggtacctcagatggaaatgcagaaatcacccatcttctgtgttgctcacgctgggagctgtagaccagagctgttcctattcggccatcttggctgcttcagtgtgttcttatatttctaatattttgttttgttccctatatttttgttccatgtgacttaaggcagaaatactcaattatttaaacctcagcaaaaattagagttcacagcaattaaatctgatagttttttccaaaaaaataagaaaatttaataaagaaaaagtaatttttaaaatgcagaaggtttggataaccaaggaatggaaaatgatgatacagttcagacagaaggtatgtgaggcctgtgagaggagaaaacaactcaattagaaagttgttaactatccatccaagctcattggcctgcagaggatgatgaagaatcttaaaaacaattttatttagacatgtgataatagtcaacaaggagattttagaacaaaaacatgatgtgatggaaatgatatttaggaagcgttattcttgcagtattatataaaaggtattatagataagagaagcctgaatttaataagattccctattgactattatagtcacatagatctgattggataaggaacttgtccaggacaatggcctaagaaacataaagcaatatgtagtaattaattaaaatgaagagaaaggaaaaacaccaaacttaagatagcttcaggagggatggcatgcggttgaattttcaactttatttgtatgtgtaagtatttgtgtatgtgcatttataggaaagacagaaaggaactgtaagtaaaaattatcctaagtatattttcaactgattttccagaataggtgacttactagatataagggaagtcaaaatatgactttaatgtttcaaattgggtgactaggagatttgtggttttgctgattgtttatgtttgtgtgtgtgtgtgtgtgtgtgtgtgtgtgtgtataaacatacatatacaaagagaaacacataaatgccacttttaatatggatagtagaattaattttgcacataagaacattagataaatcaaaatattatggaaactattattgttatcttcagaggcaagattttttaccagcttatgaaagctatagtaattctcaacttgaaaataaaagatgtgtaccagagatcagaaattcaattaatattctcacttctatttcatctttatgaaatcaatgctgcctttatctgtatattattaaaataattgtgcaaaatataatttttaaaaacagccatttgaaagtcagtctttgtggttaaaatgtgtatttttttattcgtctcatggaagaaatctaatttaaaaagcaaagatttgttttagtaaacatttgcagattgattcaatttaagaaagcagatagttttgttattgctagaaaaatcctatgtggaggaatatttgacttctgtattaaattacttctcactattttttgccccagatgttttctgtgcacataccagtttcttaagggaagggtaaattgttctaatgccagcttacaatagtattttgctgagggaaaatgtgattttatagttaaatagcttaactcatgatagtaagacatagttttgttgacatgagagatgttagcatctgtctaaaaattctcattgtatattataattaatattctcatcagcttgcaaagtctccctgtagaagccagtatactttctgtatggtaattgctgtttaaattagaaaatttatatttggactttgaattttaatatttaatgttgctatgtaattttgttcattaagaatattgaaaacaaggcccaaaataagttgcattttgttacattccaagtccaacttgaaataaatggagcatattaatggttatacttttaggataaaactatatatggacaaatatattttctacatatatttatgtattgcataatacatatatattcgacgtatatttatgtattgcatttatagtgtcttattttattttttccctaacataaagcattctttctattattttttatgtcttttatttgtgagttatactgtagatacagatagagacattttcactaaaatgtcataggagactttctggttatatttgaccagatagttaattttctaagatagtgttctatcttcaaatagaaatggaaagatcaaatagaatgtgattgttttatcatcatactatataaaatggcgttgaatttcaccatataaattcttaagtaaaattcacattttatattcatccagtgtctcatttctaagctatattttataagaaatttaaaagcaagtgtagcacatagttcctatccttgataagcttacgtagcatagtgattaggaagatatattttcccccatgacacagtttaaacacatgaattaataaattatgtgataatagtaaatgtagctaaatatcaatatttattgaatttttagtatgtatcagctatatattaagtagttgaactgaattatgacctggaattttcaatcaaagcccagtgaagtatatcatatgctttaatgtatttgtttatagattaggaaacatacttagaaaggttaaggaacttcctcagggtcatgcagctgacatttgaagtaaggctgtctaattctgagtatttgctctcaaccactacagaacaccaaagaatataaaaggggaaaagacaagatagagagttacattactaggaacttcatggaaaagatgaggcatgggttggcccttgaataaagtctggaacttatatagatataagggagaacacaaaggttccaaatggaaagacaaaagtcctttattattccatctcctcatgcacagaatagaatgattaaatagtgtgttgaagagactgatctaatatattaatgagtttatttgggagacggttcatacagtcatgctgacttgtcttaagttaaatacttaaatcactactctgaggcaggcttcaatgctgtccatcagtcatacgatatttcccttgtctatcctgttttccacttcgtaaattattattttataaattcatcactcccctccctcacacctataatacttcctctcaaccctcattctcattatcttaccttctgtttcactgagaaaaatagatgcaaagaaaactccccctagtctcaccatggcatctacccatctacccatttacttgaatttgtagccctttactctgctttctccactgttactatgaatacatcgtccatgtttccagttacaaccagcccatcctctaggtgtcctttcctcttacctcttaactgcttaagcacaagtgcactgttccaacaattctacccactttttttaagagatggggtctcactatgtcgcccaggctggatttaaactcctgggctcaagcaatcctcctacctcagcctcctaaataactgggactacagaatcctgcttacttctttaatcagttttctctcttcggttattcttaccagaatgcaaagatgctgtttatcctcccttaaaaacaaatgtataaacaaaatacttctctagcgaatgcttatcgtggatttgttcatttttcttttcttattccaaaaagttcttgaaagagttggctgtcactctcttgagccatctccgtaccaccattttgttttgaattccctgcaattgacttttatccccacaatacagcaaaattgctattgccgaggtcactaatgattgctatggtgctatatttaacagtcaattttcagttctcatattgacttgccagcataatttgacatggttgattatgatctcctttttgaaataaatttttcacttggcttttaagtcactacactggaatataattttctcctacttttctggtgattccttcccttcattatttgctgataccttttcaccctaaccccaagcgtagatatgtcctaagggtaaggcctaagggtaatgagctggctgattttctgtggcagtcattcccgtggtaatttcatgtagtgtgtcaatgttcaatatcatttaatctgcagcccagacttctcccctgatatcgagaattgaacatctcatggtattctggatatcttcccttgactatccaacactcatctaaatcttaagcaccagatagtcccaaactcagcaccagatagtccccacaaagcctcgtattttcaggaagttaatcctcttagaaaacagaaactccattctttcatttgctcaggccaaaccaggaagtctcattgcaccatctctttctcttactatcaacatctgactcatcatctcattaaaaatattaactcttatcatcatcttccctgctactattaatattttagtctaagctgcttatatttttacctgaatcattgtagcaatctactaagtgtttttgtttgttttggttttgtttttatttgttgttgttgttatgtttaattttctttagcacccttccatctctgatcaacataatagtcacagtgtgcctattaaaatataaagtcctgttaaattgtaaatcagttttgtgcttatttctctcactgcaaggtacaggtgaaccataccaagaacaattctactttaggacctttttacttcctattctctctgcctggaggtttctcctgaatatccacatggttttgctcccttaccttcaatctctttaattatgcctgaggttgcaatttttttgaatttgaaaaatcagaccttggcaatgaccttgagcagtaggatataaataactcccacatgctgagcattccaataatggaacagtagtcataaatgggttaacccatttatcatctctctaaattcttctttggccacattatataaaattactccaacccgtgacactttctactcccttattctggtatatttttctgctttgtactactgactacctaatataatgaatgttgttttacttacttcttttctttattatgaataaggaaataaaacatatttcttttctcactaaacataagttcatttaatgcagtggtcttttttattatttattttatttatttatttattcatttatttatttatttctgagacagcctcactctgttgcccaggctggaatgcaatggcactatcttggctcacagcaacctcctcctcctaggtttaagaaattctcctgcctcagcatcccaagtagctgggattacaggcacatgccaccatgccaggctaatttttgtatttttagtagagatgaggtttcaccatgttggccaggctggtctcgaactcctgacctcaagtgatccacccacctcagcctcctaaagtgctgggattacaggcatgagacaccgtgcctggccaattgcagaggtctttctaggggactttcatctgtatggtgggcactcaataaatatttgttgggtgaatttataaattaataaatgatgatatatattctgattgcacacagaagatgtgacaggcagaaaaacttgactttgattttgtaatcaaaagtaaacttaataggtttttagagacatactaagatgatgaaagaggtatagatctgtattgggatgagttagtgtttttttaatctatttttttcccagcaggacagtttagcctggagcagaataagaaaaaaagagaaattgaaaatagtctaatgttggggattactacagtgtgcactataacaaatcagagtgtaattgaggtagtcggaatttaatgatagctaagagaagactaacacattattacaattaaagttggaagtcctttttatagcttccatttattgagcaactaccgagtgccctagatgctaagtcttctaccttaaatcttcctcttcaatccttaaattatgcttagaaagtaaattgcattattcccattttataattaagggaactgagggaagaagagatacttttatttgggctgaactattggaaatgctttctcctgtactttcctctaaatttgttgccagacttctcttcccagcctttatttgatttatctgaggtttttggccattttcagctattttaaaagtctcatttttagatactatggtgcagcctagtttttggctaatactggttggccttcatactctccaatgcggcatgcatttatattttcattttttgtgagaagcattttggagactactttactgtaaaattcccagcagaccaatgactcccacctgatttctttcagtctctctcagttcctgcttcagacagaacaccacgcaagaacttgcttctgaggctctcttaccttatcagacagccctatagaggagagacttgagtgcaataattcttaccatatccacttccctgtagaattcatgactccttaccacatccaaatttgcaaaggtacttcttcaaccactgacttttccctactcagcccttataatctttttcaagatgattcctgccttacatgtctccaaacattaaaaaaaaccaagtcatgttactatcccatcacattctgtcataacccaaggcattacttcagattataattttatggccattaaacatttttgcaagagtgagatgctgatctcttaaaagcagttacaacctctgaaaatacatgttttaagattcccatcacttggcttaagagataagaagcacacttcttcccttccctagaagtagaaaataccatcatgtacctaacgcctttaaattcccttacttcattgaactgttcttcaaatttcttatcttctcccacataaattagagatgtatgatagattcactgttacaatatcagtactgctatctttccaatggcttcttttagaatttgggggtaacttatcattggctagcctcacttttcgtacttgctaaaattccaggaaggtgaatttttcttatctctatgcttaccacatttatctgttaccgcacagtatacaagcctcaaagtcaggaattgaacaaatctctctgactccaaagttttactctttcttctgcttcctacttgagtttcttgagagggtaaaagacactgaaatatgcatgcgataaggaggaaatggtcaggatactaagattataaatgtgagcataaatctgtgaaatgctgcagtgttcttggttcaacaactgtattcccattgtctaataaatgcattctatattattaatgaatattctgctagaatgtatatttcttcatttaagagatctaaaagttcatgacaattgcatcaagatgattgaagcagtctggagtagaaaaaaaaaataaatgtgagtcccacactggtatcattttagggagttcagaattggtatgcattgtggtaggagtagggacaggagagaacaacaggaatgattacgtgggtggctgagacagatggtgtggacttcaaataaagaaacccagaaggtggtggataaataatgatgagagtagcatcggagagtaaggaaaaattggacagttctatctcaagaactcaaggaataaaggatgaaatcagacttttaaatgtttactacctttaattatttaaatgatgtgacaacaaataacacttggaaaatcatttttcaatgtttttgttataacctcttataaacaagaggattagtttataggaaaagacaaggctgagcaacataacaaaatcaagtgtattttttttttttgttttcagacggtctcgctctgttgcccaggctagagtacagtggagcgatctcagctcactgcaagctccacctcccgggttcacaccattctcctgcctcagccacccgagtagctgggactacaggtgcccgccaccacacccagctaatttttttgtatttttagtagagatggggtttcactgtgttagccaggatggtcttgatctcctgaccttgtgatccgcccgtctcggcctcccaaagtggtgggattacaggcttgagccaccgtgccaggcacaagtgtatttttttcttttgaaaaattatattgtgattttacattctaacataaatactctatatcagaaataaacaaccactagaatgagaaacagaatgtcattacactggaatgtggtaaaaaagaaattgttgttgataaaagaaccaccaacttgtgtatgtggggaaatatctgtttaactgttaaagttttgtgttatgtagaattcttaaataacataataattttttaaaagtcactgagtgcctttcatcaacagttttgataatctgagagcctattcacctgtgaatgattttaaccaaagtaaattgcttcaactctgtgcttaatagatggtgtcagaagattgtggcccagaaaacaggatgctgaaagacatgagatgtacatgagatacacatgtttcagtcatagcctgagtatggtagatgtagtctaggagaacttggctgggaacacaacaccatgtcttcatattcatttcgaatgagatgggggtagacagagatagggtcttcctaaagaagtatattagtttgtttttatatatgcattatttgtgtcttataaagaacagtgttagataaagagacagagttaaatactgtaagatttttattctcactgtgcttaaaaatagcaaccaaaaatatttgttggcagaattaatcatattattgtcagttttaccattataaaacagtactaactagagtgttagtttggtgccacttttaaacatatgaatgtattttacaccttcttttttgtgtagatgaggtaatggaagtccacagtagtgagccgagttttccaaagtcacttatgaaaaagaacaaaactctgtctcaacccacattctttttttttattttatttttctatttttttttttatattttttattatactttaagttttagggtacatgtgcacaatgtgcaggttagttacatacgtatacatgtgccatgttggtgtgttgcacccattaactctttatttaacattaggtatatctcctaatgctatccctcccccctccccccaccccacaacaggccctggtgtgtgatgttccccttcctgggtccatgtgttctcattgttcaattcccatctatgagtgagaacgtgcggtgtttggttttttgtccttgcgatagaaggaaatagagacacaaaaaacccttcaaaaaatcaatgaatccaggagctggttttttgcaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctatgcaaataaactagaaaatctcaacccacattctttagtacggtgttctgttacccatctcactgctgttgtctgtttgactgactgtggcagttgtgctgattggagcagttttctatttggcctacagtagcgaggatggctgtgtgtcctttcatattctttagcataatcagaatcatatctgtacagtaacaagcccgaagctatcttaggacagggatagtgaatatagatgaacaccctaagaaataagttaataacaatgggaagttagtagaaatggtggagtttaagtaggagcacatagaaatatctgtcgtaaactgggttttaaaaaaagtggacaagaattcaggataacatttctaaaaatagcttctctgtcataagctgttttcctcagttctcactctgtatttcataggtcttagtttttttgtttataaaataatagtattgactttgatatcatccaagatttcttctagctgtaggatttcatcttaaaatgaagatgtcttaagatataaactcttcctaattaagattactgaaccatttggcatgccaaatagtgcaaagctttatatcatactgaatcacagatgctgaagtatttataaaacattttagtaggcatcaatgtaggcatagtgtaggcattacatagaattattctaatgtcccaacatatgagacaggaaaaaatagttaagaatagagcatggaaaaaaaaggggtgaatctaggaattcacaatctttatcaggaaaaactggtaataggggtaaattaccatatagatgatcacccaaaaggtgatctttgggcaattaattgcttaaatataagtgaaatatccatagatcatctatagcattctatttctgtgtaacattaattatatttgaaatttggagttatagcttaaattcttcaaatatttataagatttcaacaactagatatattttttgacaagaggtaatagaagcatgagatacttgtccttcaaggaaagatacgacagatttattacaacacacacaaaatctaaacttggtatccagagaaacaacatatataggatgtgagattcaggagaacaaactctgttgactaaacagagaattgttatgttaagttaaaaggttttttcaattatctactcaaaaagtttatttagctttaatattgaaaagttctttgtaaggaacataagaaaacgtgacgtggcagcctcaaatactagaaatttaaatttagaacttgattatagaatgaatatttgaatttgagcacacacatgtgcacaatctatacaaatttagaattcagaaaatcaaaaaatcgaccaggtttataaaaactaaaaaacaagtttttggtttataataagtcttaagtttaaggaggacagcagttgggtcttgtttttctttccccctttaatacattctaatatctagcaaagtatctgaaaaacagtctttactgaataacgatatctttaatacgttaagaaacacactgtttgaaaaactgaaatcaaagtgaaactctaacacaaaatgaaaaatgtgtctactgtcccaagagtgttccaaaaacatttcaaaggagaaaagcacagggaaatagtaagatgctactttctcatttttaagtgagtgttaatgtgagagaaaaatcaacaaaaatatttctctaaagaatagaataatataatctaacaggggtcaattagaagactgatatttttccttggggaacttttacctccttcactgtcttttaagacaaaattcatcaataatttgaaggaaccatcctgtttgtctgttttcctttgaggaaagtcctttctgtttaaagtttcttttttttaatttttcttgttttcttcacacattaggtaattatcaccattttcagagattggtaattaactgagacatatgtacatgcttacgcttacagcctcattatattatcaaaatacaaataaagttagttttagaaaggatgaaccattgatttgggaatttaatcatcttaagatgtgcttgaattgtttattaacattttattatttgtgtttatattaaaaattagttttcattaatatttagaattcttgcaatttaacttaataggaatagatgcagcataacattctgattcctcatagtgaaagaatttaaaggatattctggatctttctgttagaagaagaggaaatctaaaagaaggattaccaaagggcactgattgtagttttgagctggagaaagtgaaattagaccaagatctggactccaagctgagaagaaaattacacgaagagaaagctattagctgaactcagtagaaaggatatcactgggtcaaactccacaggtggaaaagattttcgattgattaccagttcaagagagtattgaacagagtcactttttgcttgacatctttgggcacaaggtgtttattatttaaagctctgtgtaagaagtttgggtgtcatgatctgtgtctggtacactggtcagtttttcttaaggtctcacgtgtctaaacaaaataactttttatttgttccaaaaaacttgtctagaggaactcaattcagtcattaaataaaaattgttggctgggcactgtggttcatgcctgtaatcttagcactttgggaggctgaggcgggtggatcacctgagttcgggagtttgagaccagcctgtccaacatggtgaaaccccatctctactaaaaatgcaaaaattagctcagtgtggtggcatgtgcctgtaatcctagctgctcaggaggctgaaacagaagaatggtttgaacccaggaggcagaggttgcaatgagcggagatcacgccactgcacttcagcctgggcaatgaagtgagactccatctcaataaatcaaaaccacaatgagataccatctcacaccagttagaatggcagtcattaaaaagtcaggaaacaacaggtgctggagaggatgtggagaaataggaacacttttacactgttggtaggacagtaaactagttcaaccattgtggaagacagtgtggcaattcctcaaggatctagaactagaaataccatttgacctagccatcccattactgggtatatacccaaaggattataaatcatgctgctataaaaacacatgcacacatatgtttattgtggcactattcacaatagcaaagacttggaaccaacccagatgtccatcagtgatagactggattaagaaaatgtggcacatatacaccatggaatattatgcagccataaaaaaggatgagttcatgtcctttgtagggacatagatgaagctggaaaccatcattctgagcaaactatcgcaaggacagaaaaccaaacaccgcatgttctcactcataggtgggaattgaacaatgagaacacatggacacaggaaggggaacatcacacaccggggcctgttgtggggtggggggagtggggagggatagcattaggagatatacctaatgtaaatgatgagttaatgggtgcagcacaccaacatggcacatgtatacatatgtaacaaacctgcaagttgtgcacgtgtattgtagaatttaaagtatactaataaaaatgaaaataaaattaaaaagaaaaataaataaataaatattgttagggcctatcaggttccaggaattgtgccagatcctgtaattgcaaatatgagtaaggcatattccctgccattgcagaatttatcttgtagttgagcaaaagtgaaaagtacacagaaaacaccttgtatattagaaaacatagcatggtcaattgatctgtttctctaataggcacatatagcacttttaaaattgtattcttctagggttgatagaggaattctattactaactgaactttgttgattaagcaactttcagatattcgaatatttgaaaggctaaaaaaaaggcagcctcttctttgaacaagcttttaggagtgatcactctaacagcaaacatctcctttgcatgtaaaattaagcaaaaacttttcttttactcctttcctttccattctccttttttcctaccacttcagcccaaagccctaaggtggcactgaacacagagggagggcaatggtcagtgtgagtagagagacacaacttaatgtagggagagaaaggcatccatgtgtgaccacatatgtgggtataagtagagcaaccacatggcatcagagcccaagcaggttgaggatagagtcctgatagaaaggcagccttgcttggggggcgagaacctgtgcaggttggtaccaacaatcctatggatggtaccctggtatggcatgtcagaacctgagcaaggtaaagaaggcatccttgtaggaggacttttcaaaatgcagtgtaagagcctgaccagagtaaagagtattttcacatgggaagggtactttcacccagcgaagttggagtgccaaagccaagtcaggtggggagggcatcagtgcatggaaagaaagcagtttgcccttcggatctggagtccaagtggggtgggtatgttgtccatgcagtatctggcccaggcagggtgtggtatggagcctggccaacgtgaagtggtctggtgtatggcagggtagtgcagagcagcatgtcacagagagatttattttaaggaattggttcacatgatcatagaggccgacaactgcagaatctgcagagtgtatcggcagactggagacccagggaagacatgatgcttcactttaaattcaaaggcatcctaccggcagaattccctcttcttcagaagaggttagtctttatctattaaagccctcaacttattggatgagatgcacccacattatggaaagtaatctgctttactcaaagtctactaattgacctaatttcatctaaaaaataccactatagaaacatctaaaataatgtttgaccaaatgttttggtccattagtgttgctacaaaggaaaacttgagactaggtaatttgtaaggaaagagatttggccgggtgtagtggctcacacctgtaatcccagcactttgggaggctgaggcaggcagatcacaaggtcaggagttcaagaccagcctggccaacatagtgaaacctcatctctactattaaaaaaaaaaaaaaaaaaaagtagccaagcatggtggtgggtgcctgtaatcccagatactcaggaggctgaggcaggagaatcacttgaacccgggaggtggaggttgcagtgagtgagattgcaccactgaactccagcctgggtaacagtgtgagactctgtctcaaaaataaataaataaaaaagagaaagaaaagagatttattggctaatggtactgtagtttctagtccatacacgaagcatggtgccagcacatacatctggagagggcctcaggctgcctctactcatggtgcaagggggaggggagccagtttgtgcagagatcacatcatgacagaaaagacaagagagagagacagaaaggagggaggtgataggctccttttaacaacctgttctctcaggaactgacactgcaacactccctcactccccgctaccaccacaggggacattaatcatgagggatccatccccatgacccaaacatctcccattaggcctacctccaaccttggaaatcaaatctcaacatgagttttggaggggaggggtcaaacaaaccatatccacactatagcaacaaatatctgagtattttagcctactcaagttgatacataaaattagccatcacatttgggaaataggctctgaggtataagtagtctcattatggctgattttaagctatcaacttcacgtcactggatgtaaactacagaagaattatatgaacacaaccagctcttgtgagcaggtattagccagcagcagcataccactgagttgacttgagttatgaagtctgaatggaatcttcttccaatcctatggagggttttgagaatgggacacgacacccttcaaaactgccccatattggcactagtgagtgagtcagatcactatgccctgaatcaatcaatccttggatacaggctgccttcagaagggggcaaggctttgagaaaggcagctctcttcaatttaggcagttttcaaagctgggctgataactggagctgctcactggcagcactccgggtaagtttggtaataagttacttaatggtggatgaggatctaggcagcacatcgtagcttcatagcacccaccgtattcaatgatgagtctccgtgattgggtctcactaaatccataaaaagaaattggaggctgactctctctctctctttcccttagagagagagagtaagagagagagaacccagttacatccagagttctagggagcagaagcacagtgctgcaaggaagaaacttcagctgaatttcaggcagaccaaggctcaactgaatttcaggcagaccaaagctcaaattctaaaagtattattttcttattaccagcttagttgagtcatagaactagtctttcatcattgaaagtgtatacttttaattgttagggctactgttttaatcagggtttccagctgcagaaaagaaagattatttgcctttttcctgccttcttgttctatctgggaccttagccaattggatggtgcctgcccacattggatgagggcggatcttccttactcagtccactgagtcaaatgctaatttcttccagaaacaccctcacagatatgcccagaaataatgcttttccagctatttgagtttaccttaattcagtcaagttgacacataaaattaaccatcacacccaccaaaactgtattcaataagggaaaggtaggagatttgatgctggactgctatccacgttgtttacagtgaccatatatatgattgactcaggtctacacctgcttcctggaataactataataactgctcttttactccccaaagagcccagtttgagcaataaattacattgttatcctaatatgattgcttctacaagacaggcagaatagcaagcatagtgccagatgtcacaacctttcactgccatgtgaaacctgggaataataataataataccttttaagactgtcatgggaattaaataagataaaatatgcaaaaatatacatgctaagttattggaatagcacctaagtattattatattttccttgtgatggcattttatattgccccaaaatgagtaaatattaaaatgtccctacaatagaattccaacatgaaaatatccagtgccaataataaaaagaaagaaatgattgatttttaaacaaatgaataatactctggaacaacttgggtagtttgctggagaagctttcaatgcagaagtcttgggtcaaacccaaaatcttataagcagtagttgtttttgggtaatttgcttaaactttctcagccttgggtctctcaattattgggttgtaaattatcaaaagaatatctttaaagcccatagtatcttcctggccctcttagacactcagcaatgttaatttccctctcctggctgaaaaaagtaactgaggttaggaatatttttcagaccaaacaaatacatggagggcttggaaggagtcttccaaactcctcaaagcagagaggcttccatcctcaaactctccttatcaaataataaaattcttatttatggggaaggatgggagggaattaataccacctactactctagaaacttgttctcaattccgcttgccttctacctactccaccagaaacatttcctcatggcttgaacgacaatatgtagaaaagcatgctataaatttgtgtgttttcaatttataaaaatggtttcatatattacacctcagttgaaaatcaagacaatgcatgagttgtcaaatcaggtattagtcccattttgcagatgggaaatatgaaatcccaagaggttacttgacttgcctggataatacagttaataactggaagagacaggcaggatatgaacatacttttctgaactctaaagtgaatgatttgtctgctttggaacactctgaagtccctgactctgaaataggagctcctggatgtgttattaagacaggcacagtgaagtatgaatacataagtgctaaagtgtttctcagcttcacagcttgttttatcagctatttcaagactatttccacttgagagttttgtacttctagcctgctgtgagtcactaatgatataatccattttggaaatggtggtaaattatgggttgtggtaactctgttatgaacttattattattaattacttgccatcacttgccatctcaattgtgttttgttcagtaaacataatatccatgctcaatacaaaaattaaatctttctttctcatacacacacacacacacacacacacacacacacacaatgctaagccagtaataaattttacttgaccttaagtttgagcctcaaatatgaatctggattcctgaaaaattgagtttctaactatctttgccaaataaatatttttgagggtgaatttcaaatgaccatgtctaataaaaatattattttaaaacttatttttattttttacagatgcataatagatgtacatagtttgagggtacatgtgataatttaatacattcataaaatttgtaaagatcaatccatcaccttttatgtttgtcttttctttgtgctataaacattcaaatagttctctactagctattttgaaatctactatacattattttaaactattatttccctactaatgtatctaacattgggtgttattccttctatcatactgctttttggacccattaatcaacttttctttatcctccctccccactaccctttctggcctctggtaaccaccaatcttttctgtcttcatgacgtccatacttttagctcctactcatgagtgagaacacgtagtatttatttttttgttcttggcttatttcatttaacatgacgtcaagttccattcacgttgctgcaaatgataggatttcattcctttatatggctgaataatattctagagtgtgtgtgtgtgtgtgtatgcgcatacatacagagcacattttcttcacttatctgttgatgggcacttacattgattccatatgctattgtgaatagttcagcagtaaacatgggcatacagagatctatacaagaaaaaactatacaacattgatgaaagaaattgaagagtacaaaaaaattgatagatattctatgctcgtggattggaagaattaatattgttaaaataacaatactacccaaagcaatttatggattcactgcaatccctatcaaaataccaatggcattattcacagaaatagaaaaaaatcctaaaatttatatagaactacagaagaccccaaatagacaaagcaatcatgagcaaaaaagaacatgagtaaagctataggcatcacattacttgacttcaaaagttactgcgaaactgtagtaaccaaatcagcatggtattggcattaaaacagacatatggacaaattgaacagaatagaagacccagatataaatccacgtatttacaaccaacttattttcaacaaagatattgagaacatacactggggaatgaacagtctctttgataaattgtgctggggaaactggataactgtagaagaatgaaactagaccccaatttctcactatacacaaaaaaacaaatcatttaatttgattttttaattaaatttaattaattaaatttaaatttttaaattaaattaaattaaattaatagattgaattaaagacttaaatctaagacctgaaacaatggaagttgaaagtcttaaagaaaacatttgggaaatgatccaggatattgttctggaaagtattttctgtgtaagactttggaagctcgagtaaccaaagaaaaatagacaaatgagataacaaagctaaaaagcttctgcacagcaaatataacaatcaacaaattgaagggacaacccacacaatgggagaaactgttagcaaacaattcatctgacaaggaattaataaccagaatatataaggagctcaaacaactcaataacaaaaaattatctgacaaaaggtctgaatagacatttctctaaagaagacatacaaaaggccctcaagtatatgaaaaaatgttcaacatcactaatcatcagagaaatgtgaagcaaaactataatgagacattatctcactccagttaaaattacttttattaaaagacaagcaataatagaagctggaagctggcacagatgtggagaaaggggaatgcccacacactgttggtgagaatgtaaattagtacagccactgtagacgatagtatggaggttcgtcaaaaatctaaaaggaaaaccagcatatgatccagcaagttttctgctgggtatatatccaaaagaaaggaaatcagtgttctttgaacttaaattagatatagataatttaattgtgatgagtttgcaatttatgattttcttgatttgttgtttgcaaagataatttaaggtacattaaaattacgcagtctcaaccccttcactgattggctggatggtctaagtggatttagctagactacctcagagtgttttcaaatgcttaatcaaatactggtattcctgttaagggaaagtgaatagggcagatgcaattacagtttaagctggggtgagcagctctactctagggcactacatctatgaaaccacacaaaaggcagacactgatctgtatagtcaaagactctaagaaacaagtgaactctggggtgtacagggtaatattaaattcaggtagataaatctgaggattttttaagctaacataacagttccatgagcaagttggaaagcatttaatgaaatagatacacacgacctttgaaaagtgaacattaacttgtacttgtctaaaataatcctttctagtcaaagaaggtttttaagcaagatgagttttggagtgtttgagtttattaggtttacttaaagatataacctttatttcctttcttctatgtaaggatatacaggaaacttgacatttggttaattgactttttacatttctcattgggaaataagactgaagctttatgaaaattcaaatcaactacgtatatgggatttttgtttctgctatgtctcatttttcattgatgactacaatagaatattatcacgtttttctagctgcatgtctattataataataaacattttcagtcttgggaaatgaagaaaatcttcttgtcaacataactgtattgctttccatatacttgattagaaagcctttgcatattaaaaagagatttactgaagttcttatgaaaacttgagctgatatttcatttcaatgtggttataataactagtatatttttcttgagcaaataatgcataatattccctatcattttgttaatttgattagacgggttataaattcaggttttctaatctttgaaagaaccagtgagccaaacatctgcatattcttacccaatgaatacacacctctgttaggaacttaactcataattggaggaactctagcattctcttttcattttctggaacattttagtttatccagtaaacacatcagtacatgacatagttaatctgttcttttcagatgttctcctgatcaatactgtgatcaaatcaatttataaacatccacatagatcacataacaagacactttcaatgtaatgagattcattcattctgtggagaaagacatgagcctttctactgtctgaataaccacatttccatacagatactcaatatgaaaggtgttagtcaggtggcagaactgaaaactattctggagggaataattgaagctaaatgggattcttagtgctaatttggaacaagcaggatattttaccaagctgtttggggattcttaacctttaaatgccacaggctccttggaaaatcttgttaaaactatagaaaccctctgagaattaatttttaagtgtacaaaataccaaaaaatatatatattgaaatatggtcaccaaaatagtttaaaataaatgtgtagtagggtaatatatactggaaaattatctctatcttgaggtacttctaataactatcataatttcaaaatagtaacaagcatacatgataatcccagacacttgcaactataatgttcttatgaaaaatctatgatttatattatggataaagtaccagttattgcagtacgtctatggtttgctgcttatagtcataattaaagtaaatgttatttcttacttagaaattaaggaaacatattttcccccatccaagtttatgaattctaaacatggaccactgtcaaggtagtaaaaaaaaggttaagaaaccctgtgttaatgatttctctgagaggcagaagtgataacgaaaacattagactatgctacatagatcaaatatacacacagacacaaaagagagaacataacccattttgtactagaatttccggttctttgttataagaatctgtgcctcttagaagtcagcatgatgcagagtatgtttgtttaaggtctagtagaacatatatattatttatttatttatttatttatttatttatttatttatttatttatttatgggatggagtctcgctgtgtcacccaggctggagtgcagtggcgcgatcttggctcactgcaacctccgcctcctgggttctcctgagtagctgggactacaggcgcccgccaccacgcctggctaattttttgtatttttagtagagacggggtttcaccgtgctagccaggatggtctcgatctcctgacctcacgatctgcctgccttggcctcccaaagtgctgggattacaggcttgagccaccacacccggcctagaacatataatttaattaataaatattcattttaagaattcctgatatcaaaagaataacaagacagctatttggtttatggtacatatttattatggataatggtatgaatgatgttacataaaaccaggaagaggaaaaccatgattaagatgttcatttagtttgtagtgtttctattatggctattgtgctatccatattcccctaaaatgctgatttttgaaaaggtgtttaatatatctcatttaacatgtcaaagcaaagggaaaattcttaataaaaatacttagtgacttcattttatttaaatattttcttagcccaaatttatggttttggttatctagactattgttacttaaattgtgggccagggagcagcagcatctgcaactgcatgggaacttattagatatgcagattcatgagacccctctccactccaaacttactgagtcatcatttggaggagtatggctaaggaatcagtcttttaagaaccatacataatgttcaacaacaataactgccagttaactaccaatatttaaacttagaaagattttatattaaaagaattcagaattctaatctcaagaaaaaagaaacagacaaaacaaggatctgctgtggtacatccagacaatggcatatcattcagtgatagaaagaaatgagctctcaaacgagaaaaagacatggaggaacctaaaatgcatattgctaaattaaagaagacaggcttagaaaggttatatatagttgaaactctatggtttcaactatatgacattgtggaaaaggcaaattacagagacagtgaaaaagccatggttgccaggagctggggagggggaatgaataggtggaacacaggattttagggcattgaaaatactcttgtgatactacaatggtggatacatgtcattatccaatggtgaatccatacatttgccaaaacccagagaaagtacaccaccaagagtgaacctgattgtaaactatggactttataataatgcatcactattggctcaaccattgtaattaaagtagcgcattaatgcaagatgttagtaacagggatactgtgcagtaggaatagtgggctaggggaaagggaatatatgggaatgctctcaatttttctgtaaacctaaaagtaaaaataatgctatttaatatatatgtacatacatatatgtgtgtctacatacatacatatgaggcagagaaagaccagacctgaaaagagacctggcaacacaggactatatttttgtgtaattctgcagctgagtagtagctacccctttttgaagggccaaggacacaccaacttgcttcaatgctcaacttgccattttaagaatttgatttatatacttctggcttctgaacctttatgactcaagtaatgcaaaagcaagttttaggagcagaattggtattaattcattcagtaattgcaaattatttgctcttgagaactctgggagaggataccactgtcaccgtcttctgttactactgtgcttacctgtgattattgctgcagctgggccaggaaacatgccaacccttattcaccactataagttaggtgctaagataaggtagaaacttgctggaggtcacacaagtacactggctggaagagggtactcagaatcaccaggctatgccaaattgtttctggttactttttcatttggtagatttggcagatatttttcaaatggaaattagaatttagtgtgaagaaatgttatctaaaacatgggaactgctaagggaattgaacaatgagaacacatggacacgggaaggggaacatcacacaccggggactgttgtggggtggggggagggggagggatagcattaggagatatacctaatgttaaatgacgagttaatgggtgcagtacaccaacatgcacatgtgtatatatatgtaacaaacctgcacgttgtgcacatgtaccctaaaacttaaagtataattaaaaataataataataatgtcttcctctcgctcaatctgcacacggagttggtcacaaagtccttaattgtatcaattaacatattcttcaagtcttctctcactcttccagttccattgtcctcatcatttgctgcctgagggtttgcaatagcttcttaatttatctccctgttgccggcatcatggtcaatgtcctttcccattcagccagctccagtttctttcatgagtctgccagaattgtcttctaaatgcaaatagtaatcatgtggctcccttcctaacatctttcactgatattctagtctaactgctttagcaacatttaaaactccttcagacagcctttctaagtttatctgcagcctcagtcccaaaggtgcattaggatccaatcacacagaaccaatctgagatttttagagctctcagttttttcttactgataaaactcttttaccatggcgttccctttggtaagatttcctttattgccacatctgcccaataaactctcacttatccttcgtgtcccaacaaaattatccctgtctctgaaactccttctactctcttaactctaccccaggtatgttaagtagtaaccattaccagaacattctgtttataccaatattatatagtttattatggttaattttacctgtcagtttccctcatctagagaatacatcagagactattttttgtctattttcctagcatatagtaaatactcaataagtattccgtgaacaaatagatatgagtaaatgagtgaatgaatctgcatgtgaaatatataatgctgttttgctgatttcattacaaataaattgtgaaaagggaaatttgctggtaaattacatgtatgatttaacttcctgttgattctctcatactcattttaaaattaaaagtatatacaaaatgttcttaacgtcaggaagtgtgaggcaaaactgtcaaatgtggaatatcaactctgaaagcagcctgatttttgcagggttgtatctttgagtattaaagaactttactaacattcatttgaaatataatgtcttgggttttcatttgtattatgaaacaggccacaaagacgtactaaatgctcatctttaagggctttctttttctcatctgacctttataactgaaagaagcttcaagtacaatttcataagcagcaaagcagcttctccagaaatgacatttgtcagtatttctggtttggggaccctcttccatgataaaaaaaaaaaaaaaaaaaatcttaaaaggagtgttttcagctaactcagacatgattctatttgttacttgagtgcatatccaatcagatactcagggaggcagatgttttggacacacgtttctctatagctgacttagagtgcattttattatgtgcttggtttgaaaacaaatttcacagcaaactttacagaagtatgctgcttagtttgtaatgcagttcacacactcagcatgaataccaatttatgaaggtgtcatcaagttgtttaaaccaacccaaacacacataatacagatggcattgtaggcatcagtgcctgaaaaataatttgtgacatctgtagccttctctaatcatttcagttttttgtgctttttattcagtgactcttttatgccatttcaaaatataaatagactcataacaatatagaaattgttttttgagcattaaaatgaaaattttattgtatataatttttgttattttattatatttactttaacatagctagtatattaaacattttggtaggtctttttttctccttgccttttatggatctttttgtcaggcagttaaacaaaccacttatttaaaaaaaaatacaaatattgctgtttaaatttacatttacaatttcttgctgaaagatgtacgtttctacagttataagtacctgttaaaaaaatagatttgtttttttctgattataaatgtaattaatgcattttggaaacttttttaaaaatccacaaccatgtataagaattctaaaaatcaccatgcataataagcgtagttaaaatgttgctattcataattctcaccttctttttctaaattaaagtccctataggggtgtatctatctgtatatctaaattaacctgtgtgataaatattttatggtagttgttttatttttattttttcctaatatggtctatatacttaatttcattgctcttttttaatgtcattaactggagatctttataagcatgttagtgataaaacaagtgttaaatgaaaatatagttgacccttgaacaacatgagtttgaactgcactggtccacacatgtgcaaggatatttaaaaaaataaaaaccatcaacccttaccattggtgggttccacatccacagccaccggtgagtggtattgtcaggatgcaaaacctgccataggaaagagccaacttttcatatctgtggttttcacagggccaactgatagacttgaatatgtgcagattttggtatccactgcattcctagaaccaatttcccattgataccaaggaatgactatattgctttgaatttaatcaatactttattgttgtatatttagtcacttttatgattttgtaaaccatattgacagtaaagtgttgattatcagtaacacttcggggaacagattttagcactaggatgagaatttagaaggaaattaacaaaataaaaatgcatcacttaaaagaaaaatattttatccttgaagagaaaacactcctcagccttgctaccaatgaggcatttatttaatacttatgtttatagcatttctcatatttacattaacattttttctctctggcaggtaattggtaaaataacaattttaggttttattacttgatttaaagtgagtatgtattttccccaaaggaataatttaaagttgaaatgaaacaatgctattttgctttttgaaaaacaagtttgataaatttttacgatatgatatatatttatagtctttaaagttttaactataaaatacattctttttctgttcacagtaaatatttactggatctcataggtaaaaatagaagtaattaatattcttattaatcctggatgactgcaggttacctttacatatctcttacaggttgctcaaagtattttttcatactttaaaaataaattacaaataaatatttaacataaataatatttcaccattttcgtcagttccttagtatctaagctaatattacaaatgtcaaagtctactaattagtgtattccttaagaacattattagattttctctctctttttttttatgtttatatgttattggttatcatttgtctctcttcccttgtaagaacttttaatatgagagtctaataagattaacagtgataacataattgaaatactcagagatatttagggaattcttaccgaatatcaaacactatgctaactattatatatgcgttgactatttaatttagaacccactcaacttgtactatttctagctccctttgcttatacagaaacaaacgcttatagaggttaaacaaatggcccaacccagcagtgctagtaacttgagaaatagagtttcaagcccagggtgtctgactcccaaagatatgttaatcatttgactactaaacttgtaacaagacaatgtttcatttcttcaatgcatttccagttgcgcatactgaaaagcataaattgctgttttttgtgtgcgcatttggtaaaagtacttctacatatttgaaagttgtcaatgtattctaaatatcatgatcagatatatctgagcttcaaatggctgctttttgtgtacaataatattggttctattttgtggtcattaaggatctttctttccccctatccatgtggaataataagccagtagttctcaaacattcatcttaaaaattattgaggaacccaaacactgtttatgtaggttataactaattttatctgttttataagaaattaaagcagaaaaaatatatatttattatatggtatataatatataaaaatatgtattatatttatataatataggataatatatttattatatttgtataacatataaaatatatttattgacattggtgttgacccctttttaaaataagagtaggcctggcacagtgactcatgactaatcacagcactttggaaggcccaaagctagaggatcacctgagcctaagatttcaataccagactgcgccatttgtttctcagggacaaatcccacttgatcattgtgtatggtcttcttaatgtgctgttgaatccagtttgctggcatttttttcagaatatttgctttcatatttattagcaatattggtctgtaattttcttttcctgtagtatcattgttttggtttggtatcagaataatgctggtcttgtggaatgagtttagaattgttcctcctatttaatttttttggaagagattgagaagcattggcattgaatcttctttaaatatttgttagaattcatcagttaagccattagctcctagacttttatttgttgggaataaataccaaatcaatgtttttagttgtaattagtatgttgagattttctatttcttcctagttcagtctttgtgaattgtatgtttatagaaatttatctctttctgctaggttatccaatttgtttgagtataactgttcatagtagtttcttatgatcctttatacttgtggactctctttcatttataattgtatttatttgagtcctctctctttctctgttgtttagtctatctaaaaggttgcagactgagtatggtggctcacgcctgtaatcccagcactttgggaggctgaggcggttgattgcttgagcctggaagttcaagacaagcctgggcaacatagcaaaaccccacctctacaaaaaaataaaaacattagctgggtatggtagtgcatgcctctagtcccagatacttgggggactgaggcaggagaatcacttgagcccaggaagtaaaggctgcagtgagccatgatcatgccactgcactccagcctcggcaacagagtgagaccctgtctcaaacaaacaaacaaattgaaaaaaacttgtcaattttgattctcttttcaaaaaaaaaaattcttagtttcatttttcttttgattgtttttctaatctatttcatttatttctgctattatcattactatctttactatgttttttcttctgctaatttggggattagtattctttttctagttctttgaaatggaaagttaagtttatttgaaatttttctttattcttaatatagacattaattgttatagactccacagggtcttgctgtgttgccaaggctggcctcaaagtcccaggctcaagagattctcacttgttataaccttatcatgaattaacccatatattatttgaatttataaatttataatatatttgaacttataaatttataataatacatgggtaaaatatattatacgaatttacccatagattattatagaataaccttctttatctcaattgtgacaggttttgacctataatctattttttatatacatatacctgcctcttctcactttttgtaactcatagaatatgctgttttaccctttgctttcaacctttgtgtgtacttaagaataaaatgagtctcctggatactgtttttaatccattcagtgactctctgtgttttgattgaataatttaacttctttatacttgaagtaattattgattgagaaggatttattattgtcatgttaattgcttttctgttttttaattcctttgttatttttttcctatcttgctgtcttcctttgtgatttttttcttttcatagtgatatactttgtttcctattctgtatcatttacagtttcctctttgtgattatcatgtgtcttagtctgtttagtgttgctaagaatacctgaggctgggtaatttgtaaagaaaagggatttatttggctcatgattatgcaggctatataagatgtatggcaagagagaaaacaagagtagggagtagaagtgccaggccctttttaacaaccagctcacaccagaacttatagagcaataactcacttattactgcaaggacagtgccaaacctttacattttttcatataatatatcatttaaaaagttattgcagctctagttatttgtaatactttaatcttaacttttatattagaattaaaagtgatttatataccaccattagagtattagaattttcttaatttgatggtatacttacctttgccagtgagttttatgcctgcatatgttttgatgttggtaattagtatcttttcattttaactagaagaactttctttagcatttctagtaaggcaggtccagtgatgataacctccttagattttgtttgttgaagaaaataattatctttttatttgacagctttagtggttatcaatttcctagtgggcagttattttctttaagcactttgaatatgtcatttcactttgacctgacatgcagagtgttggctgaaaaatttacagataatttcatgaagtttcctttgtttctgataaattgcttttctattactgctttcaaaattctctctttgtctctgacttttgacaatttgattatcatatgtttcagtgaagatgtctttattctcaactaattggaattctttgggctttatcaacctagatgttcatttccctatttgtatttgaaacgttttttgtcatgaattatttaaataagctttctacacctttctctttctctatcccttccgagattctcatagtatacatattaattcacttgatagtgtaccataagccctataggttttcttcacttttttattgtttttactttttgtttctttgactggataattttaaattatctgtctttgtgttctctgattcttatatttgattaaatctgctgttaaagttctccattgactttttcagttcagacattatattttttagtttcagaatttctatttttttataatttttatctccttgttgaacttctcatattgctcacttattgttttcctgattttatttagtaatctataagttatgtttctaaatgattatttctaaatgattacctacaatgaagaatctgactccatatcaaggtactttctatactctgccgtattaaaatgtattgcctagcttgtagttcaaatggatattttcactcatgctaaactttgtaatattatttactgttcatttggaaaatattttttacttaattattacagtcttccaaatatagcatatttcatattacactagttggtagttttatgtcataaaattacattggctaatagcatcaccaatctcatcagagaattttttttacacattgtaatgctttcaagctcaaggtgaatgatacaagtattcttaaattgtaatttttgtttaaaatcttgaatttttattatttttaaaaatctactactgtcagctgtttacatgaatagcagcattattttgttaattttgaagaaaatattaggcaaattcccaattgttaaatgacagtttgtctgtcatccatcctttccagtaacaatgtcattagatgaaaaaaacagatatgttagtttgcaattcaaacaatctcatgattgcttattttaggcaaccattatatttacgtatgtagcagaagttctttgggcatgctctccgtttcatctcacagaattttcaaaaggtacatgttgttgctgcttacgttatttttactgggaggtgaagaatttaatgatcactagtatagtttgctgccaactggatttctctaagaggccagcaacttacctaccattgattttacatcatcagtacaaatgtcaactctgtgacaaaggcaaatatcttagttttgctttgaaactagttgagaaactctacaataatccatcaaaacttctttgcttggttctacttgaaaccatatgcctatgttattgagctaaagtaaaattgttttctcacagtcctagtagacttacaggttaagcccatgactttgaccctgagtgcacaaaaggactaatttagaagaatgtgttgcattaattgtgattatactctttgccttcaaacttaaaccaaatcatataggaagccagatgtcaaagaagcattctatcattgcttcaagtttatatatggtaacaaactatgtattgagaaagtatctttctgatcatatgccattaagtctgagtagaaataagaagcaagattaaataacagaaccaaaaaaaaacccccagtttattatgaaaataaaatagtatcaaagtagtcttacaacttttctagttttatccctcttacagactcagtctgaattggtgagtttattgccctatagaaaacttcatggttatatgaggaaaagtgaattctggattaccagttcatattgcttaatcaagatctgataaagctcttcaacctggtgctttttgtcaaacatatctgattttactgtattttaaattaaatttaaaatgttttagacacataaatgcacttttaaaattgtgtctagtataattttagtaacattttttatttaaatattctccagaaacttcttggaacagttaagtgaatgagtaagaaagagataggagaaaacacacacacacacacacacacacacacacacacacacacacacaacttctaaacatgtttggaaacctcaggtggaatccactctgaggggtatcagccataacaaacatgttaatatatcactgttcacctcatgatggtttcgaaaatttcctttttttgaatatgcagatttgggctagtcagctcaatggtacatttattagcatgtaagtttaagtcattgttttattacttatccttattacactacatgactcattaaagttataggcattctaggaagttagagagacatgtgagctcaaaactggatgtagacctaaacaactacctgagagcacagaaaataaaaactagagatggggaaaagaaaggcaactaatttactgcatacatacaaaatattaaaatggcattttttaatgttataattaaaatagtttttttggtgtttctgtgacattttattagggtttttctgaccataagtgacagaaatgcaaaccctactagttcatcaaaaatagatatgtaatgaagattgttcttttctcttagtattgatgagaagaattcccttggtgatttcacagaaaaagtaagccaagaaaagagtagtgatgtagctaggcatcaggcattctctctctctctctctctctctctctctctctcctgtttttctgttcatattagcttcattcttttctcacagcagtgcaactttccccaaatggtggaaatatgacctccaagatttccatctctagtaacatgactcttttgaacagatgtacaaatgtcagggaaggaactcatttgcctttggtcagatgaatgctctgtagccacgcagaataatgataagaggtcggagtaagggcagtccctgcttgaactatatggactgagtacaaggtgtcaacagtccccaaataaagaggggttattgtagctgaggaagggatggatactaggcagacaaaatataagtttgcactacagagattcattgttacaagattttaaaaatcaggtcaattaagttattataaattatagttataagatgtatccatgctgaataaaaattaaatccattactaggccaactgccagctgaggaaaacaaaacacaaaaagatgctatgattgtgagcctagcaaagctttgcatgtaaattaattagtatttattaatgttaaagcaaaaaagataagaatattaatctcctaacagcaaagaatatttgatgaacagcagactattttcaaattagattgctgaatatttcatttgtccttgtatataacaaatggagtaggatgtgaccttttttttatttaactttaatgttattttggaaataaaaattatcatggggaaatgtataggctatttcattcttaaagtacaaagcatatctcatactcaaaatatagtatttcatttttctgcacatttctctagataatatttttaagactgtagtttgacagcttactaataggttggtgcaaaagtgattgccattacttttaatggcaaaaactgcaatcacttttgcaacaacttaataactagtcttgaatcaattatttaaatttactatgcctcagtttcctaacataaaaaaacgggcttaataatccaatccaaaaaaattaaaatttttgaattaggtgatttaaggaaaacgtttggaactaagataattaaaaagctgttcttattcatatagttgtactctgaccattcagactagtgtatagagatggaatggagatgcttttaatgttcttattcatatagttgtactctgaccattcagactagtgtatagagatggaatggagatgcttttaattataaataggacatataaaatttaaaagttggataatgttatggactgaatgtttatgtccccaaaattcatatgtggaagccctaacttccaatgtcactgtatttggagatggaacctttgaaaagtaattaggttattagggcaggaccttggtctgatggggctagtggccttatgagaagaggcaccacagtgcttgttcactttctctcttctcacgtgcacaccaaaaaaaaaaaaaaaaaaaaaaggcgtgtgagcatgcagcaacaaggaagagagtcctcacgtccgcacctgagcagccatgctggcaccctgatcttggatttccagtttccagaactgtgagaaaataaatttatgttttctatggtattttattatggcagttgaagcagactaagacagatgcaaattagaggtttacatagaaaaaaaaaaagaatgatttgaaatggtaaacataacagtgttgtcagcttccatcccaataaatatgtcactaaccacattttattccaccatccactcctactatggtggagtaggataagaatggattagtaataagtaaagctgtttgatctacattagtaaaaatagcctcacctcataggaaaaaaatggaaaaagattcacatgtttatacctataacagtgctacttaaattgttctattgttagctttaatatgtaaaatacaggtggttgttaaaaccatataaaaacctgaatttaaaatgttttttaaagctaaaatgtcaggtcataaaatacaccgtatttggtgtccttcttgtgtgtgtttttcgttatcttgttctcaatgaaattccctcaaatgctccttagaggcaggtttgcttgcagcagggtccatgatgtgagaggactgtaactcaattttctgatttaatagtgcagtgttattcaagcatgaaattacctattcatggagagcaatcccctttgcctggcaagtcaaggctcaaaaacttgatgtctactgtgattacagctgttgacccaaccaattgttgctagaatcagagttaagtttttctgtatgccccactgaggaaaatatgtctctgtgaacagctaaaaggtgaaaataggtatgtagctctccttagaatcacagcactatgtgattaacatgctgggttaaaaagaaccaaatataattatagcacaaatggaaagtatattgtttgaacttttaggttcagggatacttgaaaagtgtatttatttaattgacattcggtttaaacaagtttcttttaacaaaaattctaccaggtttaagaattacagaggaggcaaagtccaactcagctttgtctgtgaccatctgctctataggaaacaatgaaaaacaatttgattttcctcattaacctaatcaaacaccataagtgcagttgtttagcattgcaacctctgaagtatgaaaattcaaatagtgcaaacttgtccaggagtaattttgagccagaaattttaactacatatgtaattgtattttttcctagtaatcacttcaaaaaaggaaacaggtgaacctaattttaataatttatttttaatttatccaatatatcaaaaacatgattgctttcaacacttaacaaaaacatgtctgatgagatactttatattcttttattcatactaaatctttgaaatctggtgtgtatcttatacttaatggacatctcaatttgaaatagtcatatttcaaatgctcaatagccacatgcttctatcatattggactgtgcaaatctaccatccttaacatcgtaaaatattctctctgaactcaagggttttcagaacctttaagtggcaaacactggagatgtgaaatgattgagaagaacaaacaaggctgcctgctctaatgaggtgttttcagtatgataaggctatctaaaaaataagttttctttttttatgcaatgggaaaagtcacaaatattctctcacacacacatttgcacgcgcacgcacgcacacacacaccacttaaatttttggctcactgacttctcttttcctgagcagagtaatggattaagaagtttagatgtatttagactttagactagacaactacaatttcagatgaaagaaaagagcttggaaagctgcacttggaagcaagaaaattgtcattttcggatgagatttaacagagagtgataggagagactgaaaacatcaactgtaggaagagaaattcagaggggtaacattttattgtgcggtatgaatgtaatcaacctgagtaatccactccatagtttttggtaaagtttaaaccacttttcaacttggagagatgcttaactgatgatggttttctgaaaataacgtgatacctatgaaacgggaaaagttcccttatccccctcacagggcgtgcagtggggtgtggctcgcttcttcggtgccccaccactcaaaaccccttgggagagcaggcagatgggcaagttgtggggcttcgaccccacggcagtgtctaggggtgaatgttacagctcctgaggccccagtgggcgtgtgttaccatgtgcccttttagtttagccaaccgctgttggctgtgtttatcagctcagttagaccccccgccttacagcaagcacagagggctttctgtatcccagggtttcttgccttggtgtaccagaagaatcggatcacatgtgggcttggagaatgagtgcaaggttttattgactggaggtagctctcagcagatgggggaagccagaaaggagatggagtgggaaaggtggttttcccctggagtcgggctgctcagcagccaggctctcctccaaccgccccggggcaaactgcgcatcatttcaccagtcatggcttgacggtgcctttcagtgtgctctcaggccggtgcgtttctctccacgtccagccacttatcttcttctgtcagtgtgttcctctccatgtccagccgcttgtgtgcctgcccgctagggtctcggggtttttataggcacaggatgggggtgtgacaggccagggtgagaaatccaacatctgggtgcgaagccaggagtgcgtcctcacctaggtctgcgggtccaggcccgggggtggaaccctacccagggacccgcccttctcctcccagctcttccctgccccactcctgtatcacctacatggaccatgaagtcagccaggtttatttgggttatatttacattcacatggattgaatgacatatatatatatatatttaacagcattatgaaataaagtaacttgtccgtttgtgtgtgcaaacaaacatggtgtaaaacttcaggtttatctttataaattttttttatctttgttagccagcaattaggtccatttttatagatgtttctggtaatttgtttgttttagtcacatacatgaaatttttagaaatattatttaagttatttaaaggctgatcttgaaggacaaaggttttcagagtaaaaatctaaaagttttaaggttgttatcttgtgatttacttaaggcttatgtgtagcttgaaaaagatgttaaaatctctttgctgtcaagagctagtttcaatattttagaagcacatgacttaaaaatctgcactaataattctcattcacaacattgaaagttgggatttgttgagttctttaaattggctataagttccatttcttgagtaaaaagctattgaaaaaaataattagaatagttagagtaaatgtcacataaattaaaacattttgactaaactattagtgtgtgtttgtgtgtcagatcaacatagtcatgtgtttcttagcaaggaactattcacatatgttttgcttctgctcaggataagagtacaaatccctctggctctttctgaacaattacaacaaataattttatttgaaaatatttcataaataatttataattgttatacacacaaatattatatgtgtttattcttatgattcacttcaactttatctggcaatctcaaatgataactgatatctctagctgcttagttttttattcttgttaaatagaactcatggactcaggtttgcagacatccaagttgtgttgttcagttgcatctccagaattaggtcatctctccttggggggcagtagatggcctccctcagaactaaccagtctgcagttttgtttcctgaagaaccgtgaccatgacgaaacatcacttgaatgttgaaagtttttatttctctgtaacttttctccagcagcctgattacctccagattcctggcctgatcagtgacagccttgtcctgacagaggctgatgaaacacaccaccatgtcccaagaaactcttgattcagtgctgcaccctagtaccatagcaataataactcatgtaatttacctcctcttattgcttgagagtgaatgtcaaaagtttactttgctttctaatgtttataggtaatacgtgtgagcaagcttcttgggttttaataccagctccacctctgactatctatactgttttgggaaaattacctagcctccctaacctcaatttccaagtctgtaaaatgggaataataatagcagcctattttggaggattactgtgaatattagatgagttgagggcaagatgtgttaattcctgtaaaccaagttgaataggacctggcaaatggtaagcaaccaatagataccagttattattaccatcgtaagataagtgtatttttgcagcagtggctctagactgcacagcagaatcacccaatgaaaattttaaaaatcaagctacttgtgtcccagcctaaacttactgaattagaacctcaagaggtaagtctcatcatgtgttttttttcttttaaagttccaaagatgattctgatattgcagccaagtttaagtcttactgctgcaagaagatattataattctaattggtgtccagtttttattaattacaagttaatcatatactaacactgaccattctgtgctttattgactctagaccattattcagtgtcattattaatgtagatatctcaaatgagaggttgagaccaatttttttcctatgccatttacatgccatttttaaaaagtagagttgggaagaagagcccaccgggttgaagtttaactatgaaaatacagtgtagacagaaagggaaacctagattttagttcagccttagagtgaacagtcatttcctggggaattgttggtgaaaggttgaatttacatgaaccagatggtaaatctgaattttgttgtatctttgtttcccccagtatttccactgcccctttagagcacagttgcactacagtcagggtaaactttttcaggtttgccccaatattgttattagctaagatttattaaaggccctctgttttaggggcttcatatgattttatctcaataatgccacgaactaggaactaattaatatcatcattttacctataaggaggctgaagtcagagagattaagcaacttgcctaaagctgcaaagtttataagtagtgtagccaggatatcagcctggactctagagctgtattttttttttttttttactttaagttctgagattcatgtacagaacgtacaggtttgttacatagatatacatatgccatggtggtttgctgcacccatcaacccatcatctaggttttaagccccacgtgcattaggtatttgtcctaatgctttccctcccccttgccttccatcccctgacaggtcctgatgtgtgatgttcctctccctctgtccatgtgttctcaagagagcagtattcttaaccactgctctgtactgctgcctcccacaactgcagctcttcagcccatcccacttgagaataaatacatcatcttaaagatgactattttgggtaaacacaaatattcttcctctgggcatttctttctctctccggacttttgtcttctgctgcaggttttggccactactctaccttcattaaatttgcttttcttagcatttcaagttacagtgctattaaaaacagtttttcattttcttttaaaaatgtaccgtgggagaaatgcagccatctttccttcggggctctttcttttagacatgattaaacaatccacatcaataaatgactcaaccgggtgaaacagagaattcctaagaaaccataaatctcacaagtttcaaaggctgctacccatttcacattgttcagatgaaatatatcaccctaaattcaactttaatcatattattctgattgtctttgctccttatacttcagattttcaacactttggtctttttaatttttggtccatcctttgtttagtgcaaggccttccacacatataggagctcagagcttctttgtggtaattaaaaatgagcctcttcaaattttgaaaaaaaaaatattagctatggggcttaaatgaactactctgtctcaggtttcaaacaattggatagtgatattttccaaacaccctgcacagccaagcacttgcagtgaagtgattttgccactggggagcatctattctggtgccccaacccctgctcatggtaccagaaccctaactccattctgcagaactgtactgctcctattcatagatctatgattaggataatattgacccacccaagctagaaacagaaactgtgaagtccagtcttttgttcaacttaattgcatcaggcctgggcctgtgagtcagttcaaaccaatgagacattgcaaatatttgctggtgtcttttgggtaaaaagcttttctttccactgagacctatgaacacaatgttacctctttacttctggacattgaaatacaagattgtaaagcctagaactgttgcagctatttctgataaaaagagaaaagtcagtcttagaaatgatctgatactcaaaaaaaaaaaacaactctcatgaattacgtgtgagaattcagatcaaaccatagtcagagaactctgggctttttaattcctttttatgcttaaggctgcatcatctgtgatttttggctacatacaacataaagagttcaaattatatttcaagagagaaacagaagagttcatgcttgaattgtaagtgttcatagaagttcttttatttgttttctttaattttttattaatctactggtgttggtcataccaaagacacagagaagtgaaataattagctattcatagattcagaggcagcataaagatagaaataaaaagcaagctgtaacaaaatttaattcctgtttaaaggctttgattcaatcaacatgatcattaatatgtatttgaaagcgtaggtgattctaaaaggaagctactaccggtcactgttaagtgagtttgttttcagttgtataaactttgtgataattataaattcaaccatgtttcaatagtcacaatataattatagatttggactttcacaatcaaaagctctttggttgctctttgaattcatatttccaagaattgggttctactaaaattatcatttcatgacctctttgttgaatgccctttggcaatatctttgctaggtggtcatatatcctatgcttaagcatcatgggttctaatcttgattggtttttactattattatatgtgtccttactctcaagagatgaatcatctgattgctatctcattccctaagtgccatatagaaattatgtgtacacatgaaagccttttcgatgttcaaagatgtcctttataacttttatttatttttaaattatcttcaatatcttctcaggataaattcccccaacatccttaagttatttgattttttaaaaagtgccaggcagaggttgcggtgagccgagatcacgtcattgcactccagcctgggcaacaagagtgaaactccatctcaaaagaaaaagaaaaaagaaagaaagaaatgtctcttaagacattttctttaagccaaaaacatgaatgacagtaaaatatataaaagaaaggtggataagggaccagaaactttcattatttgtagataatatgtttctccaaacaaagaagcccaaagaagcctagggcaatgaccacgcattgtattccaggtggtaaaggatggacttttcaatcaactgagctcataaagttgactttccctattccaaaagagtctgttagaagaaaataaatgagtacatctacctcacgtgatacacatagtcaattccagatgattaaagacttcaaagtaagaagtagaacactaaaattattattaatatatttaggagaatgttttatcatttcaggataaaaaagaaaaatttttaaagaactcagaagagaacataagctttgaagtaaaagactgatattttaaattaatttaaaattaagcacatctattcattggacagcatccagttaaaaaaaaaataaaaagaacactagccataaataagcagaagatatgtgtagcatatataactgatgacagattaatccagaacatacaaagtctagtaagtaattcttaaaagacattgatctagtataaaagtatctagataacagaaacacaaatggtcaacaaatatatgaaaagaagcttaacttcattgaaatcacagaaatgcaactaaaaaccgtaataaaccccattttatattcatcagattcacacaaattaaaaaagaaaaaaatagcaagtgttggcaaggatgcaaatcaatagatattcccagacataacattgaagaaaaaacagcagcagatatatacatgtaagataaattacatttttaagaaattacctttttaagaaattaaaaaggtaaaatgattttacatgttgtttaggagtacatgcatatgtattcaaagtagatacaatgcatagaaaaaacacatttaattcagagcagtgagtaactattgagacggtgagatggggtgagagagaaggaatgccatcagaataagttaccagcaggtttaattgtacctcacatgctttaaatcttttattttctttttctttgttgttttttgttttgttttgttttgtttttgcttggtgacttttttattgtggtaaagtatatacaacataaaatttactattttggtcattttatgtgtacaattcagtggcattaggtacattcataatgattgtgttttcaatagttaaagtaagttttttccccttatggatgtgactaccatcctggaacagaaaatttgggtggacaaggcactgaaaatgattgtaacttctttaacttacagggaacaagacttggagtccctgcaagtaccctataaggggtacttgcagcatataacctttctggctgaaattacagaacagaatataaatgttattaactttttgaaaaaataaaaagtaaaatgacccagtaacaaattagaatatgggtaggagggaactgaagggtcaaggacttaataaggttatcttacaaagtggagaattaagatatactgtctatggttgttgtaatacaaaatagaggtttagatgtgctacctaaaaatatacaaatacagttactagagtaatatagccttagtattataaatatatcagaaaaaggagtaggatctaactaagctaaatctagcatagcagaatttcagtggttaatgctgacttttccaacaaaaatatatgtatatgttcaaatggagaagtaagaacagaaagaggtcgaagtgcttgcatctaaggagctggactcagggtggggaacttgatcaggaaattgtggcttttaatgataatttcttctgtttttttttaagtaacatgcttgtattctttgattaaaaataatcatcatggtatgtttagaaaactgattctgttctgctctgaatgtttctctcagatttatatctaaattttaattatttattattgacagtagtatacctattatagtattactgtaaaaaatggaatgcaagaagaaaggggaagcattttaagtctaggaagtagaataaaatatgctgcaaaaaatgttttaggtttagtattccttgaaatataattcaatcttgatgttcaagagaatttttgactgtatcagtctttgtatataatcaaacagagcacaaaatgggtacactcaaccttaggaaacttgaggtttagtaaattttccttttgtaatatcttaccaaaaatggttgtgttaattttttatgttcatgcaatttacttccaagacaaggtggttaacgagggttttgtagttgtttgacagtggaagctaaacaagatatgtctcagtggagtaattattgcttatgtatgtattagaatttatctattagtaaaaaaacagtcttataattatgtcataaaatttgattagggacataaaactggagattgtaatactattagagtgcagggaatctgcaattttctaaaaatctaattttggaatgtgtctcttttggatactaaatacagaattttttggccctagggtaagtaatcttttatctgaactctttcttgaattttctaagacttataataatcaaggtttggattgaaagcataataaattattcagagatgcattatatccttgattttataattaccgagcaagaattccagagatatgcacagttgcatgttccatatagactcctcagaaatcataccttcaacataagtaaaataacttccactagtaatttatttattttttgtgagggatggggggattaattcttaaatattaaggcattaaagtttctacaaattgttatccctgtaagatttcattttaggagtcatgaagatatattgggtagtaaacataaaattatattttgtctttgcatattcaagtcagtcctctaagtgtgattgtcatttaacttatgtaatgcataatttttcttatctctttcgagataagaaaagaatttcaatagaattactgcattaactatggagatggggtggtgattaaggggaatatcccaccaaagatatgaactgtggtctggtaagagtatggcaagaggaatagaagaaatgccactacattacttttaatgcatttcccatgaagattgtcttagtctgtttgtaaagctataacaaaatatcatagactaatttataaataacagaaatttatttctcacctttggaacttgggaagttgaagatcaaggtgctgtcaggttcaatgtcttgtgaaggtcctggtctccactttcaagatggcagcttgttgctgcattatctggaagagaggaatgctatgtcctcacatggcagaaggtagaagggcaagagggccaagtattgtgtgaagtctcttttatcagagccttaatcccattcacaagggaggagccctcatacctgatcacctcttacacacctcacctcttgctactatcacattggccattaaattttaacacctgaattttggagaggacacattctgactatggcagagattaagctgtaaaacttgactaacatacatgatgagacagttcatctattaagatttattttgaactgaagaggctttgggaactagcctagaaaatgtatatcttatataattttgtttttccaagaaaatgcaattctattttacaacaattaaaagaactttaagaaaatacttttggaatattatcagttcctacatttgaagtctctttatatgtatatgtgtgtgtagtcacatcaagtggtatatataatatgctttgtattagtttgtaagagctattatcaagttcagctagccaactgaagaaattgtggtcagcctacaaagagttgtcatgtgtattaataatgtaatctgaatgactgcagagtgatgaaattatactgttagtagttaataaagacaatagaaagtcttccatgaatgtgtattcatgacagcatgagagaataattctgtctagttacactttgaaatcctggcatgtcatagaagctttgtttgatttgttgctgttgctttcttgacagaaattcaatttagggagaaactctgagaccaacgcatctcttacctgttttgtgaagcatggcattgaatactgtcttatacctattagcaatcatggcaagaagacattagtaacgatgacacacatgcatagcatcaccttcttactttatttaaagtgtcatgcgattgggccccttagataactgtttcaaacaggtttagacaattttgcagtttaaacatacagaggctaccaaaaccactgaccataaaatgttgttctttagatcacattttttaaaaagtatccttggttatctcctcttttcaaaggcttcctttatcttcattttgttttgataatggtaagagttaattctaaatgtttttgccataagcatgtgtgtttgggaattctttgctttttacttacagaacaggcatctaattgagcaagtatgtcccaaaagatagatatgtgtctggcagtgcttgcccttcacctaagtccttgttccattagagtgactattattgacagacagcaccatctttgattcttccttgatgcttcaagactcagcaagagtcacctaattttattattgctgtttacaatttgtcccttgacaattacatttttacaactaagacacattgatgaagataactttctggcatttatactgcttaccctttgatttaattcaatccaaaatacttttgtgaaacacctactttgtgcctggctgcaggcaaggttgctctctgtctagcaggggagaaaaataactatattatagaagaataatgcagacatatgtaagatgttaatggagtgtctactgtggaaaagataaaaacttttgctttcatgggaaggggctagattggggtattcaggaaaacccctgtaaggtaatatttgatctagattttgaaagatatatgtattttaattacatatagtaagtactgtatgttccctgatgaagttctatttttcagggaatgctgctgcacttagcgtccttgagatcacacttctacttttggattagtagaaacatgaatggaggtagcattttttaaggcacatattcttaagtggacactttacagattatgattatgactctcagtatcctctttctttagccatgggccagggagccagggtaacttaaaacaatataggaaaataatacattagaaggctggagaaaatttaggagattttacttgttatctgatggctaacaccaagatccaagctttcttcactatgaagattttataagcatatatttattaatctcccatctttcaccaccatgacactctgttaaaaaatattaagaagctttgtttatgtttaggtccagtctcttttgatatcccaaacaggctaaaatcatatacttcagcatttcagcatatgtaacaattatccaaaatgactaccatcggtgattccaaggtaactgtgcatcaagttatctcagggaaattaataaaaacacagaattctgagcctaacattggatgtttcgctgcaataggtctgggctaggaaaatataataaggatttttaatatgtaatttcggtgaatctgattcagtcattttatgaaatggggcctggaagccgttaatctagattttatacacctgctaacgaaaatatacttttgaaagttccagtctgtacttgtgttttcgggggctataactggcccccaagcagaagtatcccagaatgtaaaacttattgtaacccagtgtgaggcatggggaggagggagatacaaattaataaaattcattttgagcactcataaccagttagccattttcgccttgagcaaccctggcagaaaattatgggagaataaatgtgagtgttttgtattcctcttattcaattccaattctcttttcatgtttaacatctggatgattaataacttattaatattctgcaataggaagctctcaatttatcagtgttgaaagccttactgtcaagctgtcagaattggcatccccagttgtaacagaattgtctttcctatgaactgtctcatgtcacattttctctctctccatatagatagaaagatagatagatacatagatagatttttaatgacaatttttttcactataaaacctcctcctagtcatgtaattcctttcaaagtcattcagacaagaagtctggaggctctccctaactcctgatttccagggaacccccaattcatccattccacctccagtcttccctgtatcagcaaatgacaactccttgcacctggtgctttggagaaaattccaggagtctttcttgattcttttctttgatttataccacaccctcaatttccactacatgaaagccctattcatccagctctataatgtagcctgaattaattcacttctcttcctttcctgtaacaaatcactgccattgccattgcaccgttgtctacctacaatccattatttatgcagtaacaagaggagactatataaaaactaagtggaatggggtcactccttcaatagtgattctccaataggttcaaattgctttaaataagatgcaaaatcttcaccttacctactacgccatcaatctctgacttctgcccacctctttaactatatctctggtttcacattcccacaagcccattttgatccaaacacacaggccataattctgttctttggactttgggactcattcactctggaccattgccatcctttctctgacacattttatcctggactgcctcctcattaataaagtctaagttcaaacatcaaccatcgttcactgatcagcctaactgtggtgctaccattctattctctctctcaatatattaccctatttaagtgtttcatagaacttattttttaattgtatagtgatttaatccaagtttttccctctaaaatataagatgtgtctgtcttattactatatttctaaatctagagaagtcccttatatactgtaggtatgcaataaatattaactgaataaataaaataatacatttcaaggcacgataacttgaattatttattttcatttttccaatttaaaagttcctgaattatgagaggactttaatattttttaagactcacaattattctaacaattctccttttcccagttgaatctcaccacattccatcttccacagagttgccaaagttaaatttctaaaccaataaggtgatggaccttttaccattctccaaatccataagataaagtcaaaagtcctgagcaatgtctaaaggctttttataatttattctccatctgtatttttagcttcattttctgcctcttccctttgtactctactatctaaccacataaaacttgagtagtctcagacatatcatgttatgttgtgatccatgccttcgccagtactagtatattattccttttgaagttcacttcaagtgtcagttctcccctcttcattgagagttagctgttttcacaagtctctgtcttagtgtttaatacagcatatggtaattatttatttatatgctgtgttagccctgatggctaacatagtgtgctcagcatatgtcccatatgtgtaaattgaatgagtgatggatgaatgggtggatgggtggatgggtagatgaatatatgaaagatgtcttctactaattcataatcatcgggtgaataggatcctttcccattcatctgagtgttcccttgatactgggctttaaacatggtaaagactttatattacttattaagggagtggataaaataactgtacttatttatccactgtactgtaataaaagtacttattaagagagtggctaaagtaatggtattcacatacttttacctaaagaagcattatctttgtcttaaaaagttttttatttctgtgtgttttccacctgtgttctctaactgtggaactagtagccactagttattcgagggtactgagcaattgaaatgttgctagtccaagccaaagtgtgctgtaagtataaaatatatacatttagtagaaaaaaagattgtaaattagctaggcaataacttaacatgaattatatattgaaatgttaataatttgggtatattgtcacatagacactgtattagttcattttcatgctgctgataaagacatacccaagactggacaacttacaaaagaaagaggtttgttggacttacatttccatatggctggggaggcctcacaatcatggaggaaggcaaggaggagcaagtcacatcttatgcagatgctggcaggcaaagagagagctctttcaggggaactcccatttttaaaaccatcagatctcgtgagactcattcactatcatgagaacagcacagtaaagaccctccctataattcagtcacctccctctggattccaaaagataatttatttttaattttggaataggtccaaactttagtatcagaaaaaaaattctctagttttctttgtttagacttcagctttatttaaatgttttactttgcattgtattttatttacaggctctgacatacatgttttgaaacaattatgattttccttttattattattattattattattttaagatagagtctggctctgtcacccaggtgggagtgcagtggtgcgatctcggctcactgcaagcttcacctcccgggttcactccattctcccgcctcagcctcctaagtagctgggattacaggcgcccgccaccacgcccggctaatttttctattttttttatagtagagacggggtttcaccatattagccaggatggtctcgacctcctgaccttgtgatccgcccgcctcggcctcccaaagtgctgggattacaggcatgagcaactgagcccggccctaatttttattatttttgtaggaaaaattttgtttttgaaatcatatatatatagagagagagatatatctagagagaaagagacaaatacacttttttttcttttagttgaaagttgtggttttaaaagaatctgcttacttacaaatatttacctagtaaacattctaggtttggaatcacagttatctaggggtacaagaggaacgggggtcgggcgcggtggctcacgcctgtaaacctagcactttgggaggccaaagcaggtggatcagctgaaggcaggagttcgagaccagcctgaccaacttagggaaaccctgtctctactaaaaatacaaaaacattagccgggtgtggtggtgggtgcctgtaatcccagctactcaggaggctgaggcaggagaattgcttgaaccttgcagtgagccgagattgccccactgcattccagcctgggtgacagagggagactctgtctcaaaaaacaacaacaacaaaaaaaaaaaacaggaaggggatttgagaggttaaggaataagtctaaggtcaagaacatggtcgtttcaccatgcatttcaccgtgcaaatcagcaatcaggatttatttatcaaatttgatcatctttctcatctctgatatcatgccctgttctagagctttactactttttaccatgataatttcaacaatctcctgttatccttctctccattgttgtctgcattaaatccatgttccacactgctaccagagatgattaaatatttataatttaaaactatcactttcctaagtgagagcctttgttaatcactaactatgaccccattaaatacagggataaagtctaaatccctagctaaggtgtacgtatccctgtgtaattgaaatctggctacctccaatgtcgtgtcttgtttgatgcctcccctacctcctgctacatgttctaacaccaatcttgtcttcctcattctcatctccataacctgctcttctccacttgcctttgctgtctccttttgttgctctcctattaataatctgttgaattatgtatcatttccgtacccaattttattatgaatctgtttattataaattacccaacaagactgcttgttctgtaaggcagagatcttgccttattctctgtggcttgttttcctcatcagaaaaatgagaatgactcattacttacattgtaggaggagtgagttaatacatgtgcctggcaaataatcagtggtcattaaatgttatatcacttaacataattattgtaattatccatattaatagtaatttgttaagcactcagtaatgtgtatatagtaaataaagatcaggtgattaattatatttaggatcccaggaaaaagggacagggaagaactgagttgaattaagaaggaaaaaattcaaaaagcaagcttgagaccagaagtctctaactggaactactgattcctctgccctggtctaaacctttatcattcagttagcttacatgctaactgtctcctgaggagtcatttttcatatattcattgcaagttccctcagagagcatagtattagatgatgtcgcataggacaaaggcaacatatgtggctttggaataggacttttcaatgtaccctcttcagcattatcctgatttacttcctgtaattctgcactgctaatttggctcttttctatttcaataataaatacctaggggatttttttaagcaactaagaaggatgttatcaatttttcataagttccagttagatcaaagaggaaatctatcatgtagttggtaaaaacaaaattaaccaaaaggtcattccagaaaaagctgtaaaaagagcaagaaaaatatcatatcacttaattggttatgatttaagtaattaacttgttctttttgtctggcactaatgatattcagtaagcataatatattgttataaaacagacctagttcttgtttttttgagtcattatgagaaaagcagaacttagagtcagaaaactaatctgcatattgcatttgtatacaaataaatatattttacataaaaataaatgtaaaatcacttcatacatattgctgctaatatgtaatgtagtgtgtgaaatctaatattaggtaatagttactgagaatctattttttcctatgtaattgtcataatgatctggagctcaggttgtttcctggagtcatgcagtggcagaaccacaaaattcaacagagatctgtttgaccctggaatctgatatctgaagcactgccttgtcttattttaatcacgttttgcgtgtctgtgtgtgtgtgtgtgtgtgtgtgtgtgtgtgtgtgtgtgtgtgtagctaattgaacttttatgcctagaacagtgctggtctaacattagataaggatcatatacttttattacctcaaatgcccataagtatcatatttttataatcacttatcatacttcagctacccaatctctgaaagtatatatattttaatcctgtagaatatttttataatgagatccatgtctgtattaccttcattgaagcacaaagaagtagaaattctttttatttcaattaattttgtctctgtcctgctgcaagagatacctacaataatggtatttaaggattcagtaagtaggtctgtatttcccatttacaatttctgtatggctttataaacattgaagacatcccttctaaactgccctaattccagatcaaagactcatcttcagtgtttttggttagaacaacaaaaacaggaagaattatatttttcttaaaaaaaaaggtgtttgttaaagttcagggaaaaaagagaaagagtaccaataaatgagagcaagtgatgtttccaactagataaaatgagaatatccaaatccttcttaaaagcaaatttaattaaatctgaggatacagtggggttttgtggtggtggtcgtggttgacctatttttaggtcacaaatctcagtggagaatgtaatgaaagctaaggattttttcttccaagcaaaatgcttgcatgcaaataaatacaaacttttttcatgatatttcagggaatagggcccaaaggatggaccttaggttaataacttctgactgaatctataaattaggattcactttactgaattgaattcagttttcactatctcctgctaatgattgtgtcttctaaagctataacatgttttactgctttaccacttgatgtctccacctatcatttacataatgctaatgctatttcatctctctaactctgctagacatttttttcattaaaagttttagaaaacatccagacttttaagaattgtcccacatgcctactacgttatttgaacattgtctcagaggaattatttcatgttccctttttaaattgttaattgacaaattatcatgtatgtttttgtgaggtaaattgtgatctttgatatatgtacatatgtggaataattaaatcaatctaattaacatataaaccacctaaattacttgtcatgttttgtgataagaacatttcaaatttaatctcctagaaattctaaaatataccttatttaactatagtcaccatgctgtgcaacagatctcacaaaaactatccctcctgtctaattgcaactttgtagcatttgtctaacatgtccccttttccaccacctctcagcctctggaaaccactgttctcctctctgagtttgaatgttttagattccactcataagtaagatcatgtggtatttgtctttctgtggcttgctaatttcactagcataatgtcctccagattcatgttgtcacaaatgacagaattaatttattttttaggtctgaatagtattccattgtatatttataccacattttccttatccactcatccattgatggacactttgttcgatatcatatattaactgttgtgaatagtgatgcagtgaataagggaaagagatatctcttcagcatgctaatttcgaatcttttggatatatacccagaagtgggattgctggattatatggtagttctatatgtagcttttgagaaacctttatacagtttctcataatggctgtactaatgtacattccctccaatgagaaaaatatgccttgaagccagaaagatcctgacacagttaaggaactgaatgaaggccaatgtacctactcatataaattactgggagaatgtcagacaatgtggtttgacagaaaggcatggtccatattacacaaaacctacagggtcctatttaagagttgtatttcatttaaatataatgtgggacacttaatggtcttacactggagattgatatgatcataatttaatttttaaaataccattttgaaggggtttggaaaaatggaatggaactggcaaatatggtggcagataaaccatttaggagattgtttttctagttctgataagagaattatggtggttttagctaagaaagtatagtgatgatagataaaagaagatggaatcaagatatatttagggagtagatttgatagttgggaggtggacgcaatgttagaaatgactcttaggtgtctagcttaaataatttaatgaatgtatgtattattattagagatgttgaaaatacgaagagaggcaggattggtagttcaattttggatatgttaactttgagatgcctgtgagacattcaagtggatatatctaatagttcagagtagaaactagggctttatatagaaatgtgtgagttttcaacatctacactcatgcattgcttaacagtgggaaatgtgtccttaggttattttgtcatgcaaacatcatagagtgtacttaccatatagcctattacacatctaggctatatggtatagcctattgctcccaggctacaaatctgtacagtgtgttactgtactgactacggtaggcaattgtaacgcagtcatatttgtgtatctaaacatatctacacatagaaaaaggtacagtaggcctggcgcagtggctcacacctgtaatctcagcactttggaaggccgaggtgggcagatcacctgaggtcgggagttccagaccagcctgaccaacatggaaaaaccctgtctctactaaaaatacaaaaaattagccaggcatggtgatgcatgcctgtaattccagctacttgggaggctgagtcaggataatcgattgaacccgggaggcagattttgcagtgagccaagattgcaccattgcactccagcctgggcaacaagagcgaaactccatctccaaaaaaaaaaaaaaaaaaaaaaaaaagaaaagaaaagaaaagaaagaaaaaggtacagtaaaaatgcagcattaaaatcatatgagaccactatcctatatacagtttgtccttgatggaaacatcgttatgcagtgcatgactgtaaatggcatttaaagttatggtcctagataagatatcccaagaagtgagtatgaaagtggaaaacagaaattcaatattagccttgaagaggtttaaagcatgggtcaagaaagacaaaacaaaaaagtaaactaagaagaaatgagggtaggtcatttcccacagagaaagggtaggtcaagaaggctgtgagaaaggagtggtaatctgtgagatatgtaccaaagaaaaaactaaaaatattgtccattgagtttggaaaattgcatctttggtgatacactctccaaagaaactttactagcatattaagttgagaagccagattgaattgtgttggaaagagaatgagaagaagtggagacaggaagtgtaggcaacttttcaagaatctttgttctgaatgtgtacaaaatgttttgtggcaggggtgcagggggtagggggtagcgttttgaagaaattcaatcaggcatttttttttttgagacggagtcttgctctatcgcccaggctggagtccaatggcgaaatctcggctcacttcaacctctgcctcctgggttaaagcgattctcctacctcagcccccgagtagctgagattacaggtgctcgccaccacgcccggctaacttttgtatttttagtagagacaaggtttcaccgtatttgtcaggctggtctcgaactcctgacctcagatgatccacccgcctcagcctcccaaagtgctgggattacaagcgtgagccactgtgcccagcccaggcaatttaaatgtacattcttcttacctttctctctcttcctcttgcttctttttcttcctattctttttctccttttctttctcctcctcctatcccttttcctcaccttctcttctcctcccactttcctttctccttcctctccctgttcccctccttcttccccccatccttcttctccttctaaggcaatggatactaaagcaagtttaaatgcctagagaaataatctggtggaataaaaggaggttgccagtgaaggtaatataatcccttaatacaatgtttttttttttcagacttgtgcattttttttcactttgatacacacattttattaatctcaatggtagaaatagaataggatcgatctcaaagtgttatctggccttaaaatatacagaaaatgtaacattcatttgggatgtggaaatcaaaggactgagttagtgtttgaagatcacttttagaatttgacttaaaaaggaagagtggctatatttgccttaaagatgaagtatgaacttaggaaaaaaggaagtcaggtttttgttcatttgtccatttgtttttgagaaggttctggctctgtcacccaggctggagtgtagtggcacaagctcagctcactgcaacctccacccccaacctcagcctcagtggctggactactggtgcatgccacaacaccccgctaatttttgtatcttttgtagatatggggttttgccatgttgcccaggctggtcttgaactcctgggctcaagcagtatgcttgccccagcctcccaaattgctgggattacaagtatgagccactctgcccagcccagttttctttatattgaagttaaggtggtcaaatgactttgaatttgaaagtaaatgttgcagacagactaatggaaagcagattgtacatatgaatttataaaccatatttatgaagtcagttccaagttaatataacagatatctggaagatagcagattagaaaataaaaaggactagatgggtatgaagaatgagtaagagagacagaagagaatcctgcttagagagtgaaaaaaaaaaaacggaatagacacaggcagacaatatgattttggatgtgtatatcacaagaggagatggtggctgaaactaaagcttggaagccatttttctgaaagaagggagtgggaaatcatgtttttataacaagatagataatgcttcaataacaggattgatgagacgaataaatatttattcattattgttaattttgtatttacctaaaatcaattctcatgttagaatttattcataattatctgataagagttagagtaatagtcattctcacgtacttctcttcatctgttctgctcctcagtatttttcttcttaactacacaaacttttcattgtattctcatttaaacaattttgacatcaacttttccagatctctttctgaggtccacctgcctactagaatattccactaacgtcattataaaactcaccaatgatgtaatgaattattgataaattatcataattgatgataattgataaatttcacttgtgaatccactgtaagatcctttctcagtgactaactctaccattgtctgctcactaacacgaggcaccaatagtcaatcctttcctctttctgacaaccaataaccaatccttcatcaaatgctgtccagtcttcctctttgttctaagcttgtattgaatccaaatggattttccatctccttggtttccaccctcatttattacatgttatattaaaacattctacctagtgatccacctttgcttgttgtactattgttgtatttgcctctcattctcattcccttcttatttaaacaacatcattccagttcataattaggggaaccagcctttccctattgatatggtttggctctgggtcgccatccaaatctcaccttgattgtaataatccccacgtgttaagggtgggatcaggtggagataattgaatcatggaggtggtttttcccctgatgttctcatgatagtgagtgagttctcatgagatctgatggttttataaggctcttcccccttcactcagcacttcttcttcctgccgccatgtgtgaagaaggacatgtttgcttctccttctgccataattgtaagtttcccaagacctcctcagccctgtggaactgagtaaattaaacctcttgcctttataaattactcggtctcaggcagttatttatagcagtgtgagaacagactaatacacctattatcagtgtgtgtaattggagtggacttgtgctggctgtacccttaagagcagtctgtttccctagcacaatgctggattcacagatgacatgaataagatgatctatgacagcactcactcaaactttgattttggctgttggggaaaacaatatttttcagaggtattgctgagctgtgtagtatatgtaagccaaaagtttctggtggttaattctgcaaccatatttgaagagaaaagtcaacatagaagaaaatcaaacctagatgagaagacaggcacttgacagcattgtttgcacacatggatccagctgtgtacagagctctcactctcccttgactttggaagttatatgcgccaataatttccccttttatgcctgaactaatttgaactgaatctctgtcatatgtagccaaaatttttaatataccacttctatatgttgaccttccaatctagtttttactgccaccagacaaatatttctaacatagaaacctggttatcaaacccctcttgctttatttgcataatagagcccttgggataaacacagtgcctcactgtgacctgacagataccttcatgatctaacctttgacctacctttccaactttgtctcttggcactctccctccaccacatttgtccactcattcttctaagtattcttatatttaatttgctctgcctgaaatgtctttcttttccagccaataggtagtaactatttgctctcctttactcatcaggttttatgtttaaaacccttcttcgtatccggtagctcttggtacattcctttatgagaccccataggatttatttctctttctttcatttaaacttccataaagagaagaattttttttctgaatctccagctcttaccagatcatttggtctattaataaatgtttacttaatgaatgcttggaggagcaaatgaataacaatctttaaaaggctaaaataataaatttacagtgccttttcaatgggagcaggttagaatattttgctgtgcttcagaagccttgctcatttaaccttaggcatcagagtctcaagttttagggaaaacgaactcttatacattttgtagttagaataaattttaaaatatttatatgaaaaaagattatattttagaaatataaaacaaattaaataataattattttacatttgatattttctttaccatttgttaacttacattacagtgaatgtaggcatctttcttacatattttatttttgatatatacacacatatccttttgagcttcctgtacaacacatcttatgtgtagtaatgtctaaaatattaatgctttatttaggtttgaaaactccccaggaagatttgacatttaagattagattcagagtgtattatcatgaacattgacagctgagagtgtgactgaagggtctttgtccttacaaactaaaagcctatttatagtgcttaatgaaacactagaaagccattttccttacatgtttctatatacatcattctctacaaaaacttgattggttgtgagtatttttatttaacaaaatttaagacgttggtgaagatgtagttgttttatagatcccattttctcaatacgaagcaaatttcttgttaattttttattgattataacaaattatgaatgtgaaatgtacatggcttgcactcgaaaaatgcttcagatattgcccatctttttattaaaatgagattaaatcaagatggtctaaaatattataagtttacttttctttgttcttaatttaagacaagttagaactttcaaatgaaccactttacatagatttatattcatgcccatctgtctgcatataataattaagaaaaaatattaaaatgattcattttccctactttaaaattattttaaaaggcaaacacttcatttactttcatttctctctctctttttttttttttttttttttttttgagacagggtctttctctgttacccaggcacaagtgcagtggcatgattatagctcattgcctcaaaatcctgggcacagcctcccaggtaactaggactggaggcatggaccaccacatcaagctatttttttttttttatttttttagagatggggtcttgctgtgttgcccaggcttgtctcaaacctttgacttcaagtaatccttccgccgcagcttccaaaagcactaagataacaggctgagccacctcactagcctcatttctctttttattaaactactcaagttgcttcttacaaaaagacttttatattctctattattggggatttaaaaaatataccctatcatttgccttacctcttatgaatgggattcctgaagaacatgacaaataacaaataaaatgtaaactccagattccagcaatgaaattctcattattttgtatataattcacatttaacttcttattttgaaacatatgaatgagcaaagtactatttctggaggggactacatctggccattcatttagaaacctgcctaatgtgtttgaagggaaaataaaattgtgtaaattagtggaaagaaaggttatcaacaacatttttttaagtttatgttttaactttatgtatcatatgttctattctaatttacatactttttgttttgaatgacatcaaatgatgttatatacatcttctggcacttgttagcctcatgagttttatagaccatgctgacgttgttgatccccttatgtatacaaagctttggaaatatttatcaaaaaaggaaaaaatcttcactgaggaattagcattccagtgacatgagaattatgcaatgttaagattaaaataattttcttttttcatgagtaatgcatgcttatagttataaaaagaaaataaattaaaactgcatggaagtatataaagtgggaagtaaaatgaaaaatatgctgtcctcacaaaacatattttaagatgtattttcaaaagagtgtgtgtgaacagaatttatatgcacttaatcacctctggacttagtttagcaatctacgcagttgtccggaatgagatctaggtaagcagtaagggtctaggaggcttaaatgacaggaaaagatcaggattatcttctgcaagatatccaacaagcctatacttgtgagatcatgaggacatttcagtttccaggagaccaatatatcacattagctttggattgatatcagattccaggaaataataatatcaatttgacaaaacagctagtcaataaaagggcaaatatgtagttaagtgaacccagagaatggtctgactttcatcagtttctcagcagtgagcctgagcattaacattcaatcagtgttacatttactgtttcctcaaaggctttgaacaggtgattccctatatatcctagaatcagcctttgacagagatgtgacagtaactacatttcctcagtctccaaaccctccttctctcctgactcttggcctgtgaacattctcccattgtttcagccatctaaagaggcaaacaaacctacatacaagaaatatgccctcccttcacctccaatcctcctccagatgttgtactattcctcaccttttcttaagagccattgtctttcaaagagtgattgtctttattcactcatttccaatttattactctacccactgtaatctggtacttgttttccaaaatcattattggtgctcctctcccaagtgtcacagagggcctccatgttgggaaatccagcaggcctttcagtctttctcttactgtgtacttctgactaagcctccatcaaatcactttatcttgaatcttagccatattttctcagcattacgtttcaagctcctccataagttcctcttttgcctttcataccttaaacattagtattcattttagatacacatttcttatctattatgcctaattttgtgaacaattgtctgttgattttccattatctgtctaaacatttgactaattccagagcttcaaagtcaaacattttatcttttgtatgacatattgtcttgcatctaaccaagtcagagtgtgccctacagttatgcctaagtgctctcttttgactctcccatatcggttcctcattgggtatctcttatctctattaattataattgaaaatctggagtaatctcaactcctctgtatctttcaccagagttcaaaattaatcaccaagaatctaatatctcttaaatgttttcttaatttttatatgcttcctagcctattttaataatgatgataaataagaactattttaataatattagctaacatttattgagtactgactacaatgcaggcactgtgacaagtgctttacatgtattcattcatttgatctcccctacattcttatgaggtaggtgttattagtgattacattttaaaggtaaggaaattagtcaaaagatgaataagtcactttaccaatcttctaccccaagtaaattagagtcaagatttgaattcaggcaaatctggtgccaagcctgccttttaatctccttacctttctccattttcacaatcttaccattcttcaatcctaaatgtacatgtaaatctttctacccatattattttcaagcaatattcatactatctggaaaacacattaatagtatattgtgcatcactggcatgcctcaagttctgtttttaatttcaaaggtgtcttacaaattcaccacttcagctctttgtttatgatgaagtaataacttaccaacccaatcctgctccagttgagcagtcttcagaaggcatgggccaggggtactttttgggaatggaactattaaagtaccagaatatctttgtgatatctagcccttaatgtgccatggttaggtcctattccctgatgaagaatgccagtctccacctgggaagtgatcattcctagcagacattatgatttgcagaagctttaagggctgaagccttcagtctatggacatatatgacctcagatgcctgatgcacagaaacagggagaccctcagcagggagcaacctaatttccggtaaatgaagaataaggacacatatcatatatatcatatataacttccagggcagatccaggtgtgttgtgcctcatacttaaactaattggggatattctttaagaagactaataaaaactctgaatataaaattagatacagggtaccaaatgggctatgcaagcaatgggccctaatgattgagattccttggctttatggacatctacctctgtccacttcaatgagtactagaatcatgttgacgcaatttccctcatgagtaaatgttcccatatattccaagtacaaattttatccatgagccataaatgaaatatttggatgtgtagtaaaagaaaagcttaaagtcatttgtagagattagaaagtagagaaagaacctgtaaatagatgttaagattagtaaaaatcttggaattcaaaagactgaagagaaattagttattctgatgacataccaaagaactaatcgcctgcttttcagtatattcattctcagcaattctaaagtcatgttctactaggtcttaagctcttaaattaatttcctgactttctgttcattttcacttcaaatcttaaaaatacatgtgcacatatgcatacacacatatttctgaagaaaagaaaagttattttaacttacatatttatattatgaacttgggatagaagctgttaaaatcttgatcttgtacaaattttttttatcatgggtttattattttgcaatgccagtaataaagcaagttgtcataaaagtagtcaacagtgaatcatcttataacaatcaagggagtaggtgatacttattaaatcctagtttttaaagacattatgctaagaaggcccattgtttataacatttaattaatgaaagattgcagaagtttgtaaagtttaaataagacacttgtgctttagtttctggcccaaatacttgtcctaattctccagactgtcacctttttgttttagatgagcgcaaagaaataatggcattttatagacagaccaaattaaattatattaatttgtttactcacattttaagcacatagtgcactggggcttagaaagataaaggaatcattttctctggactccaaaagcttctaataggtttttaccacttaccaatatattaaccaattctttccacctgccagaatattctagtaataaaatgcacaaattagtattgtcagtcaattaacttagctttcttgaatacaggctgttacagtacttgttgatgcaaacagaaaaatgcaaaaatgagagcctgctttccttatcatacgaataattattaatagaaatagtaatgtttatttttcattgttatatcatgtatattgtattagacaataataatttttaaagtgaatgatcctcaccactgtgttcaaagccagcatctattattattagaattcttatttgaataactccttgacttagtaattcaactaattacattgttttgttttgcaggtagatatttcttttgactgttggcttgaggttgattttgttccctaaaattagaatctgtaattatagactaatgtaacatttgagatctaagacagcagtgatcttgaatttgtaataatttgacaatcacaagtgcagtaggttctccttagagaatgaaaggcaattctatttgaggcttctagtaacagattccaaagacaacttgttcctttctgcaggatatggaaaaaggagttagagttcagatactaaccctattcattactcttgaaatcttccttctgacatggaaattctcttttagagcacagcaattgacattcaaatgaagtttgttcttttcctcaatgaaaacattacttgtttatcttattatgaaaattcatttgttttaccgttcattaatgtttgaaatggggcacagagtaggctttcctttttcccaagacaccacaccactgtaattctcaaagagaaatggtggaaccaccccaacatttctccaaaatagttttcatttcttttatagttgcttgaattccagctctatttgttatattaggaaaaacttaaaatgctatgggtgggtgcatttttctagcatttcagaaaatgcaccttttaaaaaatatttttttctcaccatttattctttacataccattgttccatttctgcctgctctttttgcacaatttacaggttgatccactctccttaggaaagaaagcattgggtattttgtctacagatcctatgtaagaagtcttactgaaatcaaataatctagataaaatttaaattcctaaaagaaagttataatatcttccacaattaataatacaaattattagccaatgaggcagatctttgaaatgtttccctacttttcctcatgagtactattttattttcattgaaactatattctgatcagccaatatcatgaaagataaagaggcttttataagaaaactgaatagaccttaacagaaaataaaacaaagtaccttatattattttaatccctaaaattattgttgataaaacacagaatgaattttgacctggcctattccttttgtttttaatctgttatttgtttcataaaaggtgaactgtgtagaacctttgcattttatgggtacatttcccctacagtagctcctagacaccctgaagaggcaaggtcagtgattggagaattcagagacttgaattctggtcaaagcacagcctctagctatttataatacttttgtcacattattttccctgtttgtgatgcactttccccatatgttacctcctcaatcagggacgggttgaggatttatgcatgagttcatggagtaagttggattcgaaagagaagcatcattgaagtggtacctgtgattggtgtcaacaaaagagagacaaactttttcttttttaattctgctttatttcaaaaggatttaaggacaatataagctatgctgtttaaataaataatgaagtagaataaattaagaaaaaaatgccagctctagttcagagttcacgtgtagcaagacaggaatacttgatttaaacatgtaacttctatttattaaaccaaaaattatagctcttggttaaattatttgaagatagaatctgggatttctttagcatataaaactataaaagggtccacctttaggtatgtaatcaagtggtcttaaatcttcaatatgattttaaaggagaaacctattattttgatattcaatttatttttcagcccttttcatagaatacagatgtgaaattatttaataatacaattaaataaacacacaccatgtttcatacagctaaatgtaagagatagcagtaacatataagggcttctggatagatactgtatctatttgggagtgattaagttcactattacttttcactatgttattgtagatggaaagctgatccactttgttgaaatttattatttattttcttttttctttttcttttttttttttttttttttgagacagagttttgctcttgctgcccaggctagagtgcaatggcaggatctcagctcactgcaacctccgcctcctgggttcaagcgattctcctgcctcagcctcctgagtagcagggattacagatatgtgccaccatgtctggctaattttctatttttagtagagacagggtttctccctgttggtcagactggtctcgaataaatttagtatttcacttttaataaatcatttggaaattatcttatctcaggtaaaagtatttgtcacctgggattttcattcttcagtggtaatagctgctcttaactaacattacattgaaattaaagatagctatatttaacattttgatattgattgcagtcagtaaggcatgatattttatattacatttagcaattacaactgaagctcagggcatttatgaggtgttcatgatgggaagggaggagttgacatatggagattactttgacttcagttattcattgcacttcagaaaatgcttagtaataaggtcattcttcagaattttaggaaaaaaagaagtttacattatttatttatttatttgtatagcgtatgtgtgtagacagatagaaatagagaaaattataaaagccctttataaaagagtatataccttatgatatcatggcaaaataattatgtggtgataaaaagcaaataagtcgttgattcataggacagaaaatttcttgtgaagaaatgtagctatgataaatcttcacattttaataggagtttaggttacacaagtgtaagcatttatcaaaacttaggaaatacacatttaagctatgtgcatttcatggtatataaattttacataaaaatactgaaacagaaatcaaactctagttaataaagcacacgtcaaaatttagggaggagtgtgcctatactctgataagcataaaacattcgatggatcagaatgaataaaggggctcacaagaaaaaaacatgctaaaatagctaggaaagcaaagaaaaaaagctacaagggagaattcgtcttgctggatattaaaagatagtataaagttttataattaaaataatgccatagaggagcatggatagacaaaatgaatgaaatagaaaatatacagataaatacaaaaataaatggaggtttaatatatgataaaaatgacaaatcactcttctaacactaataactgatgctgaaacaactggtttatcatttgataaaagatataatttgacacaaatctcacatcagaagaaaagaataagctgcacataaatcagcattctaatgtttttgaaaaaattatctaaattcctcttaaccttggtggaaggaaatgctctctgtctgtggtgatactgcacatgcaacagaagaaaatattgatacatacaacattttatgtagcaaagcaataagttaaatgaaaagacaaacgtcaaactgatagaaaatatttccagatatgtcgcagatggagtgctaatatcactataaagatctctaaaaaattgatagggttcaaagcaagacaagcaaataaacaaaaaccctccaacacaataatgaatgaaagactagaaaggacattcacaacacacatggagagatagatagatagatagatagatagatagatagatagatagatgacagatagatagatgatagatagatagatagatagatagatagatagatacagagactgagagactgagagaaaattgacgtttcacacattcaaagatgtttgacttcattcttaatttttaaaaatgcaagttaaaactgtactgagatacgtttattcacctagcagtttgctgaaaactttaaagtatgataacacgttctgcttgcaagtctatgggaaaaccaaaactgttcacacattgatgatgtgaaagtaaactgcaacaacccttgtagtgagagatttggcaatacctaataaaactgtatatgaatttacctttcattcagcaatttaatttctaggaatttaccctcaagatacagctccaagtatgtgaaaaaatacatgcacaagatatatgttaaaggaaatagttatcaatagatgacgtaggtacaggagaaaaacttcttcgccctcttgaaggtttgctgaaaatcacagacaaagggagattaacaggaaagaaaaggcatacagttttattttatcatagttttacgtgatatggaagccttcaggataaaagcccaaagatacaggggaagtttgtccatttttatgcttagattcaacaaagtatgaacagctgtgtagaatatgactggacagaaaggggtacgatataatgccaatacactgagtggggaaacacaacaaaggctgtctgtctagatttttacctctctgtgcaacagtccttccttatgggtgtggggcaggaccctctccagaatggggatcttatgatctgtagttaaacaatgtaggtcaaatattttcttgatggacaatttttacacaaaaagttaaagggtggggagttagaggaatatttttaggttttgtgactggctttggggaaacggggttctgtttattatgacccaccttggaaaagagggattctggctagccttgggggagaatgaatgaacagagacaggagggcaggagaaggtcagagaaaatcttttattatgaagcctttgttttggtgtatcgttttctgagctccaataatgatgtaactagtgagtgaaattttgataaaaattgaaaagtttacaaattctcaccttaagtgatcaaagttaacattagtaatggcacaaatcacattctctgtcaacttctatgatgcactaaatacacagtatcacttctcttgcattcttgtcaaaaaatgcttccctgaatgtaatgatgtgtaaataccagacaaatctctcttcctcccaaaatgatgttcctattattgtcatttataacaatgattgtacttaatgagaataaaatacaaagagaaaaaacaatgtatttattctttaaaactgtgcatggagaaatatgcaagaagagaaatttatgatgcatataatcttttaattgacacttaatttagcagcaattaaaccttgcgattactatttaatattttttaaattttattttagtaggtaaaacaacatgatttctctgctttaattttttaacttatttcacacacaaaactgatattaattgttcttgttgatggatttaaaatgtttttgtaaatataacaagtagtatttaagtttttatgccgcaagaacaaagttgttccttgaaacatttctttagtgtcagaaattcatgatattcaatttcagagtattattaaataccatttatattgattttatatttattggcattagtatatagtgctatatagttaacaaagatagaaataaatggaaacagtatctattctcacaaagcccccatttttgctgtatgcagagagacgctcctcattgaccctgctcaaataaagtgcaattatctgcatgactttctgctccacttcatctaaagatgcaactgttcctctggcaacagaacatatcatctctcgtagtcagggtgatttaaggacttctaggctcagtacattcatgcagagtgatccagtgtgtgtactgcacaaagacaccagctgaagaaatgagtgggtgcactctgctgatgatgtggggaggggctgtctcactgagaaaagggtgactttttctggatacaaaggcttcatttgcttttaggtttgtgatagcaggactccactggctacctggggcacatttttctttttttctttttttttattatactttaagttttagggtacatgtgcataacgtgcaggttagttacatatgtatacatgtgccatgttggtgtgctgcacccagtaactcgttatttaacattaggtatatctcctaatgctatccctcccccctccccccaccccacaacaggccccagagtgtgatgttccccttcctgtgtccatgtgttctcattgtttaattcccacctatgagtgagaacatgcggtgtttggttttttgtccttgcgatagtttgctgagaatgatggtttccagtttcatccatgtccctacgaaggacatgaactcatccttttttgtggctgcatactattccagggtgtttatgtgtacctggggcacatttttctaatcacacaaaaataggctggttgtggccttcattctagcttaacccatttcccgtttgcacctgcagtactcaccagtggcgcttgtggctgtagcgtttaccctgagataactttgccacgaaatatctcacttttattattatatttgcatggctctagtatattgactttggaaacaatagacatcattctatttattgaattctgtttttagtagtggtatttccatttacaaaatatggtaattctcaatcactgtaaatgtcaaatcctagaaaacatagcagtcctacgtgtgatgttaacattgttctcaaacagtttgctggctgaagattcatttgatgaatccaatttttctgaaatagatgattcttatgattcagatgattctgatgttagttctgtttagaaataactccaagaacagtttttatatttcattttcccattaaaaatcagtcagatttgcctcagcctcaaagagcgtgtttatgtaaaattaaatgagcgctggcagagatctacactttttttttccccctaaatgggaaagggttaataagcccatttttacatcttaattgaccctatctctttaggttactgctttggtcctgagctctagttcccacgttgcactgtgatccatgaactgattctgtgtcctgcacttttgtatgaatatcttgctgcagcaaaatcagaagccctgtttctccatgagggaattattttctctgggactgtgatctatttctgaaatcgtcccctggatgtggtccctgctattgttactgaaacactagaggtttgctgtaggacctgctgctcaccttgcagaaagccaatgactgagaagattaatattgccaaggaagaaggctttaattgggtgttgccaccaaggagctcagtctcaaatctatttccctaactgactaaaactaggggtttttatagaagggaagaaatataacaatgtatgagaaaacaggaactagggaggagtaaggaagcaagcatgatgaatgaggggtctggaatctcattttcaggatgtggtgatctggtgagtttcagttctttgatgcttttttttgagaggcttgaaggtcctttcctgaggaaggaatttagataaaacaaatataagtttcaagctttaagatcagaaaggtcaatttctatgtttatcaaatggaacagttgatgggactatttgggtcagtttcactacctgctaccaaactctacaaataccatcaatttatctgttagtatctcttcattgtgcttgttgctgtatacccggggcaagcctcttgtcctttgccaacactgggctgttcttaatgtagtgtttttcttggcacttcagttctgttgcattcttgaccaaaaaaaagaaaaaaaaatgcttctctgaatgtaatgatgtgtaaacaccggacacatctctcttccttccagtcatagcttatcctaatttactctggatacagagcttcaattgacaatttgactttcgttatcaataactacatctttcttcaagattgtatggcccatagccaacgtatgtttagtatatactaattctcaaaacttttgctgagtatgtaattttatatatatatataattttaaaaattctatgggtgaaaagtctcattagaagaatcctaagaggaaatggatcttttcagagaatctttcatattttgcactgaaaacagtagttacactaccatcaggaattttccacacacttcagaatgacttcaacctctcagtgagtttaattgcccaatatcctatttatataagaaggaaaggcgaataaatatataaaatttactgggagatgaggagagggaatagttgaatgccaatggagaaaattaggatttctgagaggaagtgtgacttgaggcctatcttgggtaatatacgtgagttctgcatgaaagaaagcattccagatagaaggcattctacagctagaaagagttaaaagcatgagagggctttgttccctgaagaaacattgatatgttcaacattgctgaagagttgaaaggcaacagtgaaaggaaaagataacatgaggtgaagctgatccagatcctgtgaagcctttagactttatcattaggaaggaagagtcatcaaaaacatttgaataaaggagtggatgttttagatttgcgtttttgtctgccatgaggagaatatattttgaggatcaagaatactccacagatgcactatactgattccatgcaataatttaagggcttgttgattcatgatgtcagcatcaccattgtaatgtcaacatcaaagtttctggctttgaacttgggtggatggtggtttcattgtctcagagaggtaaaaaacatgagcccctgagtggtcagttgactgggataagaccataaatgagagcagaagcaaagcccagaccagagtccagacctgctgataataaaatccagtgttattattactaacaaaagtaaaaatttaacttatgaattgcaggaggaagtttgctgcaaagtcactttaattacagttatcacaggcaataaacttatttattccaggcaactaattgttaactacttccaatagcatgaaagaattatattcagaggttacataaagggaacaattccaaaaattcctgttccaaaacaacaaaggccacaacatttacttggtgttcttttacttttattatcatttatttccaaaattcaagagagttcttcacaatagaaagaatataaaacttgcttgcataatactgtaggttatctccctcatttttacgtgctagataaacagggtgttttaaaattattgacattgtagaaataactccaatggtaatatatgattgttatttatttaatagaaattatattcatgacattttatttttaaaaataacttagacatcagcctagtgtaccctctctgttaaagtccagatgaggtccactgaaaccccagaagaattatctatggatgttcagagagccatgcaagatttattcagttctctggtagacttaagtgttttgtgactgcttttgttactgctttctctgctcctcacagttcaatccagatactaaatttggcttttttctcacattaatgacattgccatgacattgctaatataatgcatttattaataggctaaatgcagtggacaataagagaggaggtgggcttgtattgcaagattgtagtgaaacctgaactttagacaaaactcatttttagatttcctccagctatcacaccaccactgaggagctcactggcctttttagcttcacatcatttgacttgctcctttcctcatcatagtctctttttactcctttctttagttttccctaccttaagcccctaccctcctggaataaagcaaatattccccttatctcattcaaagcagctatttcctcggtttcctggcaatacatacctccttaaaagaaattcttcctgtcaaaggcaatttctttcataagtgggttgccagtgctagttgctaaaataataatgtgtttactttcttaaataacctatctgtggttatgatttaaagacatgggggcctcttcaaagcactcaccttagaagaactcatgtttctattgatgatgttgctcttatagatggattttgttttgttttgtttttattttgggttgctctttcattactactctggtgaggcacttaatttattcaaaaatggtaaagaagttttattattttaaagaacttcaattagcacttttattttaaagaacttcagttagacttttcaaaacaagtctataaggggtgactatttgactattccttttgaagttctatttctacagttttagtaaaaaccacaaggtgcagtggaagataaaatgtctttcctcaccaatagtgttgaattcactgggccatatgctattaggttggtgcaaaagtaatcgcagtttttgccattactttcaatggcaaaaactgtgattacttttgcaccaacctaatatctaacctattttgtttggttttatttttgtatagatttttaaaaattcaaataagaaaattatggctatatacaataaaaaagcaccatgtaataaatttacatatatgttatactatattctaggcactggcctactttacatttactgcctcttgtctcacaactctgtgaggtagatattattattcccattttacaaccaaagaaactgaagcacagagagttaaaacaaaagagagagagagagagagagaagcccagtctaactctaggcttatgctgccctggatcatctcagataacattccaattataacaatgctgaaatgtaattggtgagttgatctaataattcatgcaatgcctgcctcactgtgaagctttcactcattcaacctcttattaaatatattttgtgatatgaaaatacaactagtaaatatgtagtagcacatttacagcctctaaagttaatagtattgatcctgtcaatgttctgctctgttctgcttctctcatagtgtccataaatttattcccatttgttcccatttattcccagtgaaggttacttcactgtttttaaggcaccaggccttgatggacgttactgctttagactttaaaatcatcatcactctaataatcactgtagacttctttatatctaagtcctatttatttccattaaagtatactgcaacaaaaataacgtaccatctttatttaccatgtggcttagttaagatggtgatataactaccattgttatcagaaacactatctgaactagtaaaacactgtatcccatcaggaaataacttttgaaatcagattgcatgggtttgaaacccagctccactacatagaagcaagttacttaactgattggaacatcaggttctttatttatcaagtgggagcaatagtataattaggttgggtgcagtggctcaggcctgtaatactagcattttgggaagccgaggtgggcagattgcttgagctcaggagtttgagacaagcctgggcaacattgtgagactttgtcgctacaaaaaaaaaaaaaattacaaaaataagtcgggagtggtggcatgtgcctgtagtcccagctacttaggtggctgagtagaaggatgcttgagcccaggaggcggaggtggcagtgaatcaatatcttgccactgcactgcagcatgggtgacagagtgaccctgtctcaaaaaaaaaaaaaaaaaaaagaaaaagaaaagaaaaaaagtacaaatggttcataaggaatattgtaaggattatcttttctgttaacgccacaaaagaccaccagaataaactgatgaagaaggaaactgagtttatttcctgatcaccaccttagcagatgtcttagtagtcatagaaaggagaggccaaggtggatatttgtagacatagggaatctggacttaagtagtttaaggaaggtcttttaatgtattgtgtgaagtatgtaacataatagtttgggatgggtagacataataacgaagttctggaggttaattgataagcaaccagtttgtctagttaggcaatatataatagtcctatgaagcaggctgtttacccacgtgagcaacttaccctcctgagaatgaggctgtttgaacagtttattgtttgaatagatttatttcctagtagttcttgatgcatgaaatgaagttgtttatgacttttaagccttatcatagttctgataggtaatctgtgtggttgctggaagtctcagttctgaacaaatggcatgatccatataaaacacacagcacaatacctgctatataattagtatatccacaaatgttagccatttataactgcctcttgtgtatgatgtttcttaaatcagggcttgatagatgggagacctagcctaactctgacaagatgcaaaatttggtaaccagacagaacaatagagtggagaaagtggtcggggacggtcccagttgtgcttagtaggagggggtgcaagatggcagatagctcatggatggtcaggaggagggaagaagcagagatctaagcaagcaggcaaagtatgatcctctgggttcttccagctgaaaatattaaacagagattaaagtgagtaagctggaagatctaccagcaggccagataaatttaggattaggagctacacatgatttaaaagagctgaaagggaaagaggcaggacccttactccatactgctacattggacaaacaggtaaagcttccctcaagcctagatggtctagtcaccagatctattactgaaattttttgggaaatagtgaatatgaaataaaagtttgaccacagaaattaaagataaaatacaagatattagaactgtgtcaatgatcagagtcctactagcagcatagctgacccaaataattttagagatcttatctataatattctgtacagtgcttcatattataagaatattataataataaattacattcatatcattccattataatttcatatgttctcctccaaacttctgcaatgtagatatcggagcagttttactctaatttaggtgatgacaaaactgaagcttagagagtttagtcacatattttaaatggcagaatggggaggaaactacaggttttccagacacagatcttgttccaatatgtccaaatagtaattatgttactgaggtttgaggggaatgtgttacaattggatgacttgcaaactcattttcatatactctttccctttcccttctctgtcttttgctcatttttggttatagaaaaaatcaattgaagatatgaaaaaaatgttttttaaaaaggtatttctacacttctatttcatcttgtaataatgcagagatatgactggggagttgatctgataattcatacaatatgactcctcattgcaaacctttcatccattcaaccccttattaacaatatttttgtgacatgcagaatgctagattctggagaggcagagataaataaggtgaaccttccttctgttctacttttaaagaatcccctagtctattggatttgatagatttattgtgaaagagtataaaaaagtaaaagattaaggcatgtagaaggtacaaggccagggaagggggccgtatattctaatatgggattagggaaaagtagagaaattccttggcttcctgttcctattttgtccagcaccgctatctcccacctgagattcctacgacatatttccaatggaagccaagaagtatgggagcgttggaagtacatcctgcccaatgaccctctcaccccatccccaccaataatcagaagaaaacagaagaagcaaataattgatctgatagcaaatacaccaaagatgagtacggcatctccctggattttaaaataaagatgtttggagcagatgaataccaatctgattttttaaaaaattgaattacccaagtaattatgacatagaaacttacttttggaagatttaacacattgtaaatataaaccaacacacagaaacccatgcaaaatttagtgcttcattttacttcaggccccaagctgctcaattattatgaaacaatcactttttggttgcccaagttttgtttgcatggatgcatgggagaacgatgaaatttctctctctgaatatgaatgttaatgattgggaaacatagaaaccacacataattctgcaattctcatagctcttaaaatatatagaggacttgcattgcaagtctttattttaattagtgttattaatattcattgactgaggtagtaaaaggcaaccactggctcaatgagcagcagtccaacaagtcatgcaaactccagtgttgacagcctttgtttggagtcctgaatggattgtgtctatctaaatcactgtgtaatcatggatcctttgtgatttcacattctcatcttatagtcaatttttatttctctgatgtggcatgttgtgttcagtagcttatctgaaaacatcaatatggttttgaaaggataaaatcaaattgtaacagtttatgtttctgtaatgtgtgcatagcctagggaaaaagtgataaataggaatactatttcactgtattgctatgttacagacattggaaatatgattctgcctccatattctttccaaagtagatcagctggatttattttttatatatttataaatcaacagctaatagaccatgagaacagcattagtgtacatccagatgacagaagagattgtaaaagaagtggagaagactttctgactttccctgctttcgtgacagtaaatattgtcttcttgcttttatatgacataaaggtaatcttcctacttttataagatataaacacacaaagagatgttaacctcatgcatcatattttaaaatgttggcataagcctaaaggttttacatgtttcaaagagtctatctttatggtaaagtacttgagtaaccattctcaactttggctacacatttgaacttccaaagagttttttaaaaatattttcacctgtagacacagtcagacactttaatcagaatttctgtgacagaagctctcacacctatagttttttgagctcatgagataattccaatgtccagccaagattaagagccacagatatattatcatagaattaaaaaaataaactttcacttccttgcaagtattacaaattcagcatgtcaatatagtgttaactgttgccatgataaagcttatgatttcactggaataccagatttcaggctcttgatttggacatcaaatattcctttcaaattgatgaaaattgctattgccatctgccacttttactctcaaagttaattacatatacattgtgctctacaataatgtcaattttgctaatcccatttagatgtttacataaaagaaaacaaataataacttcataagacatgttgctaaaagggttatttggtctaaatatacataatttcaattcaagctgacattttatgcttagttttaatgaagtgatcccagggaaattggtattttcctatctgatacaacgatatatatatttgaatgcaagattaaggcacattttaatatgctttatttgtttctaatttttccaattaatttttttacaattaatgtcatttaaaacttttgatatagcattataaaagaatctcaggcagaaatcattagtattactaaattatttttattgcattattattactactttaatatagtactgaaagaactatgcagcttgagacttgtattctgtgaaatgaaactttgaattagccaactttgaaagtcctttccagttccaccatgtggagattatgagctttactctgcagcatataccaaagaatgtctaccatacatttcagatgagacctttgagattgcctaccttaatcttattatgtaaaagatataaaaactgaggtgaaaagtggtgaaattatcctttttatatcacaaagaacaaattgtcttgtctcaagtagaatagattattagccaagttctatctatttgttttgttttaagtacttatccccacttccatcatttgttccttgttcatgttgttgttcttgtttgttttgaattgtttctggaaataacagtgagttaaaaactctgccagctttatatatatatatatatatgtaatattatatataacatgttagatattatttataatatatagtataacatatagtataaaggtttttttacacaaaactttaaatgcattttgttgtctaaacaaaagaaattattgtattcacatgtgttaagatgtgcagttttttcattttatgtgtctgaaattagcatgagtttttcaaacatggtcacagctgttcatatagccattgcttcatctagattatgtgtactctttgtactgcatgtattgagtttaattgtcattcactattttttcaaaaatattacattattgttcaatattagaacaaaaagttattgtctgaagagaacaagatatgaaagaacagcaagaattaaattttatatgattaaacaaagatttgttattgggggcatcattacaatcctacatttgcctgttaatcaacagctgactgatttatatggcttttttcttatcatgtcagccaaggaccaggaatgttggcaccaccaaggatggtattataaatgtagaatcatgagttcataccagatctactgaatcagaatctgcattttaacaagatccgcacataattcatttgcaccttaaactttaaaaagcaggactttatagtaccaaggaagatatccacaagaggttgacactgttttagatttcttgagttatatgctaaatgtttgtccctcatatgataagcaatactatttaaaggcaaagaaagcttaaatacatggaagaaacttcaaatctacaggaaaatgatgtgactgattcataagtcgagcataacaatattgatagaaatctaagtccaaattcatttaaaagctttttctgtaagctctatttaagtattaaatggactctagtgataagaaagcattgtgctataatttgaccacatttttttctttcataatagtagataaaatcatatcttcccacagatggaacattaactttggtaaaatacagacaataataccagttcattgtaccacaaattcatcagaaataatgaaaatcataactcttgcttatataaatatatgcatttaagataactagataaactgacatagaaaagaactaatttgtgtcactttaatagtacagaaggagtcttctttgctgaatgactttattcagctttattgaggtatatttgacaactaaaagttatatatacttaaggtatacaacttgatgttttgatacacataaacattgtgaaatgatcaagttaacacgtctgccagctcacatctttatgatttttttgatgtggtgagaactcttaagatcaatttcttagtatattttaactacagtatacaatacagtattattaattatagtcaccatgctgtgcattagatctccagaagttattcatcccccataactgaaccattttaccctttgatgaatgactgtttacacaggaagaagaggaagaattaattaaaatattagccctatttaatttttatgctacattaaataatgacagtggaagttttctctaagtaaacatgatagctacattaacagtaaactaattcattataattttgacacataaaatgaatataaaggtaacatttgtgagtggatttttttaatcacaaagtaaagcttggtagaaatactttaagatgctgtatcgaaatatctgcttttagtttgacattttaaatcatttaattgttggcatttcgtgtaacatacaaaaaatgttgattgaaaaaatcttttttaaaaaatgatgctgagtagactttattcactgtagtccttgagtgaagccactggttgttggcttttggactgcttttagcctgtttttctagttgtacttctttgaggaggatgatgatctttaccttactcttggctttgcatgctcaaagtgattaggtttttttaatgaggcaggagaatggaaatttgaggaaaatggtagagagaaccctctctcatttaccaagatgactttctaagtttatttagtgatgagctacttggagatacaagtcaaatgatgaagttcatagaaatcttttgaatcttgccaccagaaagagatgacaataaatccaactacttttcccatgccttacatttttattttcttatatgcacagtatcttttgtattatagatgcttaataaatctttttcaaataaatgtatgctggaaaatgttgtaattgaggtaaatggacatttttagctggctatattgcagaagactttattgggtaggtgatcttttagacggttttaaaaaataatgaagatcttaactggcacacaatcaagtatctgttatatgccttcatcttccacattttattgtatttttttcactcccttgtgaaggaaactaatttcaacaatgctgtatgtgtcatgcattaacccattcataattagcaagaggtatctgattcagtttatattatggtactaattatctagctcttcagaatattttacataaaaaaataacctcaggtgaataaacttctgtttctgctccagaaaccttttgacattttttaataatctgtaatcacgttgacttaaaatgacatgacagaaatgcctgaatgttgacgagttgatgggagcaacaaacatctgcctgttaaatttgggatcaccacctacagcactacacatatcattgatccaagtgtaccttgattgattgcttgaaaagaaaaatctggacttatttggatttataagcaaagtcaaaaacatttttcaaaatgttaagttctaaaagtagtaataatgatggtgtagccccttactaatcagtgtgctctggggaccagcagcctctaaatcatctgggagcttttcggaaatgcagaaacttcaccctagacctagtgaattagaatctgcatttgaataaatctccaggtgatgctgaaatgggaaaagttgccttctccctctcacacggcgtgtgatggggctgtggcttgcttcttcagtgcccctctgctcaaatctctagggcagtatatggacggacgggcaggttgtggggctccgaccccacagcagtgtttagggccctagtgggagcgtgctaccgtgtgctcttttaattttgccatctataggcagcttgtgttaaccagctcaattagaccctctaccttgtcactaccttgtcacaaggacagaggactttctgtatccggggttcttggcttggtgtaccggaagagtcacatcacacttgggcttggagaatgagtgcaaggttttattgagtggaggtagctctcagcagatgggggaagccagaaaggagatggagtgggaaggttttcccctggagtccagcacctcagcggcctgggctgtctcctctgactgccccagccaaattccgcctcctcccactggtcaatggcttgctggcttgccggtgcctgctggtgcatccctctccatgtctagccgtccgtgccttcctccgctgacttgctcctctccacacccagctgtctgtttcatccagctgtctgtgtcttctcgggcagatctgctcttctggacgtccagcagcttgtgtgtctgccttctagagtctgggggtggtggagcgggggtggttataggcacaggatggcaggccagggcggtcttgggaaatccaacatttgggcaggaaatgcctgtcctcacccagggtctgtaggggtggagccctagccagggaccacgccctcttctacccagcacttcccttcccttcttccctgtcatttaaagggaccacgctcttaccttcccagcacttccatatcagtgactgtgcacattacagtttgagaaatgctggtagtccattccctttcctgatctccaaaacatagggaaattttagaggccaggatgcatttagtagattctgaatctaaaggaaacctaaatcattccttggaagtagacattgtttatagcatcctcaaatggaattaaaagcatatatgactagatttagaacagaaaaatctgttttacatatttcaaaaccctttggacccttgtctgtttatgttcctatgacttcttgagttatacatttttattaacaaatgataaaattatattcactaaatgaactcatttgtacctgttttaccagtttcagaatgttattttatatttcttaggtttttcttagacttgtagaaatcatgctgctttgttccctgcaggagttaaaataaaaatattagtaattatgcatatttaattttcagaatgccaactgattactcacagcagttataaaagggaaatgattttagatattcataaaacatttccttagtaaggggctttcaagtctgaagttgtgttattatggatatttctttttaaaataatcaggataaaaaatgcatttattaagatccctcttcttttctctttttcagatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagaggtacaaactggttttttgtttttgtttttgtttttttgttttgttttgttttgtttttttgtattagaaagctttattatggccaaaaagataactaggcaatgatctatatttgcattataattttactagccctgccacagcctatcagattctcatcaagaacctcattaatgccaactctagaagcaaataactaattctttcactttctctcatgattctatatggttcttacctaaaatttcagccaaaatgactttcaaaaatatatcttttttccaactcaattgattatattattgagcattctcatatgattttatggatacttgacattaattaactaatgaaatctctattattttatatctaaggcagtaaatactgataggaattggccaccatttctgtgtgttgaatttccatcttggtagtatctctgctatttcttaaaacagtttcaaaaatttttcttataaattcttatacatgttacagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggtaagaatttatgtgttctgtctgcctgggttatgactgaacctcttaggacagttccagatgtccatcagaatttctcttccaagttgctatttttagaaggtttattttatagcttttcttaaaagcacgttttcccacttgcttgataaataagactgctgtattcatgctggacatagatagttgattaagaaatagtgaaataattcaaataataaaaacgtgttaaattactttttaggtgaaggaaataaatataatctaaaatagtataattgtgttataaagcacattttcaaagcacctttttgtgttctgacaaccaccctgtgaggtaggtactgtagatattcttatctataacttataatgaggaggaacaaagaagccacatctaacttgctcctgtcattggaagtgctgggaacaacaattcagctctttccagttctctgccagtgttctgtaaactacacgagcacccttagtcagtctagttcaaatccacctggaatgtcttaaaaatgcacacacacacatgcacacacacagcactgaaaaaattataattaaaaaaagaaacataagagcacagctataagaatatgtttaattatttcaacaatgtcaccttatacatacacattttgaaatctggaaaattgaataaataacacttatagaaattaagaatccttatacatacctgcaattccttctgttgttgatgaagtacaagcattttttagcaaatatttataaacactggtgataagagagtataatttctaaatacctagataactaacattgaatgccaactgatacaataacaaaacattacataacaccatacttgcatagtcatttcgtctatagtagaaaattccttctagaattgacatttttaattagacactcaagataggagctacttagtctgagctagtccagccacatcacttaaacagcaggatttggtacttgccaggaagatggatggaagctgtcagtaaaatgaagcacagcagttgaagaaagcagtaggaaccttttagtccatagagtgttgtacatggctaataacatttttccactctgtgtattgtacagtacccacaggacaatcagactggcaaagtaaaatgaacttaaaaatgaatttcctggcaaattttggtacattatgttgttttttttttccacatgtgtttcatattcaactgaatgagcttttaatgtttcaatacggtcatacataggctatttatttttttgatctaacaacataattgcactgtatttgcatatgatgaaccctattgtcttgacctgattataaagtttaaaactaccctaaatagacagtctgttcaagatttttagacctaatttcttctcctcacaagttaaatcattaaatctaataaaggaagtgagaaaaatgttgatttttctggggtccagagtcaccaagaaggttttccaaggctagaggagtcttgttgatcgcagataagttgaggctctggtcagttgtgtggaatataagacttcaattgaaaatgagtattggtgaaactggtgttacaaaacaagtatgaataatggacatttatgtgcttttcatatctagggatgattcagaagcttatttgtgtatttaccttctaccaaatatgaaaaaccaactctggtcttcagaattagctacaaccaatacaatttgagtaggcctgaacatttacttgtggaaatcacagaaggttggtcccataataaaataaatgaacaggcattagatcaagaattagagaaggcacaacatggattaaaagtgtacctaatgattttcccaaatgaaattttctaccatagaaagctaccattaagaacaccaacctttctcttactttaagaaaaatgggataggccaggtgcggtggctcacacctataatcccagcatttgggaggccaaggcaggtggatcacctgaggtcaggagttcgagaccaacctagccaacatggtgaaactctgtctctgctaaaaatacaaaaattagccaggtatgatggcaggcacgttgggaggctgaggcaggagaattgcttgaacctgggaggcagagtttgcactgatctgagatctccccactgcactccagcctgggtgacagggcaaggctctgtcaaaataaataaataaataaataaataaataaataaataaataaaacaccagagattaaagttgcttatctttccctatcttaagctatcatctagattatacatgtaaactcttaatttgaggacattttactcagaaatggtcatgaccctatcatctttcatcggaaacatttacttatactgacggattatgatttttgttgttgctgtttgttgatttctgtttgtttttcctagtaggtgttttctccatgaagatgttctcagaactctctaaactaacgtaccctacttgaaatgcaaactaccagatctaatttgccatcatcccttcttacctccctgaatgctatttcttttcaatggattatagctaaaatgatgcataatctcaaagcagctctactaatcatgctgtgggtggaggttttataaaaaatagaccctgctcatcttgctaagttagtacttagaatgcatttggaaataaacttgtttagatttcaaaagatagcataaagtaaactgtaaggaatatgtagtcaaaggaaataattccatggactaataggataaaatgaagctaaaggcatattaaagtaacaaaataattaaatttcctcatatcagctataatcagtttgaagaagataatgtaacattttaattatcatgtgtctataaattggttttaatttctctgcaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggtatgtagatcatatctcttgaagattatgtatatccccctaaaaattaaggaatattatagatttctgttctaatgtttaattatttaattgtatccttattattcaatatacatatacattatgacctttacataatcatataaggatcaatgacaatattaaatctaatttaaattagtataggcaaacttaagtattggcaaaaatgctaaatatcttttgaaagtttatgtattcttgtattcaaaatatatttactgtgaattttctatgtgacagaaatgtgctagccttgacacttcaagtaaatgtgtgtcttaccttaaagtatagatttataatagaaatgttctcaaaactgaaatagccaaaaatgttttggtaagtattctaaatataccacctttaaaaggttatcttccttatagattctataggtccatttggaaaatattaatgtattcaaaattatgaagggcttattatcccaaattacttcaaatactacttaagttgaaatcctgattagtaaaatatgcacttacttgtaataaaaaatatcatatacatctcgaattgtctgtataagcattacccactttattaacacaaaagtatcatcttcctacttaaacacattgtggacctcttacctgaaactaaaaatcgatttcctgaaaaatactttcggaagtattcactagtttagttctttaaagatgaatttggcaaatcatccttcctttggaacatgagagaaataccctaacattctagaaacatacactttaagtcctcacttagcattgtcaacaggttcttggaaactgcaactttaaacaaaataacaaaaacactgtcatcaatcttataatggaaggacattgaactaaaggatgttactcgaggaccttttgtttgtcatttcacttaaagttgcaacaacattaagtgaagacttactgtatgtaaaatccatgatctgaacaagaatgtctggtaacctactgaagggatgacttatctattgtcacctacttaattatataaagaattaattaaaattaaactctaaaaataggctaatggaagagaatggctaaaggtatttgttactgaacaattaaatattagggatgttaacttctaaagaagatctgttacatcaaagagaaaaataaaatgtgacttctaacatttgtataaagtcatgtaagttatcctgtcagtatttaaaatgtaacttagtagtcttaagtcttgtataatcttcaaattcaccaagtcttattgatacttacctttaacaaactgggaaaatatagtggctcatgttaccatcatttattagatattctattttcccaaattgttttcatttagtgttagctgatttttaaactttagattccgagtgaaaactatcagaatgcttgaccaatacacttacatatagataatgtttttattcatttgaaaatgctgtttataagaaggcatgtttatactcatttaaaaaaacacattggcaaaaaacatgctttatttatgttctcacagagtcaaacggaagataactaagaggtagccagcattcacagtaagaaattactgatctcattcataaaataaagatctatgtagaaatcaatcattattactcatctttcattaactaaaccaaaagatgaatcatctaacttcctatattttaaccataatttatgtggttgtattgcagtaatatgagatctgataaaatctcagtatattttgtttcctgcagtaacggcacatcattttattttctaacatgctgaggaagctgaagtgagagaaacagagaaacctcagtctttgctgaagtttctagatttttgtggcaaaaggttaattaattcatgggttcggttgtaacagcctgcaggtaattttcatcagcatagctgtaatgtgaacgttccttctacttgtaatctattgcttgaagatgtgatcatttttctcacattcatacaaatagataaatcattctagatgttgaagacaatttttttcctacttgattaacagaattctgaatagctaaagtgatgaaaatgaagctgaaattttagttttcttagtggaatgcttcatttaaaatgtcagttatgatagaactttgtagtcaccataattggctagtcatcatttagaaatacaatcatgcatctgcttacattgaaagccaagttgaacttgtgacctaaatcagttatactacatctaaagtaaagcttaacatggtcattcttatttttctgggctttggtattttcattttcataataaatggagtttgtgaaatacttgttaattttcatattataactatggaataatatacataattacgaatatatattttcctttaatcagtaatatatagtttcctttaatcagtaaactttccttgacatttaataatcaaattatatgacttttcaagaatatttcaattatatgtgcaacaaatagtactttttaaactggaggtcataaactaggaggttttgtgccaaatattctctgtagaagtgttttatttggcatacatagtgttttacattttcaaaaattaccaacactttaaaaatgagatattttaaataaaaatctggatttccatctactaataagtcagaagatcttgctacaatggaccaggattcttacctggcaccatcaggtggaatttaatagaaactgcccatgtagaaatggcatgaaaacttttcccaatctccacaactccttctaaattatgttcctgacactgaggctgagggtcatttgacatttgtcaatattcttgaaattgaagaaatatttctctgcacctgtgtcttgaggaaagggggaaaatatatttattgtaacaaatccactttatataattatctttatctggctataatcttttaaagttttgaccctggtcttagaggctactgcctgggaaatggctgagtttgaaactcatcaagcatatcacccctgtataactatgcatatacattacctaatagagtaggcaactagtagcaaagttacctgataatgcaaataatactctagatcatttaattaatttggggatgagttatgcattttttcctaacacatacaaatgggaggtgatttggtttaggctattgaaataagtttgattccatacaaaaacaaacatacaaactgttctatttgtattccatgcatacaaactattgggcgctgtgctaagttctgcacatacaagcatggataaggctacctatgctgtaaagttgctcactgtctggcactggccacaggtatgctcgatgagggaaagagtctagtgtaaatggtccaagtgtggatgtacaggaataattatgtctactactaaagtggtgtggacctctagaaaggagcctggcttaagtcttattgattgctttagtctcttaattatgccctgtaagtgaacctcaataaataattatgaagatattcatttccactttaatttcacactgattaaaatagattttttaaatgaaaaacctactggtaatttccaagtgaatttaacttttttcacccttcacatcttaccttatggactcttttacctttaatcatcattaatatttttaatatgactgccttcatttttacttcaagtgccatgttgagtatatttctaaagtaaaacaaaagagttttagatgttcttttaattctgatatagtaataaatcaaacataaatgttattggtttttatttcagacctattttacctaattttatattcctttttattgacattcagttgatttcatgcatttatttttcactcaattagaattaggagtttatgaagatcaaataaatcaaataacatcattagtatctctgattataattgtattttattgtgaaaaactcatagaatgttcacatatattatctcctctatcattctagtgtgatcatagaagaagcattgaaactagccttggaggatctagttttatttcaagctcctccaattgagaaattacctagtcttctcaactataaaatggaaaattattctccctgctttgcttaactcatgaagtgctataaaatattgaaatgagcaatgtctttgatatgaattaggttttaaatttatatctgataatgtaacatataaatattgcaaaataaatgtgacaagtacccaaaaggatgaagaagcagaacaccaatgagccatctcttttagaatttggttgtattttcttctaaggcttttctattcaatttctctacaatgtaaatttgatatatcatcaatatttttctatgccattatttttccccacataggttttaatggctgctaatgtctcaattacttacgatgtttctctattttttttgttgactaaagttcatcaagagtttgtttgcacttcaatttttttatcaattatttcttcacctagtgtttgcatacaaagtgattgctttagaattatgcatttgaatatgaaatttgttttaatattcctgacaccttctgccaatttaattcctccccaaaaatattatcactgaatcaatttataatttcactaagtataataaattaaaaacacaaatgttactctttaacatcttatacaaatataagacaaagtttcttatatttagtagtaacaaataatttacttcttaatttttatcagattgtattagacttttctcaatccaaccataatatacgtttggattgcaggaaagaaacagaaatagatatcaccaaagcctttaaaacacttctataaaataaaagatatgaaaacaacagcacagggaaaggtcaacgttgtgagcagaacaaagactgaaagaaataactaactttggaatgctcaactagtcaatgctcttgcttactcctgttaaaatctaatgtatgttgattgagagaagtaaaaaattatctcctcagataaaaatatttgaatctatattctatgaaagaaagagtacttttatattatattactttctaatagtttaggggataatttgggagactttcttagcagcctgttgggatgagaagaaaactagggtaatagagtgctaagttaaatattacatttatatactgaataattttgtcacatgaaccaaaatattttatgacatctgatcccagctggccccattgtttattttgatccctcgtaagcatgaaatgaaagtacaatgaaagattaaaatttgcaccaattactctacatccttgtggaagcttagggttttatcaggtcctaggaattattaaaaaggatttagggaaaaaaataactactcctttattggaaatatagatgtttaagcacaagtttaagtatttgattctcatgcttattggtaagtgggttctttggcagcaaaacaaatcatttgcccatactaagcagaacattatatttttcttattccttaaaaatgacacaaattgtttgtgtttcatcgactctgcaggattttagtaagcttccatgtctagagcctaagccagcataaagtcttaaagtaacaatttcttctctacagaaagccacatcttcatacccaaacacaggttcagatgattgtaatagtgtgcggtatccaccaaacttcccatttttatcagtaaaaactttaattacattcagcatttaattattcatcactctgatagaaaagcatttgtgcctctgcttcctttctctttcctctgctttctattttggttatagtgcatagaataaggaagaaaggagagaaactcatagcatttcatttcctttgggttcctaaacctacaaaatgattaacctaataaagccattagattttataatttaaaaaaatcagacgtgaagatttcagctattcatgctcatatttgtaaatgtaaaaaaaaccttatttttattacttatctttattaattttataatctatggaaaatgtaattaacacagatctaaatactaacagtgtagatattgtgttatttgaacattataaataatagcttagaactaagctgtggtctctgaaacattcttaggagtttttcctccaaggcccttgattatttgccaagtaagattaaatagaatcctgatgtatccaaagaaaaaaatagaaggaatgatgtttccagaactttgagagaaattgtttatgaagggcagtccaaaaattcacaggaaaacatggtacataaacatggagcttgaaatcaggaaacatgtactattttaatttattttattttattattattatttttttttttttgagatggagtctcgctctgtcacccaggctggagttacagtggcgccatcttggcctaccgcaagctccgcctcccggattcacgccattcccctgcctcagcctcccaagtagctgggactacaggtgcccgccaccatgcccggctaattttttgtatttttaatagagactgggtttcaccgtgttagccaggatggtctcgttctcctgacctcgtgatccgcctgcctcagcctcccaaagtgctgggattacaggcgtgagccaccactccccgctaggaaaaatgtatttctaattaactaccccaaatcttttgctgtataaggtatatggacgaatggaaaaagatagatagatagatagatagatagatagatagatagatagatagatagatagataatagataaggaaaggagaggagagaagaggagaggagaggaaaggaagaaagaaagaaagatgacttttttatccatgctaccaactagttaggggtccttgaacaagggacttaaacacattgcaactaaattttttgaccaaaactgtagggattttagagctctgaaatattacatatctgaaaattaattggacccagaaaacaataaaaatgaagcaacttataatcttggtaaacagagatgtttctccttttttgatagataatatctaaaatgtatactataagctttgtgctggtattgtttcaagactgttacatgtattaactcacatgatccacattttataggtgatgaaactgaggcacagagtttaagtgactcaatgacagtcaaacactgtggggctggggtttgaatccaatctagctatgaagtccagacttctaacaactaaatttggctgcctcttggggtctcattacctctatacagggtgattatcacagcgtgaaatacaggatatattgtcttcttggtgaaaatacagacattacattttagcattactgaataattaaatgtattctgtcacaatttctgttgatttaccaacttctggtgaaaaactccagcatttttccatgtcaaatgcatacttttttgagacttttactattttacatagttacaaagcttcatatcttaaattctaaaatactatcacaaactaggcactgtagcatgcacctgtcatcctgagacaggaagatagctggaggccaagagttcgagattatcctgggcagtatagtgagacccagtctcaaagtataactaaccaaataaataaataaaatactatcaaactcaacccctaaaactcctattagatgatagagcctttgaaaatcttgcaattagtgaaatcatctttgttactcatcaatttagcaggtgcgagcaaagaacatttttggaatttcagaaataaaattgcagataattttaactttcaaatagattgttctgtggctatagagatacattactcatttgtttgttattcagtaaatatccattaatagtctaatactattaaaccaatgtattgggtatgcttatagaagtggtgaaaagtacacaaataaatataatactatatacaataagaattggccagttccttgagatacacagtgataagggcttatagaagaaggtggaaggggaagagtatgtcttgattgagggagcagggggacggggcagtggtgttgaaggcaggctgcctagagtgtataacatttgtattagactaagaataatcaaatttgaacatataaggggagttttcaaagaaaaatccaggtgaccaatggatgtgaacaaatataccaaggcacaaaaatgtaaagcatttaccagtaacagctaaacactttacatgcagggaaatagttaaagggggttgagaggagctcgttgggtagccccattgtttattttgatccctcgtaatcaaatggctagattactgatgccaggataagaagctagatttatttccttaacatagatttttgaacatctattaacatttttagaggatcatcaatttagagaaattaatctggctatggtttttaggataaatttcagaagcagaagaatctagaggcatccagatcctctcagcatctaggcatcttagcatctaagaggaccccattattagcaaacatagaagactaaaagtatcactatgataacagagatgagtcaaaaatacttcagaaaaaaaaagaagtattttggaaataattgaattaggcataaaaaatgtggtttttcattttatattaagagactggaaagaaatataagacattaaaagagagacagataagtagcaaattttcaggtctatgatgtacacactgaacagagtcaaaggagttttttggaggaatcatctagtgagtaactgcaaaagcacaacttatgcagaggaaacaagtatggaaacacagattaggagtgaaccataaaggtgacagtgaaaggtatgtgatgaatgatctgatcttacccacacaaagagcatagaaagagaaaagtgcccctgagagacccttgggaggactaatttcagatgagagaagaaattattaaatgcatatatccacaaaataatattataatggtatattgcacccacgtgatagatatgaaactaagagcttgtccaaagtctgacagcaaggaaaaaggaggggaaggggatgtcaataagaatcataaaattaacaatcagattagtagaagggaaacctctacagaacaatgcaataggagctagaaacaaaaatgatttcaagcaggaagcctgatgtattgtgctatatactttcagaggaaaaagttaaggacaggttattggagttcaaaatcaatggggacctttcagaaagaagttattgtagaggcgggagcaggatctagcttctagttgaaggttaaaagttgctaagggggtatgtagaaagcatcctttcaagaaggttaccagggaagggaatagaaaatatatgtgtctggtttaacagagtagtaaggtggaatgaaaatgttttttggtttaggatagaacttaattcagcaggcttgtaagctcaagggaacaatctagaaatccaaggcataaaacataaatgttaatagtcgatgagcaagggcctgaaagagtagttaggagtctgttgaggccacaagcatgaatgctagaccacaatgagaggaaaggagctattcttttttatgagacaagaggagagaggaggccatgaggaagacacatttttaaacatgttgagctagagattgaaggagtttagatttcatgattgagataatttagatttcatgcatttccttgatccccagatggttgagaagagtccaaaacttttggaaagactcaggccaggtgtggtgactaacacctgtaatcccagcacgttgagaggccaaggtgggcaggtcatttgagcccaggagttcaagatcagcctgagcaacatagcaaaactctgtctctacaaaaaatacaaaaagatagctcggtatggtggtgcatgcccgtagtcccagctattctggaggctgaggtgggagaatcatctgagcctgggaagtcgaggctgcagggaaatctgattgcaccactacaccactctagcctgggtgtcagagtgagaccctgtctcaaaaaaagaaaaaaaaaactcagttaaaaataaggtaaacaaatagagagcaggattgttagcagtttgtgaattaagcagagaatcaataatgtggacttgtcctataaccagttaaccacatcttattactttcccagtgtcttaatagcagaagtaaatgaagtgaaaggtagattcacccaagcaccaaaatttaaaaaaaaaagcgagagagataattggaaattgcagaaaagcaagcacagagaaccaaagttcctaagctagtgttttgctgacatggcagagccttggaaatggattggaagaagggaagaagaaattcctgaaagttgttattaatgtgagactatggattaactaaggaaccataatcaccaataaaggataaaatgacttcttatgaaaataggaggggttaaagagtaagaagttatgctctgaggcaaatttcagtcagcatcttggatatgaggtagttctaaatggttttgaaacctaaagtgagggtatatagagagagaggagcccaaattaaatgaaggatagcaaggattttacttaaatgattaacatcaataacaacaacaacaaagataaattacctacccttattaactgttggttatgtattgagaactgtgttaagtgctttacttctgttaactcagttcatctttcctacttactatgtgtggtaggtagtgttcacagtcattgagctgactattcccctctcgttcaattgactgtttggttgcttggtttgacattgtttagacacaaccttgaaaagcaaataatttcagttaatttaaccataatcaagatttttcattttctagatgctctgaacacttaaggtgcacatgggcatatgtaaatattttattaggcatattacagggcagttaacttagaacagaacgtgttgcataacattggctatggctataggtattaaacattataaggcagagtctccaatctgagagagctaactgatattgcaaacacaaaaaaaactatccaggagtatctgtcttcagaaaatacaggagtttcttgaagaattgtaattttattttattatttttattattttcaagcataagtaaaagttatttgagtctttcttaatagtataaatagccacttatacatttctcacatagaagaatgatgaccaactgtaagccgaaattcaatacatgttatttaaattaaaatgtgccagtactttatcagtaagtagataagtagatgggcactctgaactgattattaaaaatgcatcacttaacaatattaagcatttggttacattatgataggataattgcagcaattttggttcctaattttatcaatcaaatagactctccagcactgtaatatgttatatagttattgccatagtgttccaaaacccacatcaggtgagggtcatggctacttcctaattaccatctgtttagctttgttagtgtttctcattataactcagaaggtcaatgatactgttcatgataggaacccagcaaggcgaaaagtaataaaatagctctgagactaagcaaggctctgctactccaactgatggacagttaattacctgagcataaaacagtgagagcactgggagaaatagagaactttgcaatatggtagatgtccaagtacaatattatttggtggtttttcaatgaacaattctgtttaattaaaacatgagcataacctttgtcagaggagaatgtaattttgacaaaagcaaaacatttggtttttaacagcctcacagactacttagatgagcattccaaatctaagtttctatagcagtttctcacccttggcagtacattagaagtacatagaaactttatataataccaaagtcgggccccaccccaagccaattaaatctaaatctgtggagggtggaaattaaacatgcccatctttttttttaaaggtggctcagatactgcttttgtgctttgaaggttacaaaccactatattacaactaacattcaaaagtcatcattgccattatggatctatttgtgaacaactacaatcttctttttaacctttaatttgcactgcttttatatggaaagacttgtgtagctcactcattaaccattgtctttaatttgtcttttaaattatcaactaattaatcttttaaaaacttcacatctgacttctcagctcccatggaggaattttgaacgtgaaaccaaaaggcatttattcctagaaaaaagttttagaatcccttcgaagtgtcctttcaaacctctgaataacagaaatcccataaatcctatgggatatatgtttttccatagaattagatgattaattctatcattttaattagtaaagagaagaataaacaattagatgtaaagcccttatgttaaaaaaaatacctttgtaactatcgctagatacttattttctataaacattttatagaatttaattttttttatttttaaataggctatggatcttttcatagtgaaaccatgtccacagatttctagagtttacataaaaatgatttacattatgtgacctaagttgacacctgatagtttcatgaccagctaaccacttcaaggacagtgcaaagggcagaaacctctcttcgctatgattttcagagggaatatagaagtaccagtcttccatggccagtgtcactttcatctatctatttgatcacctgtaaaaaaaaaaaacaaaaactaatatgagttttaaagaaaatgtgaaaaaaatgctatttcttaattttaaaacttcttacaccttgactttgtgtttttagtttgagattttttaaatatttagaatgtctcaaaaatacgtgctacagtctcattaaactccatacattgttttcaaaagatattcttttctttttgttttttttcaactaggacccctactatggctggtggcctattttctattgacagaaactactttgaagagataggaacttacgatgcaggaatggatatctggggtggagagaatcttgaaatgtcttttagggtaattgcattttattttattttttgatgctgaacatacaatgctgtagcatgcacataccagtcccagtaatttactgtcaaatcatttttgctgagtgatgcaaattactgatcaattggttatcttaattcacattttgatttgacagagtcctattgcatgcaatattttcttctaaatgggaaattataggtaatttttgttttcaaaaatattgtttttattcacagtaaaaatacattaggactttcaattgctgaaataaagaagggttttattttttaataacgtgttgctctataaaatcactttgtgtttttgaactgaaacttggaagtatttatgtaatctgaatttgcaactactgcctcaggttgttctcagaaaactttaagaatgaactgtggtcaaatgaatttggataattctgcaagtagtgtgaccattttcactaacattattgttggataagtcagtttgaataaagcaacttcatttaataaatggccttccatgtaaataaaaattgaggaataagtccttacgaatatgttattaggaaagtttaataataatttaaataatattttgttatattcaaaaaatttaaaaatgaacacataagttttctttcatgctaagaaattgataagcactaacatagtggttttgtttttcaaatcactgcttttttttctacctaaaattcagtgtaaactatttgtgagtgttttttgttattgttgttgttgttttttgagacagaatttccatcacccaggctggagtggtacagtggtgcaatttcagggctcactgcagcctagacctccagggctcgggtgatcctcccacctcagcctcccttgtggctgggactagaggtgtgcaacactactcctagctatttgtttttctattttttgtagagacagggttttgccatgttgcccagggtggtctcaaattcctgagctcaagcaatccacccccctctgcctcccaaagagttgcgattacaggcatgagccaccacacccagcttcagtgtaaaatatatgaaacattccatcttcgcccaaaatatttgtacaataaaattattagagtttagatgtatttatctatgaagtttaaaaattatgccttttaatttctcatttcaaaagtaaagtttgtttttcattatcataatataaatacgtgtgatgttgtgtaagaaaatgttaaaatttgagaatgagttaccttgaatttctctactgtagaattcagtggatcttggataaattattttaaaatcagtaggatggcctagttatattactattttgcctgtaaactttcctgatagccagatgtctgagacaaaccttagttaatggaattttattatttttgcatttgtctatatgcttatattctcatgaaacttgccaaaccaaactcagcaccacactcaggaatatcttcttgccttcaggtccatggacagtaactctttgcaggaattttgaggacatttgagaacccaaaattattacctgttatggttcttatggtgaaagaaataagaggtaacagaaaaagaaaagaaatcagtatattcagaagtttagaaataatttgcttctattcttagaagtaataatgagagaatgtactcattcattaactgatattcttcgggtgctatgctgggttacgtaagaaataaaatcaacacagaaataccgctactatataggatcctcttgctactttttctcttgtcttcctaaaattagaattcacctctttcctccctacctgttaagcttgattttctgccaatgtactcctcttacttttatcacatatctcccagattggcgggatgctctttatctaactggttgaaagtagaattcagaaagaatttagtggaataatatgataaacaaggaggacctgatcaggaaatgtaacagaggtataaatgtataaaaaggaagacttgaggatatgatagatgatgcagataccaagggtacagaaggaatgcagctaggggctgtaagaataatcaaatccctcaaaaatgacacaggaggttttctgtgattggttattgggattattaggaaataaaatacttatcagtgactattttaaaacaatatcaagtgttttaaaatgtattattatctttagtttccatatgactttaatagaaacaaaatatgtattttgctttttattagactcttaatttatgttttactttcttctctgtgacatgaatatgtttgcttaatggtttgtactgtagctgaggtagacattgataaggaaaaatgctagaatagtgcattgacaaaagattgagaccactcatctctctttaatttcatgacttgatgaaatgagaatatgttgagcatttataatcagagggtttgaatctaatatccagctcaatcattacacaacaaacatacattgagcaagtgatatgtttccaggtgctgactttacaaagatgagtaaagcatgatgcttctttgctctcaaagaactgcattcctatgacagagatgcgtaggtgttattgtcaagaaaatgtgataatttcctttataaatttatgtgtgaggttttttgtctctgtcatgtgagtataggtgaacataaactcaactgtaaaaaggtgattataataatagtgaagttattgtggttttgtagctgtggtctacataggttctagtctaagtaaagaagatagaaatatttagggcttgcaaaatgttaagattctgactcacctcaaggtattttaagccaaaccaaaggaatacattgcaaagacttatttgtaacatatcacttgatcgctgtacttaaagacatttgaaaattttatgaaagctgtagacttcctaaggaagatgtttccaaccttttaaagacaacagatttaaatacggtttcaaagtgtttaaaaatctcttgaaaccttaggagaaagatccttggcatataataatagtgactattagtatttatagtagctagtaagtggaatagctaagagttgacccgcagcattctgacaccagggactgtgctgttaaataccatactgttacctcctcattaaggttcatctctccataacataacgaacctaacagttgatggtattattaggagaaagaaagacgctaacatgcaaatacaagcttcctccacaattctgagatgcttctctcgtctataatcttatcttcctcttataggctatagcctctaatggaagataatacacattcaatagcagtgagaatatcaggtatatctaccagagaacagcagttaggtcttaatgcttctgaaagctgtttcaaatatttctccctactgcattacacaacaatcactgcaataacataaatcctaacagcactgtctaaacataagcattaattaattatgtttagacagtgttatgtatctgctggggatacagtaatgaacagaacagacaaaactttgtgctcttatggaacttagattttggagaaagagacagacaataaacaaaataaataaaatttattaaaatatcagttataggtgttaaagaaaaaatataaggaaggaaagattctatgaagtgttggattttggaggatacataggggttgaaattttagacaagaactgagaaattgatacccaaataaaatagtgataaaatgaaccaagaaaattatgaattaccatcaaaaagtatcctctatctttaaataataaccgtgtttcaggataagtatcaaccaacaagcatcaccaccaaaagtccttgtcttttataagcaatatcatggggagcagcattcccaagagtacagatcattttgcccattctaaaatgaagaaaactgccactatccaatcaactcagagcatgggaaaaaataaataaaggagcttgatgacagcaaaggacacagaaatctgtctcacagccatgaatggttacaagtatggactgggattcagatagcctgcattcaacacccagctctggcacttaccatctgtgtaagcttaggtaagatagcacatattctaagctttagtgtgtccatctctaaaacagaaagataacagtactttcctcatttttagagaaagattaaatgatattatgtatattgtgctgagtactccactcagcacatagtgtgtcattcatggcagctgttgtggtgattgttataagctgtgcaactctgggcaagtcataacattcctgagaatcacctaaaaacaatcttacctttaataatttggctttgatcatggttaatcacaagagagaatgtagagaaaaagtcatttaaacccagaaatgcaatatacattaaagtataattatactaagtgttagttgagatgtagttctaaggctcccctgctcaaaaaatatattaaattttaaaaaggaaaagaaaaaccacacacaaaaaaatactttttatacttccacaacatcattggagttaattactgacatctaagaatctagggtggaaaacatttttctacactcataaatcagttggaatgaaacagttgttaatttttaaaagtatgtatcatctagacttggagtaacaagtactagatttaccattctcctcgtcattcacctgaataaattaaaaaatggacaaaaatacatgaaataacactttcaagacattgaacagcagtcaccctgagagatgggaaacaaacaaggaaagccttacaattgcctcggcttactgccttgtgaaagtttctaggccttagtgataaaagggctagatactgacagactccatgacttgaggagatgaagctgagtgtttggggagaccaagcccgctggaatttggtgaacagagtaatggagtcctgggcagagcattgaagagatatacagaggtttctgtgggagtattcagctgtgtcttcacaagtgtgtgaggaaacaatccaagtctgaggaaagaaccttcagaaaaggttagaggtctcattgcccagtgatgactcaggaaagtcaatagtacctgtatcctccagacagattgattcatgaggtaaggggtagaggaaatattgagaaactacataacatacttcttaaaaacccatggatagtctggatgtggtggctcatgcctgtaatcccagcactttgagagatcgagcaggcagatcacctgaggttaggagttcaagaccagcctagccaacatggtgaaactctgtccttactaaaaatacaaaaaaaaaaaaaaaaaaaaattagctgggcatggtggtggactcctgtaatcccagcaactcgagaggctgaggtagaagaatcgcttgaacccaggaggcagaggttgcagtgagccgagatcatgacactgcactcccgtctggacaacagagcgagactctgtcaaaaacaaacaaacaaacaaaacccacagattaaagaacaagtaaaattaccactatttggaatgtaatgaaaatgaaaacatagcacatcaaaatgtgtagtgacactaaagcaaacttaggaattatttatagcactaaatgtctatatcagaaaagaaaaaaaaaaaaaagaggtaaaatcaatgaccttagcttccaccttcagaaactagaaaaagaagagtttttatgccaaagtatctaagaaaaaggaaataataaagataacagcagaaataaatgaaatataaaaggaatatatataatattccacatatatgatacctatatgataaaaaaaaatatatatatatggaaaagcaatgaaaccaaaatttgtttccttgagatcaataaaatagatgatattttagccaaatatgggaaaaatagagagatgacacaaattatcaattttggaaatcagaaaggtggcatgaccaccatgtattctacagatggctaaaaggattggaatggaacattatcattctcattatgccaataaacttgacaacttagataaaatggacaacttcattaaaagatacaaattatcaaagctcacagaaagaaaaaatagaccaaacagccctgtatctagtaaataaatgaaatttattctaaaaatttataatttttaatactttaaaaataatttttacaaaggaaactcaatggccagataacctaactggtgaactctaccaaatgttttgggtagaaatcagaagagttcgggccaggctcagtggctcatgcctgtaatcccaacactttgtgaggccgaggagggcagatcacctgaggtcaggagttggagaacagcctagccaacatgatgaaaccctgtctctactaaaaatacaaaaattaaccgggtgtggtggcgggcacctgtaatcccagctacttgggaggctgaaacaggagaatcgcttgaacccaagagggagaggttgcagtgagccaagactgcaccattgcactccagcctgggcaagaagagcaaaactctgtctcaaaacaaacaaacaaacaaatgcttccacaaaattgaaaggaggtagtacctcccaattcattctgtgagatcagcattacacagataccaaaacttgacaaagtcattacaaaaatagaaaactaaaaattaatattcctggtaaacattgatgcagaaattctaaataaaattagcaaatcaagtttctccgtatgtcaaataaataatatatctgattaagtagtgttcattgcagaaatgcaaggttggtttagcattcaaaaatccatcaaggtaattcaccgtatcaagaaactaaaaaaaattgattggtcatctgaatagagtcaagaaaagtatataacaaactcagtctactcctgaatttaaaaagaaaaccaaaaacaaacaaacaaaagccctgagcaaactatttatagaaaactcatcaacctgataaagggtttgagcaaaaaaacctacacatatttaatgttaaaacattgaatgctttccttctaagatcaggaataaataaagattttggatcttactacatctacttaacattatactggaagttttaggcacagcaacaaggtcggaagaataaattaagccatccatattagggaggaaaaattaagactataattccagaagacaagattatctacaaaatccaatggaatctacaaaagtattgctgaaacaaataagacagtcttcttatcaaggttgtagaatataagaacaatgtataaaagtcaactttatttctatacactagcaacaaacagcagaaaactgatattaaacattatctaaaataatgtaaaaaatatgaaaaagtgataaatctgacaaaagatgtgcaagacctctatgctaaaaactgctgtatattactgaaattaaagacctaaatgaatgaagataaatactattatttattaatagttagtagactcaatatgatattaagatgacaattctccctcagatcaatatagattcactgcaatagcaagtgtattgtatttacttactattgcatatcaatatagattcaatgcaatagttaagtgtattgtatttacttaactattgcattgaatctatattgataagcaatagtaaataaaacttattttgttaggtagaaattgacaagttgattctatccatatagatatacaagggatgtataatagctaaaaatgcattaataaagaaaaaagttagagaattaacaaagtaggatttaaaatgtattataaagctataataatcaagactgtgtgttattaacataaagacagacaaaggaacagaactgaaaatctggaaataaacttaacacatacgtggacaactgatttctaacaaatatgcaaaggctgtttagtagagaaagaatagtagtttcaaaaatattattagaacaactgaatgtctatgtgggggggaaaaacaactccaatccataacttataccatgaaaatattaattcaaaatgtaaaaatataaaattataaaagaaaacataggagaagaacttgtgtaaccattgattagacaaatattccttagatatgacaccaaaagtatgagtcataagagaatggattggtaaattagatatcattaaaatttaaaaacttgtgcttttcaggccgggcatggtggctcacgcctgtaatcccagcactttgggaggccaaggtgggcagatcacttaaggtcaggagtttgagagtagcctggccaacatggtgcaaccccatctctactaaaaatacaaaaattagctgggcgtggtcgtgggcgcctgtaatcccacctacttgggaggctgaggcaggagaatcacttcaacctgggaggcggagcttgcagtgagccgagatagtgccactgcactccagcctgagcaacaaagtgagacttcgtctcaaaaacaaacaaacaaacaaaaaaacttgtgcttttcaaagccactattaagagaaagagaagtgaaggcactgacagaaaaaaagaagttagcaaattatatatctgataatggatttgtatctagaaaaaaaaactctcaaaactcagtaataagaaaacattcaactcaataaaaaatgagcaaaataacttgaatagacacttcactaagaaaggtctacaaatggcaaataagcaattgagtaaatcctcagcagttagtggggaaatgaaatttaaaccacaatgagattacactatgcatttattagaaaaagaaaggttaagaaggctgaccatgttggtgataatatggaagaactgcacctgcaatgctggtggcgatgtacaatggtacactaaactccaaaaaacagttttagtactttttaaacactcttgagtatttactcagtggaaaggaaaatgtatattcatacaaagagttgtatgccaatattcatagcagctttatttgtaataccgaaagccagaaacaatccaaatgtccatcagcaggtcaatgaataaactatgctttgtccatacaaagaatgtgtgcaaactattaatgcaccctacaactttggtgaattttgtaataattatgctgaatgaaacaagccaggcaaaaagattacatactatatgacttcatttgtataaaattttagtaaatgcaaactaatctatgaaatcagataacttgtctggggacatgagattgaggtggcagagggaggattgcagggagggattaccaaggggagcatgaaaacttttagtggtaatgtatgtattcattatcttgattgtggtgacagcctcacaagtttcacctatgacaaaacttcttattgagtggtacaatttaaatatatgcagttcattatatgttagttatactttaataaagctgttaagaattaaaacacacacacacagagagagagacagagagagagagagaggcatactccaaagagaaacaaatgaaggaaaaatgtagttcaaagtatctacttaacagtaaacctctatactttaggttagattctcaatatatcatagtccagttacttttaaatatccctgttgatctgattataacagtctacctcccaggacaactgtattcattaaatgaagtaatactcattaaagctgtttataaataaactgtatggcaatattactttttattataattacccttaaaataagctcttttgtcagtaactaatattttaattaacaagatcgaatttacttcaagtaccccaattttcttttgcttgcaaatcacagtgaaaacaatagtgtatttacctgaagaatatagctaagtgaaatgtcttctcatgtgaaatccatgtatttccaatttgtacaagcaatgaagtggaaaagaaatgagagctgacataataaatagtggaaaaatgaaaagcaggggttcccattgaacagaatagtatggtaaatgagacaatgaaatttgtcaacctttaggggcttatagtatccagactttttaaaaatacttaaagaaagtaaagaattttctaagcaatgtctacacaattcaaattttgacaagtgaaaacatcagccgtaataatttattagaaatcattttagacaaaaatccagctgatttatttctcttagagttctttgcctttttgtaaacttaattcatacaaatctgatgaaagtaggttatttgtcagtgtgtaaaacttgactggtttttttttttggatcagtcatagaaaccaaactataatagaaatatggagatggttttgcaggatacttttctttaaatatgataaatcactctcttaatgataatatagagattattagcctttttaaaaaatcctatgaaatcataaactgacatcatgtgtgtgtagtctccacaaagaatgcagaccaatcttaatgatttggttcagcaaatgtttctcttgttccccatttggtgcaggctgaaccttaaacatattgaagaatagcttgaagttttagcttctgtgcctgcaactagtttttctgtcatctcggccaccactttgctttgaaccattgtttaaacatatattttcattcaaagaagggctttttaaatttaaaccacagaataaaaaatatttctagataagaggcaatgagacagtgctactaaagattgtcatatatatatttatatatatgtgtatatatatatatatatatttctaaagcacagggtgagtaggtgtcacagaataatatttcattatggttcctaatagaattctgtttatccaaaacaaatgtgttagaattttattttgaatattaactgctataaataactggctttgtatgctcctttagaaaaaaataagtgaacaacaggtaaattagacattaatcaagctttagaagaacattagcaaacattaacaaaacttgtattgctcttaaaattataatagcttaaggcatcgtaatttcaataactacattcctctattaatatttttggttcagaaaactggaatatgagaagagctttatattagcctttgatatgatgctttaccttgtaaacattcaatttggagacatgcttatagttttagaaacataaagcacttaaagttgtttagatgcactaaaacttggtattaatctctggttctcttttatattcatttaattatttcttaaactaattgaaaataattttgaggtggtcggtaccacccataattcgtttttaaagcataaccacttatttataccttttctattatttctaaaatcatcctaagagattactaacatgaaaattcacaattgaaatgattcaaaacaaagcaaccgagaggaaagatgaaaatgaagggcaagagaaataaagtaacaagaaaatgggataaactagtcacattgaataatcaataactttattcaaatattcctgacagctaaagtgaaaataaattagtaaataaaattgcactgaacctttttttttcttcagatgaaaggaactagattctgaaaggcattgcccagtagacacaaagcagttgatatgttagaccatgttttagcaaacatccactaatgcctttaaatggatagtgggtttcttgggtgcactaagagaaaattatcaattttattgctttccagtgatttgatctcataaaggaatatatcttgaagatagagtatcatttggggtttttctgtaaataaaacgtatctaaattcagtcaagcttaaatgttggtcaattcacatttgaattatgttagcattcttttctcttaataaaaatagaactcacatacacaagatgcagggatgtagatactaacattagtggctggtcatgaaaactatgatataaactttttctcctactcagacccatcacatttcttcacaggtttggttcacagggttgcttgtgaataatgttattagagaatggatttgcttggatacaacttggtaaagagattaaaatgtaataaagatacaaattgtctagatatttttggttatgctatttgttatctgtgcaacgcatagaataattggccattactggctgcaatgaaatatctatgctagcttgtaacagctgtcttggaactaaacaaactaaaaattttggagaagttaaatatgagctttgttaggcaatttcatgaggatttagaagatggtaaaacaaatcctagagttatgagaagataggtgaggtttgaactgagtgttaaagaactgacagaagttagctatgtcaggaataagaaaggcatttgaggaacagaataccacatctgtggaattagaatatgtgtcataaacctagccctcttgcattaataacattcatttcttctctttcatgacctcacaaaatctcatcatatgagtgtttctctggagaattgtaagcatatactgtattggtaaaccaacaaaaatactcgtctactatctaaccaatcatgaatactatctgtttattttattcatctatatatatatctatctaatttatgtgtatgtgagtctatgttagcataaaaactaaatatttatgagggcccaaaatgtaagtctctagtggtagttactgtagaagctatattgtaacaatgatgtatggataaaaattttacagtattagatgtctctataaaaataaatgctgaatggtactcgcaagacatcctgaatgagttggaactaggatagtaaaggaaattataaaattatggaaccctgaaagatggacaggaattaaatgcataaaaagaaaaagaaatcgaatgaaaattatacaaaaatagtaatgtataaagtatacattttcatttccattaataaataaagaagtgaatgatattttatagggcttatccagaaatacacattggaaatgttttgttggaaaatcaatctaattgagaaagtttttctgtcttcttgaatgataccattagatggaaataaaggtacacacaagaaaaataaacaattaacttctgaaccatgataaaaacacttttgaaaatattattctttaacagatacaaggatattttaaacatactaagcagaatgtccctgtatatagcaataagccaggaatacctggctttttagtgaatttcagtacattaagtaaccaacactcttattagagaccaatgtctaaaatgtcaactttgagaaacatacttcattgctgtggctttctgacccttctctgctcatatgaacagatattccacgtgcatgttacccttaaaagtctttataatctttctgatcccaaacataaaggacttaaattcagcggtttgaatttatggcaataaaaacagctatatgaagaatgttaatgtgctcagaattattgaacagacaagtttcatatccccttaaggccaaatttcactagagcctcccattaagtgtgcttaatcaaacaaaatgatgctgaaaattaagtcaattatcctgctgatttacatttgaaatgtccctgaaatattctaataaagaaatgtttaactttcttttaaatctaaatatatgctgccgtgaattgacttttagctatttattttacaaattagggtttcatttttcttacgtggaaagggaaagttaaagtaaataacttgtaaaaaaatagctttaaaattttaaaaagcatttatacagattgggtttgattaatgagctacaactgccattaaattcaaatgaaatgtgcaaataagtttaagtcaggaaatttactggttaattttaaaatgtttgtcagttcttgggcatactcagtccctggtctcggtttcctagaacttatgctagagggagaccatagacgataaatgagtaagcagaaatattattctgttaatttcagataaagtcaagtgcctagaagaaaataaaataaggtaaaatgttgtgaatgacagaggtggaggatgaagggtagagaactacattacctagagtggtcagagaaaccctcccaggggacatttgggctgataccagatgacaggaagcatctatctatgcaaggatttgcaggggggaacattcagcatagaaaaaaaatgataaatgcaaaaggccttatgcagctatgaagtgagctcagttctcctgttccaagtctataggatcacaaatagcctgaagaattgggagggttaggagagaggtcatcctctcagaataatgttttggttgactgatttgttcagcatacaattaatgtgtacctatttgccacatacaatcacacactacataattgtgttttggtcaacaacgacacatatacaatggtggtcccataggatactactgtatttttactatatcttttctatatgtagatatttttagatacacaaatacttaccattgtgttacagttgcccacagcattcattacagacacatgcttttcaagtttgtaagctgtaccatctaggtttgtataagaacattctgtaatgttcacatgataatgaaatcacctaatggtgcattcctcaaactgtatcccagtctttcagtgttgcatgtacaccgagtacagttacaaaagatgtacaagagatgttttctaagagattatattttgatgaaggcttacatttgaataatacataataaaataaataataataaaatcattttacaagtattgttataatggatctagtatagattaaatatataagaaggttttttctcattattttgtttcttatcttgaatgcattttgtaacatttgcattatacttcagatcacctctaagtatcagccaactataaatcaaccctcattttacctatcaatcagtataaatattcacatacctaaacctgcaatagaccctgtggatggcatatacgcaaggtgtggttcttgatttctttcactgtgtgggtatgtaagatagcaaatagcacctgataatgtacgaagttctaggtatcatttgaagatgcagatatatagtgcattaagttcaaaggagggaacgattgctgtggtctaagacattcatggaagaatttagaaataaaaaatttaagggtatatgtagtcttgtgaaaagaagcagaaaagcatggcctggaaatctgtgtactctcagtttacaaagttctctgctgctgtgatccttgatatagtttggctgtgtccccacccaaatctcatcttgaattgtagttcctgtagtccccacgtgtcatggaagggatccagtgggaagtagtttaatcatgggggtggttacccccatgctgctcttggcacttcttgcttggcatttctccttgctgctgccatgtgaagaaggtcatgtttgcttccccttccaccgtgattataagtttcctgaagccttacaagccatgctgaacagtgagtcaactaaacctctttctttataaattacccagtcttgggtatgtctttattagcagcatgagaatggactaatacagtaaattggtactgggggtaccaaaaagatacccaaaaatgtagaagtgactttggaactgggtaacaggcagaggttagaagagtttggagggatcagaagacaggaagatgtgggaaagtttggaagttcctagagacttgtttaatggctttgaacaaaatgctgatagtgatacggacaacaaagtccaggctgaggtggtctcagagatggggaacctgttgtgaactggagtaaaggtcactcttgctatgcaaagagagtggcagcattttttgcctgccctaaagatctgtggaactttgaacttgagagagataatttagggtatctggcagaagaaatttctaagccgcagaccatttaagaagaagcagagcctaaaagtttggaaaatttgcagcctgttgatgcaatagaaaagaaaaacccattttctgtggagaaattcaagcctgttgcagaaatttgcataagtaacaaggagccaaatattaaccaccaagacaatggggaaaaggtttccagggcatgtcagagaccttcacagcagcccttcccatcacaggcctggaggcctaggaaggaaaaatagtttagtgagttgagcctagggcctcccttgcttgtgtgcagccttgagacttggtgctctgcatcccagatgctctagctatgggtaaaaggcatcagtatacagttcaggccattgttttagggggtgcaagccccaagccttggcaacttccacatgctgttaggcctgtgggttcacagaagtcaagaattgaggttgggggacctctgcctaggtttcagaggatgtgtggaaatgcctagatgtccaggcagaggtatgctgcaggagtggagccctcatggagaccctcttgctagggcagtgtggaatggaaatgtggggtgcaagcccccacacagagtcccccctggacattgtctagtggatctgtgagaagagggccactgtcctccagaccccagaatggtagctccaccaacagcttgcactgtgtacctggaaaagccacagacaatcagccccaacccaggaaagctgacaggagagggactatcccctgcaaagccacaggaatggagctacccaaggccgtgggagcccatctcttgtatcagtgtgacctggatgtgagacatggagtcgaagaagatcactctgtaaccttaaggtttaatgactgccctgttggattttgggcttgcattgggcctgtagcttctttgtttgggccaatttctcccatttggaatgggtatatttacccagtgcctgtacccccattgtatctaggaggtaactaacttgcttttgattttacaggctcataggcagaaaggacttgccttgtcttagatgagactgtggactgtggattgtggatgcttttcttttcttttctttgttttcttttcttttctcttttctcttttgttttctctttttttttgatggagtctcactctgttgtacaggctggagtacagtggcacaatctcagctcactgcaacctccttttcctgggttcaagcaattctcatgcctcagcctcccaagtagctgggactacaggtgtgggccaccacatctggttaatttttgtattttgagtagaaacggaaaatgcaacatctgcatcttcaccatattggccaggcttgtcttgaactcctgacctcaggtgatccatccaccattgcctcccaaagtgctggcattaaaggcatgaaccaccaggccctgtcagactgtgacttttgagttaatgctgaaataggttaagattttgagttaatgctaaaatgagttaagatgcctcctcattgggaatgcatgattgcttttgaaatgtgatgacatgagatttggaaggggcggaatgatatgatttatgtgtgtcctcacccaaatctcatcttgaattgtagttcccataatcccctcatgttggagggatctggtgggaggcaatttaatcatgggggtggttagttgagtgctgctgttctcatgatggtgagtgattctcacaagatctgatggttttacaaagggcttttcccccttttgctgggtgcttcttgctgctaccatgtgaagaaggatgtgtttgcttccccttccaccatgagtgtacatttcctaaggccttcccagccatgctgaactgtgagtcaattaaacctctttcctttataaattacccagtcttgggcatgtctttattagcagcatgggaacagactaatacactcctactttgttctttgaggcatatctaagtttagagtagaacatctgatttcctgccttttgttttccctatggaagattacatgaatgaagtattactaaagcattacatgtgtatcttataaaactaagatttaaatggcaggattaataaagtatttattaaaaattcaacaaattgagcctattatttttatatacctatatctgatcccttaaagacatctaggacaaaattccaaatctgttgtttttgtatatgttcagttaggaaacctactgaacctcgctcgtcaaaattaatgcattcaaaattgaatctatgtattttttattaaagagccaactttaaatctctatggtaacgactgcaataaatgtgcaacatcttaagctatgattatattgtcacacttagtgatgtctatcttcattacatgactaccaatcgttttactgttgttctagtcaaccagaaatgtagttaaaaaaggaaaccaattatgagatttatttaaataagaccgaacaatttctgcaataacagattctagatactaggactgactctgagtgtgtgagataatgttgaggggagaatttcatccaactgtaaaaaattgagtggtaagtaccaatacgtaattactactgagaaattaagtataattgaaaagctagttgttgattttcagtactacccttaaaaattatattcaaccaaacaatatttacaacattttcaaaattccaaatttgatgcattaggaattctaaagatgttttataattgtcaaactaaccatgtggttacactgcaaatatgccaaaattgaaataaacatttttggtatggaattattagcatttctgtactgccaccatgatacacctgcatgtgataatatatttctgcatgccctactctatcatcaaagttttggcaacattttcccacttacttgcttactccatagcctagtaatatgtgatccctgaccaaaatattttttctctattttaagtggtcaaccaaattctatatttactttttaaaatcctatattttagttggtcaaccaactttatattccatattattaattggccaataaaagctatttgcatttgcgaaaaacatcataacttatggaattcctaaattaagataaaaatctatacaaaactttaagcgtactgtgtcccacactaatcctgtaatggtctatttggatagtaattagacctgatggaagactactgctccttcatcatttctctgaccctacaagagaagacctcaggaactgcaagatttcttttcatatttggggaacaaaatggaagctcttgattctataaagttatggaaagttaaagatgtaccaggagcagttggaaatgtgttgcagggttgaggcaaaggataaggaattaaatgggtgtatgaggattgattaatttgccaaggaagaaaatagggacagcaaaagagcaaggcatttccttaggtagcacctactttaggggtgggagaaagaagaaaaagtgattgctaagtcaaaactgtcagtgaagaacaaataaaatgtcacaaaaacttagaaagttatggtgattgtcaacagtgtcaaatgctacagagaagtcaggaagtaggaataatgtaagctcataaaaagtttcatgagcagtttcagatgatggattcaagatagtggaatataagatgataagataattggattgtgaaaacatgtagtgggggaaaaatctttttaagacatttgcccgcaaataagaaggaaaaatcatagtaactttaaggttaaatatgagcaaagtaattattttgtattttctatcatttcattttatcataaatttaaaataaaatatcatctattatattttagataggtaaaatatctaaaaatgaataaggaactagttttaaatatgcggtgatatctaaaaagaaaaagaaagggataattgatgagataaatacctacaggtattggacaaatggtatagcaataaagaatatctgtgtgacacttagtttacagtgcagtttcacactcattattttactatgtccttaccagaacactctagatgagttcttattatcatcttattctatagttgaaggttctgagcctcagataaattgtcatgtgcctagaaattggcagggctaaacatcaaactcacatctcctgactccaagtcaggaaccttaatacgagttcaggagaccaagggcaagggtgaacttcagagaagaggattgactttctttcctaaaatggaaagaagaaactaaggatatttgagacatttcgaggtagaaatgagtagaaaatcaggtgagctctttttgatctcaaggaaagtggaggcaagagattattttcagagaagatagaatttatatggagcttgataacaggtgaaaattttggattaatcacagcttcttcaacaagcatttgaatgagcatttgatgttctctatggagcaacttttaaatttcacaagaataacattttgaagtactagtgtaccaaggaaattatctttactggactttaagcatcatatctaaagaaataaactttgcactcccctctccttgtttgtgactgacaagttagcaaagcaatatgccaaatgttgctatttcatggttatttctttactcttctaaagtgtaatgtaaccttcattgactattaccaattaatttttttaataaaaaactgtcaaaagtagagtattaatttccttcttaggatgtttgtgggtttcttgaataagtacttgaggtgacattaacatggatatttttaggtgtttcacattggttcttgccaaactctatatagcaaaaaaaaaagtgcctgtaagatgagttttgagaggtactcatattttccattgacagcattagaattttagatatgccccctagggaaagtacttatttgaagcaaaacttacagctttaaaaaataatgtcttaggttcttgactagaaacaaaatgactctagctgattaaaagccaggagaaaggcatcctgtctatcacgatggtgggggtgagaaactctcaagtccccttcttgtaagcatgagagactgtttatttatttatttcactgtcaaatgcaaactgatgactagactttaactttaatatgcccagttttgacattcacaactagactggcctgtaagctactagagagctatgtattattattattctttttctatgccccagagcccagcattgtgcttgacaacacacaaagtaattggctaatatatatttgctgaatatatgccagccaggatcttagaaaaaaattctcaagaggagacaggttgtcctatttcctcaaatttatcacaattctctacatttgggacacacatgaccactttacaaattacacaggaaatttaattgaaactgaaattctgtaactccaattaggagaggtggacatttacagatggagagactgaaggaaaactttttctgagctaccaggttttcttttccactcaagttctttttatgtattgctggcatctgtgaaagagcaagagatgccatatattgcagctgggtacccaggtggtctactgatattcaaaggggactggtttggcatgaattctagggcagcgtcacgcagctgtcatgagccactctgtggctagaagcagcagatgttactgatatctgaaaggcagtcacatcagacatgggagaagaccaatgtaaaatgcaaggtatctgacctacatatcatttaagaaatcacacacattttccattcagttttcaaatttacatccacatacaatttttttcacagttgagagtaattgataggcttaattatacaacgaggaaaacaaaaattccaataattctacttttgtcttaataatcacttaaatatactgaaaatactttcaaagcctccaggatgtattataccttaacattattaattattaaaagatgaaaaagtgttactgtatcatatattatttttgtttcctttcttcatgagttactgtttgaaacaatttgtgctcataaaaaagcaatgcttgtttataatgtgaaaacctaaccattaatttcttaagcagaaccatcttatattatgtaggatttctaatatctgacagatggccttacattttttatttcttgcctgttatattcatacattttatttacacagagaacggaagatttgccacaatacaatcagaaccatgtgttgtattgttgatctaaaggacaattgggattttctgaaatatcagcagccctaataagatgtggagtaatgacatgtaacaatttttctgattccagaaaacacaaaagccataaagtgtggtgatcaatcctaaaggtcagaaaactccaaggcaaagaaagttgtcgaaaggcaaaaagtgacagtagattgtacattaggaaatgttggcatgagtattttgggggtagcttcactgtgtttttgagctgctaggaatgggtttctggttttgagaggagtgggagatgagattaaaggctccatctgtgatcaataccacttcaccatacctctcacacacaccggttcatgcacattttgttcttaaacacatcctctccttcaactctacattcagtctatacacacctttgcattctttcactctactttttcctctccctttccgcacccccactctgcccccaccagctgctccctcaaaagtcagttgctaggcctttggaaaagcaaaagataaagtatgattgagaggcatcctttaaaaaaacctacttcaaggtcaatttgctaattcctttagaaaatgagtaagtatgaaaaggatcattttgaatttggggctttcaggaacttcattactaaattaagacagaaagtacttgataagggaaaatacttgataattggacattttagaagcaaactgacattggtgggataaatacatgggatggattcaactcagcattgtctacgtttaatgccaactttaacatctccaaattaccctaataaggctatgacctgaaaaattctcctaaaggagaacaaaagtgctcttccattttttctcgttttaaaacatctgtgagctttctaaacgagaggaattcccatatttgagggggaaaaacacatttattgcctcataataagttttatagtctcagctcctttattctttctcttgttcatagaatcatatttttattatattcttttaatacaactaaagtaaaataagcttgcctaagtaggaaaagttttatttaaatttcggagggttatatcattcccatctaaaaatatgatctctacaagtggtttgtgtaccctaggtaaaaagactaatctaaatcataaatatatggccaaaaacacaaagccatcatcaacctcattccctcttcttctgcatgtgagttttctaaggactctccagattaaatgacttgttccaaattctacaatcagtttgtgtctatttcaagaacagaatgcagctttccaattttaaatgtgatgctttttttattttccatgcaaaatattttgtttaaaaaaaacattaaattatcaagtattggaaagaatcctcaggtgtgctgaatctccctctggcttctggcaggtgaccacttaaaggctacaataacttgatgtagaaaaatcttcatcttgagatgttatcattacctcagacttcaactctagccaccactcccaagtaacataaatctagattacactgtgaagttaaaaataggtcaagagtcaaccaaacaactaagaaggcattctctcaatcaaaatgacaatgaagaaaaagtggcaagtttcatatcaagaatgaggagaaaaatgcctactgtaacctttatgtctgttccatttgaatgactttcatgccttttgtgtttgtgcatgccagtttatcaaggatcatagtgccttcagcatctcaatgaaggcctttttagactttgtttcaattctaagaattacgggatttgtcatcaggctacttgaatatatggaaagtggagagttgatatactgatagggatttttttttattatttttgaagcaaacaggaatatggaacaaaatattttgaaaattaagtcaccagtatcttcaagttttccctttaccaaaattgagaaaataacagctgtttttcctgattccattacatggtagatacattttgtgtgccttgtgtaatttttctcatttttctttatcaatattaatagatcaatgatcaattattattgagcactgatatgagctaaactttttttagactttgcaaacactgagagaatggtatctttaatttctgatttttttactatatataaattatacttcgagatcgcaccactgcactccagcctgggcgacagagcgagactccgtctcaaaaaaaaaaaaaaaaattatacttcagtttcataatgtagaaacgtgatgctttttcttaaagagataacatgagtggggctataaggctaatatatacaaaatacacacacacatacacacatctatatgtgtgtgtgtgtatatacacacaagcacatacacacagcctcacatccacatacatatacatgaacatttatctagatgacaaactatagaattgagaactcaatggggtgatatagaggtaggtagatagtaagttctataaatcagtgaaaatttgagatcaatgaaacctatcatagtcaaaaactgtttacaggaagaaaacaaatgtgggctgtgcctgatagggaggacataataggtaagggaaagtacgtatattcttttatttttatgtttatttgtaattaacacataataactgtgtatatttgtaagatacattgtgttgttagatctgtgtatacattatagagacaatcaagtcaattaacatatccatcacctccccaacttatttttatatgtgtgatgagatgttaaaattatactatttaagcaattttgaaatacaaaatacatcatcattaactgtggtcaccctgcagtgcaatagatcactaaaacttattcttccagtctaactgaagttttttgtcctttgaccaacatcttctctttccccatctctccccgattccctgtaatctactttctctttctatgagattgactcttctagattcctcatgtaagtgaatttataaaatattaatctttctgtgcctggcttatttcacttagcataatgtgctccagttccatccatattatcacaaataacataattcccttccttttttcagctgtgtaacatgccattgtgcatatatatatatgtgtgtatatatgtatctgtatacatatagctacacacacacacacacacacacacacacacatatatatgtatctcacattttctttatccatccagccattgatggcaggtgctttggttgcatctgtatcttggctattctgagtaatgctgaaatccacatgagaatgcagatatctccttcatatatgaatttcaattcctttgaatatatacccagaagtgggattgctggatcatatcgtaattccagttttagcttattgaggaaccatcaaactatctcccaaaatagctgtacaaatatacatttccaccaacagtgtacaagggttcccttttctccacatcctcatgtggagagtgaggattcggagaataactgtgaaatataacacttattatcattcatcttttttataatagccattctaatagatgtgaggtgatatctcatgtggttttaatttccatgtctttaatgattagtgatgtttcacattttttcatagatgttagtgattcatatctttttttgagaattatctgttcagatcacttgcctattttgaaattgggttattaatatttttgctgttaagttgtttgaattccttgtttttgatactagctctttatcagacatatggtttgcatatattttctcccagtccatgagttgtctcctcactctgttgtttcctttgttatgcaagagctttttagtttgacacaatttaatttgtctctttttgcttttgttgcctatacttttggagtcctagccaagatatcattgcccagactaatatcatggagttttttccccatgttttatttgagtaactttacagtttcaagtcttatatttaagtctatattttatccaatttgagttgatgtttgtatatggtgtgaaatagtacagttttattcttttgcatgtggatatcaagttttcccaatgtcacatattaaagacattctctttccctcattatgtgttcttgccacctctgttgaaaatcaatttataaatacttaggtttatttctgggcttttgattctgttttactggtctatgtgtttgtttttatgccagtcccatgcttttttgatttataatagctttatagtgtattttgaaatcaggaaatgtgatgctcaagctttgctctttttgttcaaaatttctttgggtattcagagtcttttctgcttccatatgaacttaaggattattttttatatttctgtgaaaataacattgcaattttgataggttttgcatggaatctgtagattactttaggtaatatgaacattctaccaatattacctgaccatgggatatatttttatttatctatgtcttcaattttttagtcaatgttttataattttcaataaacacatctttcacctccttggctaaatttactcctaagtattttttatgttattgtaaatgggattgttattttccatttctttttaagatagctcattattaatgtgtagaaatacaagtgatttttgtattttgattttgtgacctacaaatttgtttatcagttctaacagtttttttggtggagcttttagggttttctgcatataagatcgtgtcatcagcaaacagagataatttcacttcttcttttcatatatgatgtctttagcttattcttgcctaaatgctctggctaggatttcaagtgctatgttgaatataagtggcaagattgggcattcttgttgctgaccttacaggacaagctttcagcatttcactgttgagtctgatattagctgtggccttatcatacatggcttttattgtattggggtacatttattctatacctagttttttgagagttttaaacataaagcgatattgaatttgtcaaatttttctgcttctactcagatgatcatgtgctttgggttcttcattttgttagacatgccttacaagaagtactaaaaggagttattcaacctaaaggaaaagatacccctaagtagaaacaaaaatatataaaaatatggtcagagtggatgcaggtgtgagagggtccagcagaaggaaacatggctgccagcatgtttgagtctattaacaagtttggcctggccttatagctgttgtaggaggcatggtgaactctgccttatacagtgtgcatgctggacacagagctgccatctttgactgattctgtggcatacaggacattgtggtacaggaagggactcactttctcatgccatgggtacagaaaccaattttctttaactgatgttcttgaccatgtaatgtgccagtcatcactggtagcaaagacttacagaatgtcaacatcatactttgtatcctcttctggcctgttgctagccagtttgcgcacatcttcaccagcatcggagaggactacaatgactctgtgctgccatccatcactaccaagaccctcaagtcagtggtggctcactttgatgcaggagaactgatcacccaaagagagctggtctccaggcaggtgagtgatgaccttacaggtcatctttgggctcatccacccacctttgggcaagcagccacctttggatggcatgtccttgacacatctgacctttgagaaggagttcacagaagcggtggaagccaaacaattggctcagcaggaagcagagagggccagatttgtggtggaaaaggctgagcatcagaagaaggcagccatcatctttgccgacggcaactccaagacagcagagctgatccccaactcactggccatggcggggacagtctgattgagctgtgtaagttggaagcagcgagacattgcattccagctctcatactctgggaacgtcacctacctgcctgtggggcagtccatgctcctccagctgccccagtgagggcccaccctgccttcacctctgagggccaactaggccacagcccagtgattcttaacaatgcttccttttgcccccaccccagattggatgatttccaaatgacctgttttctagttcatcaatccttcttctgcttgttctacttggctgttgaaaccctcttttgaattgttattattatattcttcagctcaataattcctgtttggtgttttctaatatttcctatctccgttttaacgttcagtttgctcatgtgttgcactccacacctcagtgagcatctttattactgttcttttgaactgcctataaagtaaattctatgtctccatttcatcaaggttggcttctagagatttatcttatcttttatttgaaatgtattttcctatttcttcattttccttgactctgtgggattcagtaccttagataaaagaaccacctctcccagtcttgctagactggtcttgcgttggagatattcctcccaattagtatagccggagattctaggtgcctcaaaacactttgtttgtccaacctgctttgcttttattggtccctgtattagtccgttctcacactgctagtaaagacatacccaagactgggtaatttataaaggaaagagatttaattgactcacagttccacatgactggggaggcctcacaatcatggtggaaggcaaaggaggaggaaagtgacatcttacatggaggcaggaaagagcgcttgtgtaggataatgcccctttataaaacatcggatctcatgagacttactatcacaagaacagcagcatgggggtaaccacccccatgattcaagtacctcccaccagattcctcccacaacatgtgggaatcatgagagctacaattcacgatgagatttgggtggagacagagccaaaccatattgttccacctctggcccctcccaaatgtgagcccctcatgtcctcacatttcaaaaccaatcatgccttcccaacagtcccccaaagtcttaactcatttcagcattaactcaaaagtccacagtccaaagtctcatctgagacaagccatgtcctttctgcctataagcctgtataatcaaaagcaagttaggtacttcctaaatacaatgggggtacagtcattcagaaaatacggctgttccaaataggagaaattggcccaaatgaagaggcctacaggcttcatgcaagtctgagatccagtggggcagtgaaatcttaaagctcccaaatgattccgttgactccatatctcacatccaggtcttgctgatgcaagaggtgggtttccatggtcttgcgcagctccaccattgtgattttgcaaggtacagggtacagctccactccttactgctttcacaggctggcacggagtgcctttggcttttccaggacatggtgcaagctgttggtggatctaccattctagggtctggaggacggtggccctcttctcacagatccactggacaatgcccaggggggactctgtgtgggggcttgcaccccacatttcccttccacactgctctagcaagaggttctccctgagggctgcacccctgtagcatacctctatctggacattcaggcattttcacacatcctctgaaacctaggcagaggttcccaaacctcaattctggacttctttgcacccacaagcccaacaccatgtgtaagccaccaaagtttggggcttgcaccctctaaagcaacagtctgagctctacatttgccccttttagccatggctgggatgcagagcaccaagtcccaagactgcataaagcaataaggccctgggctggcctatgaaaaatttttttgtcctaagtctccaggcttgtgatggtaccaatttactatattagtccattctcacactgctgataaagaaatacccgagactaggtgatttataaaggaaacgggtttaattgacttacagttccacatggctggggaggcctcacaaaatggcagaaggcaaaggaggagcaaaagcacatcttacaaagcagcaggcaagacagcttgtgtaggggaactcccctttataaaaccatcagatctcatgagacttactcactttcaagagaacagcacaggaaagacccacccccatgattcaattacctcccactgggttcctcccacaacacatgggaatcatgggagctgcaattcaaaatgtgatttgggtagggacacagccaaagcatatcaatccccaagaaattagtgattgccaagtcatgctattgccttgagagagttggaatagcacccagtctcttgggattcagctagagaggctacagtgttagaggtgtgttccagtttcttattttcttgcagagaagctgagagccaaagtttgtcccacttattctgtccttcaccaaggagacagcctgaagcagctgcctctgctcataatcagaatgctcactttgagtctagtgagagagatgctgaatatttccaagtttaaaagtcttttcttgttccctgtggtctaggagactcaggagtgcagagctctgtcaactcccatagctaggtgatttaagagccattctcttgggtaaaggctataaaagttggggcactcaatgcatgcacaagctactcccagtgagagtctgcatatctagatttactgccggggcaagtcagggaaaaatatgcagggagagcccactctcccattcaaacaagtggaagtctcacaccctcctagcaggggaagaatgtagtccagaattatcactgaaacaaagcagggaagaaggtgcagggaatgcctacttttccattcaggaatgaagaggtcctccagtctctctttaatgagagattgcagaaatttatctcaaaagcaagccaaggaaggaagcaaggggcatgcccactctcctgttaaggcaagccgaacttttacatctctcttgccggggtagactgagattacaggaatttatcttaggagcaagccagagaagaatgtacatacaggacatgccttcctttctgtttaagctggaggcggcttattctttattggctatgtaggttcccagatactggcttgttaaaaggccagaaccacaggaagctgataggaaagcctgagaccaaatttgggggaatttagaagctgggccaatcctcagtgctatagctgctaggagggctcatgttgtgtccagaattggtggattcttggtctcactgacttcaaaaatgaagctgcggacccttgcagtgagtgttacagttcttaaagatggtgtgtctggagtttattccttctgatgttcggacgtgtctagagtttcctccttctggtgcgttcatggtctcactggcttcaggagtgaagctgcaaccttcacagtgagtgttacagctcttaaaggtggcgcgtctggagttgtttgctctttccgtccagagctgttcgtccctcccggtgggttcgtggtctcgcgggcttcaggagtgaagctacagaccttctcggtgagcgttacagctcataaaggcagcccggacccaaagagtgagcagcagcaagatctatcgtgaagagcaaaagaacaaaccttccacagcgtggaaagggacctgagtaggttgccgcggctggcttgggtggccttttattcccttatctggccccacccacatcctactgattggtccattttacagagagctgatttgtccgtttcacagagagctgattgggctgttttcacagagtgctgattggtgcatttacaatactttagctagacacaaaatttctccaagtccccaccagattagctagacacagagcactgattggtgcgtttacaaaacctttagctagacacagagtgctgattggtgtgtttacaaaacctctagctagacacagagtgctgattggtgcatttacaatcctttagctagacagaaaagttctccaggtccccaccctacccagaagcccagctggcttcacctctcaatggcactcgctgggggactttgcggcacctagcctgggcactctggcagcccagagagagcttgtcccccagtcaagcccagcaggtgctggccggccacgctgggtgcggggcccaccgaacccatgcccacccagaacccggccggcccacgggtgctgcgtgcagccccagctcctgcccgcacctctccctccacacctcctggccagaccagggagctggctcccgccttggccagccccagagaggggcccccacagcacagcggcctgctgaagggcgccttgagctcagcaagagcggacgctgaggccgaggccgaggaggtgccgagagcaagcgaggactgctagcacgttgtcacctctcgatgtgattcaaacctttttgttttttccttttatgtttgagataaatcttctgatgccctctccctgtggttcatcaagcatggtgattgaagagccgagccctctgtaaagactgcaaaagttggcactttatgtgtcgtacaagcaagccccttacccctcaggaagaagctggtagttgagatttttcctctcaattgtaaggctctgtgctctgggtggagctagtgtatgagtgtatttctgctttcaatatccattttgatgtgagtatttctcagtagtctggcatgtacgggtctttcatctggattttggctttctcttggagagaactgactcatgtttaggtgtatactagatgtgtctgtgggatgagaggtagcccagagcctgctctttcaccatgttgctgacataccctcatatattatttcataattttaatttcccaaattgtatcaagttattaaattcctctctatttcactgccatcaccttgggcaaagtcattatcatctctgttctagattgttgcaataactcctcaataaatcactcatttactcaattccaattcattgccaaataaaagctaagtatctttatgtgaattagtttgccttaatcctcataacaatattattttaccaggtttgctgggctagattcttctagtttcattttattatctgagacccaaatcacagaaaaatgacataactgaggtcacccagctagtaagttgcagagctaggatataatatcaggagctatagcctctactcataatcattgtactatatggtctccattattatttgttttcaataagactatattaaaggatgacttcgtgccagaggtagtatgtttatgggttaggggaaagataaagattaatataaaaacaagcagctgcatgaatttggtacaacagctgtaaaattagaaacaatagtagcactggaactgacattgcaaagtggagcttatgaagtttatgaactttaattaaaatgtcactgatgtgggtgccaaaaatcatgaaaaggataaagtatgttcgttaattgtctcctagcaggggaaatagagtagataatcaaatgagcaatgggcattttacattttgattaagaaccttctccatcataagacatttataaaaatatctgagaacaaagacaagctttaattccctgtggataataggatagtttatattgtatacatggtcaaatttacttgaaagagataaaatataaaatattaatctgttgaaagcctagaaaataacaatctgatatactcagtgatacaaagtaattcagatatcacttgttcatgtgaatgagacatcatgttttattcagcttatacagtttgttcagacattgtaaaataatttcagggaataaaatgcggtattctaattagaagctaatagactattattttagactccacacagtgtacataactcctggacattgatgttgtaattttaaagaaacacaacatttttaagacctgaataaaattctttttaaaaagcaagaatcagcgagtaatctatagatgttgatttccctgagaaattatggcaataaaagttaaataatatccaagtatcattttacttcatcccatatcaagtgccaggcatagttccttgtttctttacacataaaatcttgttagagtcttggaagtagtcattattattcccactttccactgggaaagttaaggccttgaagacttaaataataattttcacaagtatacatagcatgtgacagagcctgtagaaaaattctgtttgcttatttcatagcccaagttcttaatgactgggtcataatgttccttctttcttttctcactgccttttaaaatgttgagggtacaataaaggaaattatcgaggtagtcattgtggactccactcaatttgagttctttctgctttaacatttatttttttcacattaccgtggagtctaaatatatgacatttatctggtcaatatttcataagttaaatgttttattcttgtattagcttagtattactatgagtagatattaacttagtattactatgagcctaattaatgcatagtgttatgcatttctaccttaatctttttatttttgtgcaaattttgaggagaggctttacctaggaaatgcaatatcagcatttatctacacattctgtgagcacagatggctgatgggagaagcactcacattatttcaagagtcagtagcctatggcatacaggcaaaacatgagccagtatccattgagttatggaacagttgccaccacttctttgtatctatcctcaatatatttaagaaatgcctttatctgtgagaatcaaagtcagacaggttttccttgtcttacaaatatcaatgcttgcagcattatacctgtatatgtacataaaaatgtcattacatgtcaggagaataacataaaatctgaactttcgtatatccttatctttgccaattaagatggaaaggagtgagaccattggaaccctactttaaaagatttcaaaccagatttcatttcctgttctgtgtgcacgttcaggatgtaggggaaaacaaaacaatatcttttccctgcctgtcacaaggtttatgaccaacactcttatgaaaaagacagacagattcacaaaaggaaatcatgacaaatttatttaacccaagttttatgtcaaatgagagccttcagaaatgaagacctaaagatccaagaattttcatccttaagcatttgtttcataactcaatgacacttttatccttaggatccaagaagaatggacagtcatatagaagtatgattggacaaaaattaagtgtgatctaatggaattaaaggaggcagggcacttagcaaggtctgtttgttcagattcttcttggcctgcaaatatagggcagaacccctgtgaaactagagtcttatgatcttcttttaggaaaagtaagtcagagaatttctttatggctatacttcagggtagaaaggtgggagaaggtcagaatggcctcctggctacggcagttttttcagttgccaacttgacatattttggagtattatgttcagagccctgatattggcagagaaccaataaacccacaacctatgggaggaccaagaagcaacagagtggaaataaagagccctgtgcatctaactcacacaaccatagtgctaatccatatttatagaaaggcaaatggagagtcatgaggacaactgtcagtcagtagtttatattaaacagggcttagtctgaatttagtggagtacagatttaaaatgacttttttccccccaattattgcttttatgctctgaagaatactcattttcagtccttaatgttatttagcactgattttatagctttgtaatcacttctcgttattgaaaattctttttattttatttatttatttatttatttatttatttttgcgatggagtctctctctgtcacccaggctggagtgcagtggcgcgaccttggctcaatgcaacctctgcctcccgggttcaagtgattctcctccctcagcctcccaagcagctgggattataggcacccaccaccatgtgcccagctaattttttatttttttatttttagtagagacgaggttttaccatgttggctaggctggtttcaaactcctgacctgagatgattggcccacctgggcctcccaaagtgctaggattacaggtgtgaggaaccatgcccagccattagagaaagctctaatgtccactgtaaagccttgatttttgtaggcacacatagctcacattctcttctctccctaggcccatgatgaaagaggagcttggaatgagagagggcaggggtttgtgggttgccttccccaatgggtagggtgaaatgggaaggctagaaaaacggcaggtcttttctgataagtttgatgatggcttgccgttgttggcttcatatggttccacttgctattggtggccttacccaggtgattatcttctatacatagttttactgttttcttaaaactgtgctcagcttcagcctttatttcttctcttttccaagggccttttggagaggaagatcttagtctctatttcacccaactgcctttctcaaagtgtgcctccttgctgatctgccatattgttagtcccatagctcattctttcttttctatgttccatgctctatagagcccagaaatgactgaggtcttgtccagatgctattaaagaccacttcctccaaggttcactgcatcactggacctatcaattctgctggaacaacctgtaaaataaaccccaaccatagcttcagaattcactagattgggagtggtctctcttttactagggtcatgtagctctctgaacacattcttctctgctctaaaggcagcaccaggataacgtgctaatttgctgtacaactgtccagctgggagagaaataccagtctctccattcagttagctcccttgtttgggtgaaggaggaaagaagctcttcatttatgagtattccataggaagggagggaaaagcctctttaccaaacaccttgcatttttcacaataaagagaagaccttaaattccgtctcatgtataacaagtcgtgtcatttcttctgaaattggagcacctttcctggtcacagaatgaatgttgagtactctactaaatcatgtctgagagagagagaggaatacaaataaacaagttacagattgtggtaagcaaagagggaactaaacagggttctcttagagaaaataactggggtggggctactttatttttattttatttttttaaagattctttttttttgttattatactttaagtctgggatacatgtgcagaatgtgtaggtttgttacataggtatacacctgccatggtggtttgctgcatccatcaacccgtcagcaattggagaagacctctctgatgaagtgatgtttcagctgagatgacaagtatggcaaagaggtagccaaggtgaagtgctgacagaattgtattccgggtacaggggaaggagatttgagaatttggtgtgtgaaaaggtatgtggtatgttattctagaatgtggcagaaggccagtatcaccagtgttttttgacagagagggagaataaggtatggtcttagaggccctgctaaaggattttgtttatattcacagtgcaatgagaaaccattcaaggatttaagcagggaagtaaaattaagtaattaaatttttaaaagaccactttgatttctcactacaaaacaaattgcagaaagcaacactgaaagcagcaagacaattaagagtctgttgaattgacagataagagatgctggtgattaggacaaggatggtggccgcggaaacagagagagggctcccacaaaattcatgtattgaagccttcaattactgcctcacatatggcctgtgaggagggaattgaagataaatgaggtcagaaaggtggggtcctaatttgataggactgatatccttataagaagagaaagaaataccagactgctctctccatgatgtaaggacacagcaaaaagatagtcatctacaagtcagcaagaacacccttatgaggaactgaccatgctggcaccttgatctttaacttcccagcctatagaactgtgagaaagagatttctgttgtttaagcctcccaggattttgttatggcagcgcaagcaaacgaaaacagatggctatatggagaattattttacagatagcactactaggatttaataatagattgcatatgcatacagatgatgaaagaaataagtcaatgatatgttctagttttatttagttatttattttactttacttgtgtatttattggtttgactatctgggtgaatgttggcaccatatactatcaattggaaaaaaaaaatagaaaaaaataagacctggctgacagaacaggggtgaatcaacaaaccaagtttgaacatttctgtttgtatgtttctgggacatacaagaggaggtatcaagtagatgtatggatacacaagtctggatcccagaaaagaggtctgggctgagatgtaaatttgagattgttggcatgcaggtcctatgtaaattaatagtaacaagtgagaccacccatgaaatgtataaagagagatgaaggccaacatttaaatataaatttaaagtaaaaatggataaacatataagaagaggaaaatcaggagactccaagaaaacagtcaacaagataataaatgcatcaagggatatttgttattttgaccagaggaattgtgaggagctacataaataaacagtattttttacagtaggtcaaaaacgaatgtaaattgaggaagggaaagaacatatatcactaaatacatatataatatcactaaattacataaatataatttatataaatatataatttatatataaatatatatgaaatatatataaattatatataatttatatatacatatataaattatatataaattatatataaattatatatacatatataaattatatattatatataaaattgtatatatttatatataaattgtatatataatttatatataaattgtatatataatttatatatacaatgtatatattaatttatatatacattgtatatataatttatatatacattgtatatacaatttatatatacattgtatatacaatttatatatacattgtatatacaatttatatataaattatattatttatatatagtatatataaatatatatactatatataaattatatatttatttatatattatattatttatatataaattatatattatttatatatacattatatataaattatatattatttatatatacattatatatacattatatattatttatatatacattatatattcattagaatcttaattgtctttctgctttcactgttgtttcctaagaacatgtatcgctaatatgctaaaattacataattcataattctaccgtaacaaaaatataaaatatatattacagatacaaatatattatatataaaatataaaatgtagataaaatatatattttatattatttaatggtaaaaggaaacagataggatatagatattaaacaattgattttttgtgtgttttataaatttttgaagctatttgaaagatagacgactttagaaggtattatgcaaagataggcataatctagtaatgagaaacgttaatatttcaggagaaaagcaagggaaatgactaaattagtgacatccttaagaaagatacaagggatataatggaggactgaaaaagaatattgatttatctgtgataggatagcgattaactgcctccattttaacaggaagaatgtaaaaatgtgcgtaatcacaagaaggttcatatatttcatgaagctaggaagatgaggaagttatcaatcaatgaaatactttttttttttttttttttgagacagagtctcactctcgcccaggctggagtgcagtggcgtgatctcagctcagtgcaacctccgcctcccgggttcacgccattctcctgcctcagcctccagagtagctgggactacaggcgcccgccaccatgcctggctaatttttttttttttttctatttttagtagagacagggtttcactgtgttagccaggatggtctcgatctcttgacctcgtgatccgcccacctcggcctcccaaagtgctgggattacaggcgtgagccaccgcgcccggcctgaaatacgttgattatttaagaatgagcttccctgtcttttaagggggaggaaggtttctattcttctcgtatattcatctgtatttcagtgtttgttggacctatttttctgctagcattacactgtttaaaaattataaaataaaaaaatagatttacatgaaatgcacaaaccattattgattattatgacttattatttatcatcttttatcttctgataaaaaaagtggttgtctcttactgctacccaagtccaatagcagctcttttctaagctaaatgttatctgaagggtcaggtgaaaagatagtttttttttctttctttctctcttttttttttttttttttgagatagagtttcgcttttgtcacccaggctggagtgcaatggcgcgtgatctcggctcactgcaacctctgcctcccgagttcaagcgattctcttgcctcagcctcctgagtagctgggactacaggcgtgtgtcaccacatccggctgatttttgtatttttagtagagacgggtttttgccatgttggtcaggctggtctcaaactcctgacctcacatgatctgcccacctcggcctcccaaagtggtgggattacaagtgtgagccaccgcacctggccagaaatggccagaaagatatttttctttcaaaaaaagtaactctacttaaatcagatgtatcaaatgaaaacaatgttagttacagtataaaaccatgttttccaaattttgtaaaacagcgactatgacttctatttattgtgacaagaaaacctgtagcatatatgttatatatatatataattgtatgtatagtattgtgtgtatgcacatatatagaaatagtataagctatgattatacaacataatttcatagaaatcagtattttatggctagtttgcataatacttagcctcaaatacacagtgaattctaggatactaagaaatatatggtatattttctaagaatttatagttttaaaggagtgataaggaagtgaataattgtaatcagtcctaaaagcatgcttaaaataaaaaaggtacacattactaaatctccccccagagctttctagaagaaatgatcttggtgaagatgagttttgaaggatatgtagaccttgagcacctataaaggtgccctaacacatcttaataataaatccaaaggcttaagatgcaaggtatatgaccagcttagaatgaatgatcgtttataattccagatggatggagagtaactgatttttctccaaatcaaatttagtttttgacaatggcatgtaacatgtacagattcattaatagcagatttgggtaccaaatctactaactagcaattaggttaactactagaaactagaaattaggtattctaataaagagacatacattaaatgtgtcttacctccataattccaatgctacaagtatttaaatatatcaagatcttccaaattcgcatcctttgccaaaagtaagtatagtgtaccagttctaaattttgcatcagatatttgcttgaaacatgtaaaatacgaagatttggcctaagcttcagttgcttcatctcatacaatattattgcattatttacaatgattgttccttttcccagatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtacacaattctgacatttttctttctctacaggagaaaataaaattgaaacatactgaatatgtgtttcattattgctgttattcttctagttaaaatattgtttattaccataatattgcagaaaacggcatatgagaaagttgtactatgaagtaaattttgatgtaaaataagaactgtatttcaaacacctaaatattatcttttttttttctcaacccaagtgttatgctggaaaattggagcaagccatacagagagatctatatttattattaactcgaattaagaatatttttaaaaatattttagtaggggaagattaaatgacttcatacagaaacaagatggaaaattatgcagatatttaaatttatatttctgaagaacatagtaaattatcaataaatatgtgtgaaaaataatatgagtaaaacgttttcatactttagttacagagaagtatatatattgaaatagaagtaaacataggctatcagtgggtggtaggattatgggtaattcttttccctatatttttatatattttctaatattcatacattacttattttaagaattgaaagtcattaaaaaggaaaaaaatgagaaaatcctattactgggtggtgggattattaatgattacattctgtataattttctagatttctgcaatagctacattacttaaaacaaaaaaagccaaaaactgaagcatttaaaaagggagaaaaataaggatacaaaaggactgtttttatataggccttatggtcattagtgtcattattgtcattattatgtaacccatcaggacaacaacaaaaatccaggcctacatcctctttctgtaatacaatctattagctggcttagaaaaggctatttgattttaattggcatgctctgatttttgaaggtatatttaagtgtcaatgaaaagagtcaaactctgtaaaacatttagagctttactctgaaccaaatttgagtgaacctggcccaaggcacagtctggagagttccagagaacatgtgcccaagatggttgggttataggttgatgttacacattttagagagacataagacacatcagtgaactcatatgagggatatattggtttggtcaagttattgtctaaatacctagactcaataggaaagagtgactgggttaagataggaggttgtggaaaccaaggttcttattatacagatgaagtatcattggtggccaccttagaggcaatagttggcaagtgtttcctattcaaacctttaaaaggtgctaaactctcagttaatcttctcaggtttgggagggactggaaggggaaaggtctagatgcagatttttcccctacaaaagatgtctttgcagggccatttcgaaatatggcaaagaaatatactttgggttccttctttatctgtcatatgtttttatgccagaatgagattggcaatgaagcggctacgttgtctggagtaaatactaggggtttgtcctctcatgccaagaaaatttaggacagggacacacacgaggagtttaggagtggaggttaaataggcagaagaaagaaaaaggaggacagccctctctctggtgagagagagggcttccgaaagggaaagaccaccagagtcggatgcgcgcgattttataggcaggcttgagggggctgatttactggggcccacagaatggttggatcaggtgcgccctttacatagagtgcgggaaggctggccaccccaccctaatcttattatgcaaatagactttccactccactggcgccatcttgtctgctccttactgtacatatggctgccaaagagaaaagggaagatggagtcgctgtttggaacatgattggcccagctgctagcatctatatctgcagttcaattttacaaactgctctttgttagaaaatgattttagggctgcttttcattaaaaaggaaaaccttactgaggactcctgtaccctcactgcctaagtaatttcatcttaactcctatatcagcgactaacccacattacacagggttaaataaacccatctaatgagattgtatggtcaatacggcatgataggaacttggacaagagaggaaaaggtccaagtttagtcctcataaggaaattcaaacttttttttttttttgagtcggagtctaactctgttgcccaggctggagtgcagtggcgtgatctcggctcactgcaaactctgcctcccggttcaagggattctcctgcctcagcctctccagtagctgggattacaggcacccgccaccatggccggctaatttttgtatttttactagaaacggagtttcaccatgttggccaggctggtctcgaactcctgacttccagtgatccgcctcagcctcgcggagtgctgtgattacaggcttgatccaccgcgcccgcaaaaacttttttatatataagtacctagaagagaaggagcagaaggagcagtatgaagtttcttattaagatccagcatcgctatataaagaatgggggcattgtatgtttaagtgtgtgattaggaaaaggactttttcacacgttttcaagcctcttctatgttaaaaagctattacgaggaacaccatttcatgcatagatgtatttccctttacagtagaaatctagtccatatgttcagagttgaattcagcaagagcatgtaatattcaaagcaaggcagtgacatttatataaccttttcattttcttttgatgatactttttgaattcaaatcattacttgtagaaatatataagttcaaatatgaataaaggagtaatggaggaaaaaagtgtgttatgtgtgattgcatgcaatgtacattcaggaatatgagtaattgagaataattgtaatcacatgtattatattcatccatgatgaatatttgtgaaaagtaatgtgctagtcttttgtataattttccactgaatgaaaaaggcagataaatgatggaaccatttctcaaattataatgaaatgaataactttagaatgtaaagcatgggaaaaaatgcctgctatctggaactaatgactttatgttgcacaatagggactgtttgtatatcctggaaagtgcagtttttacattacaataaataatatttggggttattgttttataaaatggatttatttaaatgtagaaaagtagtttgggaggcagaacaaggacttttggggaatgtgttgaagatatctaagaacttcctaaagggcgtttatgtttacgtgtgtctcagagacagtcagtgcagctaagcaatgtagaatccaccagcaatagtgtgggcagagggaggaaaccccaaacctgaaacacaaaacaatgaattgcttctccctgaaaaaggaagaatggacgcaggctagaaactagtactggatgtctaaaacaatttgagccctgggaagatttcagatcatccaaaaacagataaaacaggttgcattcaggaagtcagaaatctattatttttatgacaacaatttcagccattgttaatttaggctaaaacagcagtggtcattttaatttaaaatcaaaatcatacacttctttgctatcctctggaatttttgattttctgtttttcatcactttgggaatgggtgagtttgtaaagagagaatctggtgtgtgtgttcaggaaggaggggtgggagctacatgcattcacatccacagttagaactatatcctttactataatacacatgcacacacaaacacacacacacacacgcgtatttatgaaaaactctaaagagtttatgagtttatattgagcttctcagaacttccttaacatggtgaaataaataatacttgttctttctagaaactcctctatatatttgttaatttttccaatatgttttgtgagatttctactttttacatgtgggcttctactctgagattttattcttcacttaggcagtttctcaaacttcagtctttaagtgctgagcctttataacttgaattatgacaataacttacttactttcaatatactctataaaatatcacctgactactgtattggttggcttcaggaatgtttcagctctatctgtcttgaactgtctgggcattctttctctctttgtattccttgaagtttgataacatgggcaaaccatcatcacttcttaccatattgttttaatttttattacttgtctctatatccaaagtagttcagagacaactatttacagtgcctagcaactttcctgtcattttgtttaaaaaaattttgttgaataactggaagaatgaatgaatgaataatttttaaaagagagccacatttgtttctttctgctgaattatccatgggtgtctggtttataccagggagactcttcacaagaattgtggcaaataagcctttgtcccacctctctgatccagccctggataaggacccactgttaaaagagaggtgaagggtcttcctcataaatctcttttattattattattattattattttatactttgagttctgggatacatgtgcagaacatgcaggtttgttacataggtatacacgtgccatggtggtttgctgcacccattaacccgtcatctacgttaggcatttctcctaatgctatccctcccctaacccccaacccccaacaggccctggtgtgtgatgttcccctccctatgtccatgtgttctcattgttcacctcccactcatgagtgagaacatgcagtgtttggtgttctgttcctgcgttatatcattctgtaaccacacagcaggttctccttgcccactgcccagacatagctgatttatgaagacaggggaattgcaatagataaagactttaagtcacataaagctggctgtacaggagatcagagtttcattattactcaaatcagtctccctaaaaattcagggatcaaggtttttaaggataatttggtggggggggggtcaagaaatggggagtgctgattagtcagagatgaaatcatagggtattgaagtgggtttttcttgcagtcttctgttcctgggtgggatcacagaactggttgagccagattacccgtctgagtggtatcagctgttgcatcaaaatgtagggtctgcaaaatgtctgcagcaatgatcttaggttttacatcacaacagtgatataatccccaggagcattttggagaggttcagaatcttgtggcctctggctgcatgactcctaaaccataatttttcatcttgtggctaatttgttagtcctacaaaggcagactagtccctaggcaagaaggtggtttgtttcagaaagggctgttattttttttttttttagcgttacactaaattcactcccaaaattagtttggcctgcacccaggaatgaacaaggacagtttggaggttagaagcaagatggagttgggtaggtcagatccctttcactgttacaataaaggcagtttcaattcctctgagttttccataggaaaagaaaattcctttggtttacatatgtgcttagggttttatgatttcaccataatcataggtacacactgtaatataatcttaccctccagggctaatacaaaagtctaacaggcacaataaaagcagacaataaaattgtctaacagagcaacataatacaagagcccacaaaccaaaataaggttacttttatacattttggtatttatatttcttaagactcccaattaatttaaagttaaaaatgagatgtataaatagcttcatgtgtgaatacctttatctgagttttttcacaatatctactatatatcctaacagtcttggcctatgctcattagccgtttggtaatattgacaaagttggtagagtctatttatgtcttctaaatagatgtgtaaataaaaaatagacatactttgaaatagtgttcaagaatagatttttttttttcacatttgtttagtttgatttctggctgtcttcttaaggatgcaaatactatatagcatcaaatactatagcatcattgatttttaaagccctgtaggctgttaaagcctatggcagttttcacaagtaattgagctgtttcagcttgaaccaatctgattgtcctagcaaatcctttgaagtgaagttatgtaagcaaaaactgctcttcacagaataccacattataaaaagcaacattttcttttcctcttggtcacaggtaaaaagcttaagaactttaagatagactatagtcataatactttctgtatatttgatatgctggctgttttataaatagtggttttcttttgaggggaaggtagatctctagctgtagatcaacaggcatggtgattagaagcagcagtttttatataacacccaggttcttcttcctttacttgatggacactcttgttttgagcagaaacatattaaaattaaatttaaaggatcccaaaacataccttaaaaggtatttgtatgtgacttggaaaaatacattattttttctttggcaatattgtagtttgatctgtattccagttaaacacaaaccacacaattacagaagactccttgaacttactttgaaggttaactccctattcgttaaccttttaaaaatgcttaagaaaaatcaactcaccaaaggcagcctttgttagcagcatttttgcattgttattaaagtttaaagcctatattcatttccatctcttgaaatttctatctatgaaatactagtgtttttgacatgctgatattttgaaaaatacaatatttaataaccagctctttgaatgtggggcctaatttcttctgtaagtcatgaaaatgttccaggctgattttgcaaccacattttgtttccagcaaaatgtgcagtgtgaatatttttgtaataatctaggaatattagctattggttggattaacaggaattcatctgaaaatagtatagcacttctgaaaataaagtacatttgtacccatgagttttgaacttttattttttaatacatgctttttcagcagcagcagcagccatagtatcaatgagggattgtggtatgatgaggagaaaattctaaattattttaaagtgccatgttataataacacataatgcattatttgtgtgatgccctaaaatgctaaatattgaaaataaagaatgacagctatattcatcaactgcttttccttgctacaatcaattaaaacagttttggattctataattctttaaggcattaggtcaacatttattattggtccttttattggtattctatgggtttttatttgtatttttataataaggatactgccatgctctgtcttcagttgttaagtgcttattaagttcttgtttgttactatgtcaagtaggagggactatgaacacttttaaaatgttgtctttgccgttaaagtgtgaactatctacatgagcacatgtaattagtttaaatgaaaaataagattaaatgcttaatacatgggaaacacattttcaagaattaatatgattcttaggtgaactgcttacattttcctagattcctccttctcgcccacagtcttcaaatgaatctccaactcctttcttttccaccttctaattgctctcaaatccattcgtcttcatttccagattcaccttcatccagacaacctactgattatcctaatggggctctgtcctagtctgttttgtgttgctataacagaatatatgatgctgggtaatttataaagataaaaagtttgactcacaattctgcaggctgggaagtccaagatcaggcagcccatctggtgagggccttgtgccacttcaactcatggcagaaggtggaaggggaaatgggtatgtgcaaggagaccaaacatgagaagaaacaactcacttttgaagtaactaatccagtcttgtgagagcaagaactcactccatgagatggctttaatctattcatgagagatccactcccatgacccaaacacctcccactagggcatacctttcaacactgcaacattgggaattgaattcaacataaatttgggcaggaacaaacctcatccaaaccacagcagcctcccttctcaaagcttgcctactcctcttagagcgctgctggaggaccttcccaaaccaaattatcactggtctcttattttcctaacaaccttttaatgacttaacacaaagtcaaaagccatgaacatgccaaaaaggccctgtgagatccagtccttgcccaactttccagtcttttcttgtacactttcttcccaagaattccacatacctgccacgtggaactacattcattgggtctccaagcttaacatgctcccttttaccttgaaggttttctgtatgtctaaaaaagtatttgagtagttaatgaatactgccacctttgcttaaagtaccataatcatccacccctatcaattgggtttgatgtaattccccccagggactccagtggttcctgtaatttccctaatgtagcatttatgcatgtttcaagtatttcttacccccactaaatgatgtgaataaaaggactatatctgttttattgttttttgtttgattttgtctttagagcttactgagctcaaatctattatatttgtactattttataacctacgtcagaggcaaatgaaatatgtaagtcccaatcaccattaccatgtatccttcaaatctttttcttatgcatttacatacatatacagacacatattcatatatataaaaaaacagtattgttgtaactcctttacttctaccttaatattatgtcctgcagtgttttacatactatttgcttagaattattattccattttgtagagaaatagttttatattgcatggatatatcaaaacttatttaatcatgccaatattgataagcagttaggtaggtttcagttgtcccttactacaaaaaagttacagaaaccctcctgtaacaacttctttgtgaacccaagaggatatttctgagggatgtggaagcattaagaatgagagcactggaggcagactacctgggttaattcaaatcctgactctacttaatctctctttacctaatctctgcacttagtttgtttgctataaaatggggattataaaaatacggccttccacataaagttttttgagagttaaatgaaataagatatataaatcacttaagacaatgtctggcaagtatcaaacaattagctgttattattattcatatatattcatagaatattctaagaatatatattcatagaatattctatgaatatatatgaatgacaacacaaagtttacttaaatttattagatcaatggatatgtagatttatattttggtagatattgtcaaaaattcttaacttcttgaagtacttttttatcactctcaccaacaatgcttgagcacttactgtatactatcaacattctagattatcaatctttttgtttttgcatatatatgtgtatagacatatatgtacatatttatttatatttgtatagataattgcacagatatatcgggggtcctgccccgataatcacgtaggttcttttctattttcctaagcgtcgactggcttgagaaataaaaggacagagtacaaaagagagaaattttaaagctgggcgtccaggggagatatcacacataggtaggatccgtgatgccccacaagccacaaaaaccagcaagtttttattagggagtttcaaaaggggagggagtatacgaataggtgtgggtgacagacatcaagtacttaacagggtaatagaatatcacaaggcaagtggagacagggcgagatcacaggaccacaggaccaaagtgaaattaaaattgctaatgaagttttggcaccattgtcattgataacatcttatcaggacacagggttttgagatcaaccagtctgaccaaagtttattaggcgggaatttcctcttcctaataagcctgggagcgctatgggagactggagtttatttcacctctgcaatctcgaccataagagacaggtacgccctgggggggccagttcagagacctacccctaggtgcgcattctctttctcagggacgttccatgctgagaaaaggaattcagcgatatttctcccatttgattttgaaagaagagaaatatggctctgttctgccgggctcaccaggcggtcagagtttaaggttatctctcttattccctgaacaattgctgttatcctgttcttttttcagggtgcccacatttcatattgctcaaacacacatgctgtacaatttgtgtagttaacgcaattattacagggtcctgagacgatatacatccttctcggctgacaggattaagagattaaagcaaagacaggcataggaaatcacaagggtattgattggggaagtgataagtgtccatgaaatctttacaatttatgtttagagattgcagtaaagacaggcataagaaattacaaaagtattaatttggggaactaataaatgtccataaaatcttcgcaatccacattcttctgccatggcttcagccggtccctccgtttggggtccctgacttcccgcaacacagataatctgttttttttccccaattgctggtagcaatgaacatcttttgcaattttctaatgacattgggatttcttctgtaaagaaactagtcatcctttttattcgtatgctttgttcattttgccattgaatatttttgccttacttttatctattcatagatcttcatgtattctggtgataaattatttgtctgttatatacattgtcaaggattttctctgaggttattacatgtgtgtggtaatttgatcgatatacaaaaagatattttaaaagaatttaactgttgaagtaaagtctatcttagcctttatggcttttttggtttatacattgttaaaacaatctcccccaagtatagcacattttatgtgccccagaaatatttgttaaatgatttaggcttgagttgaacaaaattgatgttttgcttgtttgtttgatttttagtaaagtcagtggtctctccgggccataaccatgaacagaataccagaatcagatatctttccttatgaaaaggggctttgtttgtatacatggaacaaaaataaaattattagcttgacagttaaaattaaagttttaagtaaatctattaatgtgattatattacagtaattcttgaattgtatcttgaattgtattcatgaaatagaactaataagcagacggtataaatattatttgttgaatattacaaaaatattgaattgaagatgggtagaccattgcatcctcatcaactttgattagcatttcaacaattattttgaataattatgttctcaaaataattttatcataatgaaatctggatagtttccaactatttctaaagtgaatagaacttaagttctagcatatatgtacacatatgtgtatacatacacacacactatatatatatttatgcatatgtatatatatatatacacacacactagaacttaagttctattcactttagaaatagttggaaactatccagatttcatacatatacacactatatatatatatttatacatatatatacactagatatctatatacactatatttatatatgtatatatacacccagtagagatatatatatatatatatatacacacacacacaatatatatataaatacatatatttagatggagtctcactctgacgccaggctggagagcagtggtgtgatctcggctcactacaacctccacctcccgggttcaagcgattctcctgcctcagcctcccaagtagctgggactataggcatgcatcaccatgcccagctaatttttgtatttttagtagagatggagtttcaccatgttggccaggatgatgttgatttcctgacctggtgatctgcccaccttggcctcccaaagtgctgggattacaggtgtgagccatcatgcctggacctagtatatgttgattcacagaataagtactaccttctagggttcagataccatgatcatttatatatcttgcttctgattctccttcaaagaaaacatggatacctctagtctaatcatttttttttgtatatgcaaccaatacaatagtctgaaattttatattaataaattctaccccaattggattggatgggtccttattactttccattaccctaaacctgctgaattagtcaaggtaggaaattacaaaatttttcaaattggtacaaatgatcaagaacacttatgaaaaatgcatggatttttggtcagtagttggctgagtttttgtttgatgtaggagtactacgtctgaattaaatattattcaagtacatacggaggctttattataactcctttcatctttcaacctactcttcagagtacctcagttttactagttaaatctaaggtaactaaaattgaatagcttaaaattatatgagtaattacactaaatttcaattctaatttcttaacaaaattgaagagatcactctgacacttagtagcagtcatttatataatgttattggtgtaggtggttacacattgcagatttcttatctctcatactctcagctaagtcccccaaattagatactctggtggattgcatttgtttggatttatactcattgtcttagtctgattgtgttgctataaaggaatacctgatgatgagtaatttaaaaagaaaaaaggtttatttggctcacagctctgcaggctgtacaagaagcatggcatcagaatctgcctggcttctgataaggggctcaggctgcttccactcacggtggaaggtaaaggggagccagcatgttcagagatcttgtagggaaagaaaggaagcaagagtgagggagatgggaagtgccagtttccttttaacaactagctctcagggaaactaattgagtgagaactcagtcattactgcaaggatggcaccaagccattcatgagggacataccttccttcacttcccattaggcccctacttccaacattggggatcatatttcagtatgaggtttggagtgtcaaatatccaaactatagtactcatctttgcctggattccaatgttgaaacacactcttctttgcctaaattcctatgttatactcattttttggctattttaaatataatttgagttcacatctggaatgacccagctacatatactcttaggaaagtgatgcaagaatggcttaaagaattaagaaacccagtcttttctctaccaaataataatataagatggataaatttctcagatatgctaaattgtccctttaaaatagtcacttataaaaacaaaacaaacaaacaaacataccacaaacttttttacaggacattaaactctcaatgacagattatctcaggaccctaataatttacattcccttggtagccgttcttcctcaggatattaatacaaattatctagaaaataaaaattctatacttattagatatctttatcaactggaattatgagtttgagagcattgcagtaaatcttcaatagggaagaatgctagacaatggatccaagctgggatgaaaagttgcatcagggaggcagggctagggctttaaaaacagaaggggaaacaatttctgaaataagaagtttatttaacaaataagccttctgcctgattttatcagaagcactattaatgtggaattcttgatgcctaaaggctggtgcataactgccttgctatgaaatatctggtgtgaaaggtctacttaagacacatacacacacgtatacatgattcgttaacacatcctcagtgtggtaggtactaattgtatattaattgcctaaaaatgtttatgttttaattacaggaaacattcaccaaaattaaatgattgttatattttacaaattgatttaactggagtttcaaaataatgaaagacttattgttggttacttcagttcagcaagtgaattgtaaattacatataatatttgcacactgaattaagatatattctaagcactcagggacactgataaaatgtatcaaaccggatcacaaggtcaggagttccagaccagactgaccaacatggtcaaaccctatctccactaaaaatacaaaaattagctgggcgtggtggcacaagcctgtaatcccagctactcagaaggctgaggcagtagaatcgcttgaaccctggaggcaggagttgcagtgagctgagatcgcgccactgcactccagcctgggtgacagagtgagattcagtctcaaaaaaattaaaaaaaaatttaaaaatcaaacagttaaatgtttataatttatatcgttgaaaataagataaatgaagttagaatgatactattattattactgaaaggtgttgtgtcagaattgtcattagtaagtgagctgtattatgccattttaactttctaattgttttgttttataaactttgcacattcttagtgtaacatctgtcgttaacaaaaacagagcaatacatttgaaaattgtgatcaactaggaattttgtacaacttaaaaatttagaaaattctgtcattttagcatgatttaattatgttttcaacaaaaattttttattaaaattaaggaatatagattacaagttcctaagttttcaatttttcaaagtgaacacaaaatcaaatataactaaatataaaactagctgtctcagtccattttcttttgctgtaacacaatacccgagagtgggtaaattataaagaaatgaagtttatttagctcagggttatggagattatgggaagtccaaaagcatagtgttggcctctgttgagggccttcttgctgcatcatagcatggcagagggcaagggaatgctcgtcagctcaggtctcttttcttcttcttttgccccaagtcccagtgtgggggtcttaccctgatgactttatctaatcatagttacctcccaaaggcccccctccaatcagcatataaatttgtggattaattttccaacacatgaaatttgggtgacacatttaacacattcagcctttgcctatgttatataaacaacagtgaaaggaatggagctttgacttgaaaatacaggtgggccaggtgcggtggctgatgcctgtaatcccagcactttgggaggccaaggcaggcagatcacttgaggtcaggaattcaagagcagcctggccaacatggtgaaaccccgactctactaaaaatacaaaagttagctgggcgtggtggtatgcacctgtagtcccagctactcaggaggctgaggcaggagaatctcttgaacctgggaggcagaggttgcagtaagctgagactgtgccactgtactccagcgtgagtgacaaagcgagacatctcaaaaaaaaaaaaaaaagaagaatggtgtagggtttttactaaaaggagctcttatgaggaagagcttagacatttgtacagattgagaagataagaaaatagatacaattttaaattctagatcaataagctttccagaaaatgttgtatttggaattgatttttagtgaagtaagctacaaattgagtaatatctagaaatattcaaaggctagatgttaatcttttagcgatgttctagtgagaattgaataagaagctggatttgatttcttatccaaactttctaactctaaaattctaccatcatagaaacttatatatcaatgaataaaatcacattatattttttctaatagactatattaaaatggaaagaaaatggatttcgactcagcacgagaatcttctaataaaaagcttttcaaccatgggacaggaatctttgaaagaaggcagctatacatccctgtttccctgggactcctggtttatgcttgtttctggagataatgatatatagctcctccattcactcaccacagtgtcctgatttttgaacaataaattacatagtcattctacttataaggcattgagcacactgaccctggaggtaactctctctagaatggactaagtggactgtcaaggataacaatcattctgacattgaacaggacatagactcttattcatccagattcttgtcctaccaaaatctaaaaaaaaaaaaaattatataagtcatttaggcttttgcagactatcagtttgtagataactgctctacctcaataaatttcttgatacacaagacaaatgcctttctttaaaatactacccaaaaagaggtaattaattaaaaatacgctatctctttggagataaaattatatcactgagttttgaaatttttttggaaatgtatttgctctcattttcttattaatttgtgtgattgattatccctggctttatgataataagaagtcaagttctaaatggaatactaatatttctaagtttaaagtttgtgatacctcaaagtatctgcaaacatttctacaggaatttaaatattccaaaacgccttaaaaaacttaatgaatattacaatgcaatttagttcatgatataccattagaaagaaggaaggagtgatgaattagtaatttcacagattaaaccacaggatgtggtagcttaaagaaatttagaaattattagattagtctgggtgcagtggttcacgcctgtaatcccagcactttgggaggctgaggcaagtgcatcacctgaggtcaggagttcgagactaacctggccaacatagtaaaaccccatctctactaaaatacaaaaattagccaggcatggtggcatacgcctgtaatcccagctacttgggaagctgaggcaggagaattgcttgaacccaggaggcagaggttgaagtgagccaagattgcaccattccactccagcctggatgacagaatgaaactccatttcaaaaaaaaaaaaaaaatcgttagattaaaatatgatctgaaaaacagaaaacggccaagattagttgtttcagttattcatggaatcacccaatggttaaacatggttgtacatgcctctacattttgtctgtattttaagtatacacacgcgcgcgcacacacacgcacacacatatatatacaaatatatatacacacatatgtatacagagagcatatgataatcatccaatgaactggtaagtaaagactaattgaatattcattgtactggtaaagttcaaaatgaaggctaaatagagctatttcttttcaccacagtttttgtttacttaagtgcaagtgaggtacattaagaaaataaaaactcaacggaaaccacacataacccacgttaattgtttatatttaaacttatctgtgtaaagtatggggaaattaagaaaatagaataggaatctgagaagttaaaagtacataaaataaatgtatgcggacatttgaacaacaggagcttttgtttcacatttaaaagcatagggaaaatgaatactaatacataattcaaacaaatgagtatacaaattactgaacaattctatagtgaatgttactggaagaattggctagcattccttttgatcaatccttaatataggccaagtgtagtggcttacgcctgtaatcccagcattttgggaggccgaggtgggtggatcacttgaggtcatcagtaaaagaccagcctgggcaacgtggtgaaaccccatctctactaaacataaaaaattagctgggcatggtggtatgtgcctgtaatcccagctacttgggaagctgaggcaggagaatcgcttgaacccaggaggcagaagtcgcagtgagccgagatcacaccactgcactccagcctgggtgacaaagcaagactctgaaaaaaaaaaaaagaaaaatatttcttaataatgtgatcccattttaactgaaatgttgctttgatgatactttattctaaaaatatcagttaaattgagcattagttgaacaataagcattatatcgaactagaaatattactcttttcattcagtaacatattttgatttattttgtttgtagtagttattttttcatcatttttatatacagtaatttaaactttcacttcataaaaaatgtaatcttatttgacttcttagttatagcagacataaaagaaaaactagaaacactaagtgctgacatatatatacatatccctatatattatgtatattatgcatatatatatccctcatatatcatgagtcctaattttgagtaacttatgtaataacagactattatttctatggatactgtggatctgactcttaaaaaatggacatttttaagggtagctatttaccaagatgaggtttttctctgccaaatgattaagtgtacaatcagaacatatttatcctttaaagttaaagttaatggcttaccaatctagaatctgcacctttaacaatgaaaatataatttcttcattgtcaagggagaataaggaaacttggaagtcagtattaaagagcaaaagaaccacctcctaagacattacatttactaagttctattttcttccattatgctttcccatgtttagagtccttatgtattattaacatggaagtaaacagagaaagtaagcaattaattgatgggcttcttatcagccttctgagtataaattcagtagggatgttgcccagaaatgtttatttttgttaggggctacattgtgctcacagaagtctttttttccactgctgtcagtaaagtagtaaagggtggtggctgtgtgggaaaaatttccaatgcatgatgtacatgaacaatagcataaaagttgtgttttattgtagagtcactgatgtcctccatgactgaccttctccattctcacagtcccaggccttcttaatcatctttcagggatcactctagcctgccttacgcatggaccagaaaggctgaagaaggctctttcttttttctactttcagatgccatcttattctggtattgacagccagatctttctctgtataaacctaatcatccaaaatgctaattgacaatgaactttatcccaaatcagactcctagggacagtaacattgaaaagatcttcttttcaccttgtagtaacttttccaataagaattacttgatattcagattttttattttctctggtatttattggcctcattctggaaaatcctcaaatataggtgggaaaggcaatacacaggaaccatcttgggaaatgtgttagcaactggcatcacaagggtactttgctgagttgcccaggaaaatggaaagatgagaggggatacaaggatctgcagtaggcagttaagggaaagtagaacagggaggagtagaggtacaggaggaaaaaaagaccatggtgttgtaattcaggggtcagcctggctacatcatgatggacactaaaactagatgaactaagatttggaacaatagtagctgtctttcacaggtggagctttggtcatgtgactcatggtctttctttctcctatcctataatctttgtcaagtgatccctatattcccgtagctgctttcaatgaattgcattctaccatcttttaaaaatgcaatttatttgaatataaccaataactgctattccttttcatccctttgtctgtaaattaagactttaacagaaaaaaaatttaacttttttgatcaagcatgtattaatacagaaataaagtcataattcaatactagcaatgtaaccttgggcaaattacctaatatctttacactctagtttctacctctgcaaagtagggattttaatatttaccacagagaacatttgtgagtattaatgaaataaagtatgtaaagatattgaaactgtatctgagacacactaaagacttactgaattgtaaataatatattaaaaatatctggagaaaataaggaagcactggctaaggatcaaatatttgatatatgtgtgtatatcgtattatgtttaaaagccattatttaaaatgtcattaagtaacatatatgttacatttttgtgcataataaaatgacacattcatttatataagcatatatttctggatttctttaaggtgatgtttcttaacctggggcagggataacaaactgaaaatctgataaagtctgtgaaattattcctaggtatatacatatttgcccaacttgatttacacaaatttggcattcatggaagctttggttcccatttatggaattcacaggagtctaagaccaaaggcctaggattctaaaggcaagaaagtaacttggaaattttgagtttgagtttactttctaaaatatgtacttttttttttttttttttttttttttttttggtattctgggatactgacctaacctcacaggcattaaatattttcatttaaattggcagttgtaaaggattatttctaattccaacttcaccttctatattcttatgaaataactagcttctccaatccttttgaaatacaagaccattttctcccacttgatcatgctggtatgagtgggatgatttagcagcactcactaaagaggtgcatcttcctctgactctggccttttaaactgggacatggcactaggagcaagagccaaaagtagaaaagacaagaggcttgctcacagagactaaaaggacaattgaataaggatgtaactgtaaactacatatcagtggcagccttggtttgaaggcgtctgactcagagtgggaaacagcttttaagtgtgttaatatcattttgtttatatttgacttttagtcctttgtatttttaatccctgactctgtcttcaaaactagtggtagtcaggttgtgttgtttgtcttggttctagttttctcttactatataacaaattaccccaaaacttagtggcttaaaataacattttattatatggcaggattctgtgggtaaggagcttaggctggactcgactggatgatttctctcccgaagccattgactaaagtccctcagtggtattcagctggcaaatgggctgttctgcaggatccaagatggctttacttacatgtctggcattttgatgtgacggctggaagacttggctgacctagaatggtcaactgaaatgtttatctgtgacttctccagaatagtaatctcggggtactcagataactttaaaggaacctggcttcccctagagcaaatgtttcaaggggcctacacaggagcacaagaattcttttgagctcatctcagaaattctaaaatgactcagattcaaggagatggattataaacgccatgtttcaaaggaaggagtagcagctgagcataatgacttctgcctgtcatcctagatacttgagaggctgaggcaggaggattcccggagctcaggagcttgaggctacagtgagctgtaattgtgccattgcacctcactgcctagtgagatcctgtctttaaaaaataaaaaaggagaggagtagcaaagtatttgtgtccatctttaacctaccacagtttttccccctaaactttgagtaaagagggttgagttctcagtttattgcacattaacattttggtccctaaatagcttatttatttgtttgctttatcccccattatagacaactattgcattttgtttaatatgtatattttatttgaatgttttactgaaaaatgtgtattgtttggggttgatttattttggattagcatgaatggcattgagttatgtatcttactactcttctttttatcatacaactttacgtggttaaaattaattccttgtttctaagtgtgcatctttgtgttgcaaagtcctcagtagtgggaatccactgcattttaactattcacccttccagtgatagttacccagagtatctccaacttcctgttaccattagtttcaacaaataacatcaataattgtctgtgttcaggcactattctaggtaaaagcagcatacgtattcttatggacatatgtccataagaatggggaaggaggatttctttctatgagcaaaagttctgagtcatagaagtttgtcagacggttttgcagcatcccagcaagtattatctcccaggtgccaattaactttgtccatggtgtttattttattaaacaagattcattttaaaaaattttaaatacccatcctattttggatatataatacattcacatgattccaaagtaaaaacaatatagcaaggtcaacatttagaaatcttagtcccatcctatctctacctactccactcttttcccacaccttgtattcatttcttctctattgttccaatgagaattcctcgattttgttgaaattgatttttttttgtcttttggtttatgctcttgaattttttttagaacatatttttagggtttttaaattattttaacattttggttcttcgtctttttattattttattgtctttaatagtctcaattaagtcttgtttctaataattttaaaattacatgcaaagggtataattttgttttattattttttactagataaaatctcaactttgtccactggaggatattcagcaatacaacatgtgatgatttcgtatatttatattgtgatatatttaacttactaattttgagaagcttcttgtgaattagttggcaaatgctacctccacatcttttatgaagctttggtccatggggatagggtaggttgatttgcatgaggagtccatggttttcctgaaaagaaggaatcatttctctccaagtttcaggtttaaagtgttaaattagggtagctacaaggaaagtaggttgcagagaaaatagggagaaccagtgagccagtcttgcctctaaatcagaaaagtggaaatagaaagagtggtcctggtgcacagagcaaaagatgaggtcactgattataactgagagcctccaggaccagatgctcaccggcaggagtgtggttgcttggcaccagccagtgagtctatttataataggtggaaattcttctgcctcaccacagtggtctggagatggtcctgagaagctccagaagtagtatgtgtttttcagtgaagagacgcaaccttatttgtaagatgtctcaccctgttaataagtttgccttgttttcttttgtttgttcatgggagacccagccttcattcttccctgagctctgcatgcagtggcactgtttcactgtagctggaatctctatcatctcatctccatgaggccaaaccttggggcatcctagttccctgtgtgagtggctcagtgagaaagtaaaaaaaaaaaatgcttcatattagagagccggggccagtttgaacaggaacatccttatccctgaacctaaacctatgcctaaaaaatgatgaggccctcctcacaggagaggaaaataccacctgttttcatggtcatcccaaacagaaaactttgcttctgttctcaatgtgaaatgattattcaaagccatcttaagctctgttaccagaattctccaccacttccacattaaaggaactagatcgggttcctccagattaaggccctcaaatacactagaatatgttaaggtaaatgaggtgaggccttggaatggcatagatcttgctactactgctactggggtactacaatctcggaactgagttatatcatttgtacttgtactttttacttatattaatcatgtgtccccctaattataggtatttagatttttcttttaaccttttttctttttttaaattttaattattgtggatacataataattgtatactttgatggggtacgtgtgatgctttagtatagtcatataatgtatgtcacaaacaagagtaattgaggcatccatcacctcatgcattgtaactcatttttaaaactagatacttttatttaattatatataatcaagcatgtatttcattttttaattttactctttcaatatggtatataactagcttaggcatatagagatcagctgtgagggtaactcattcactaattctgggttctcacattagcaaaatgagcaccacttgggaacttattagacccacactccgagggcggggcccaggaagctgtgtttaataagcccaccaggtgattctacatgctctaaatttggagaaccactgtgctcatccccttgtattcagtatgtgttgtcatcatctgtgcttattagtcaggcacagtctaaggccccattccaggcccacagcatcagaatctgcattttaacaagatctctggtgattcttgtggacagttgagaaaaactagtctgataaaaattgcttgttctcatttttatctgctctggttggccctgtctggtgttgcccttctggcctctgtaataaatgcacaggtttttccaacattgaatcctttaattctaaaatcactgagcttcaaaatatgattactttatatagaaggggatttctgcaaaaaaaaaaaaaaaatacaagttaaatctgaatgtcagatcaacaataaataatattttaatgtatatatgtttcatgtgacatttgatacttggaacatagttgtacaaataaattattacttgttgatgtgaaatccaaatttaactgggaattctgtatttttatttgctacatctggaaattctacatatatatattaattatctcctaggagaaccagtaatttctgccaacatcaatatgaatatttgctaaaacagccctgtcttgttacataacaatttttccgttcctttggaaaaaaatggaatctgaaattctgatctctacttctaataagccagaatctatatccctttttatacttacaaaagataaaatcgagcttagccttattatcttaaataagaactgacctaagaatcaaaatagtctgctatctgaagctagtaagagggaaggacaaaaacaaaaatcatttttgagaagcattgtctaacacataaaaattagtatcaactaattctctgcagtaagttaaatttttcaggtgttgaggtcacattttacaactaagtcattttggttcgtccatcaggagttcctatggatgcaaatttgatactttctgctggattatttcttagaggtctgatatggttaggctttgtctccccaacccagatctcatcttgaattgaaatccctataatccccacaggtcaaggaagggaccaggtggaggtaattgaatcatggggcagtttcccccatgctgttctcactatcactatcccataatagtgagtgagatctcacgagatctgacggttttataaggggctcttcctccttcgttcctttgttcggcatttctccttcctgtcgccttgtgaaggtcgcctttgccttccaccatggttgaaagtttcctgaggtgtgcccagaatgctgaactgtgagtcaactaaacctccctcctttgcaaatacccagtctcaggtagttatttatagtagtatggaaacagactaatataaggtccctctggtcttggaggttaactggtaacacctgttctgacttattgtttttaagttaaaattgtctgctatgatccaagttggggatttgcaggttaacacaggtttggtgacagaggggaactaattcacttccctaaagaaacctcttgttggtcatccttgggcccaactctatgtagatatgaagtgcacttttatttggatggagtactctttaattttaataatacattctgaagcctgtcctgcttatctggtttccagaacttacataagtgaccttaatcaacaatatcacattactgcaatttaaactcttacacaggaatactactgatacatgctttgtattttctaccaaaagtcttacagaagacaatttaagggatacactgctaacaatgtactcctgtacatttaaagacaatcattggatcaaattagaataccagagagctgtaaatttgatattaccttggaagaatcttcctttctaaattagctttttaagttttcccttcaaattttatcaattgtcatacaagatataatttcatacattttgattttcactttatattttgttaacctcactctcctattttatacacttgtatttgttatatttttaaaaggagcatagtatatagcacttctgtttttttattataaaaacattgatatgataaaatgcagtttaaagaattacacgaaaatgaatatctttgtccccagcatgctgttttaaaaactaggtactgattgtaccttaaaagcaccttttctgcatcttaattgtatcatgttgatcatcctgctgctagggttaagtgctatcttgaagattgtaataaactttcttttgctttctttccttattgagtttatcacacatatgtttgcttgcttttgatcttttatataactggactttatattgcactgagatttattttttgctcaacattgtttttgatactcatccacactgattcattttcactggcatataatgttctatggtgttacggtatcataatttatttttccctgctgccaattatggatatttgcattgtctcaaactatatgttattgtaaatgatgctgctgtgatcattatttttcatgttttctggtgcatagctaccagagattctctggggcttggtactgaaagtgtgcggtccagggactagcaacatcagcatcacctggatcttgttaaaaaatgctccaccctacatctactgaatcaaaatctgtatttcaaccaatcattccacggcatatacctacaggtagaattgctgaacatgtttgatttcacaagataatgcccagtgtttttctaaagttgtgccaacattacaacccacaaagtcctccttgctccaacattttctcccacagtggcattctcaggctttaaaagtgtaatgtgaaaatgagaagatgatcttgttaaaaatgtttgtatcaattctgtctgtaaatgcaattgatgtgcttctgtgcagccatcttgttcatgacattaagcatcaattatttttcagaccatcaatatttcttcctcttaaaagactgctcacaatttcgttcatgttttatttgtattttatcttttccttattgaccttaaggtattctatatactttgtactactactttgttggcttatagatgttgaaagtgtttttacccagtttgtggtttgcaatttggttccttttttctttttgttgagatgaatctagctctgtcacccaggctagagtgcaatggcgcaatctcggctcactacaacctctgcctccctggttcaagagattctcctgcctccacctcccaagtagttgggactacaggtgcttgccacaatgccaggctaatttttgtattagtagagacagggtttcaccatattggtcaggctggtcttgaactcctgacctcaggtgatctacccgcctcggcctcccaaagtgctgggattacaggcgtaagccaccatgcccagcctgaaattttattctttatgatgttgttgattaaagttatttttaaaacatagtcaaatttatcagttttttacgtggttatcagtgttttgtgctttgcttttgccagttcggtttctctggacatctagttttacacattttggaaacagaagacatggtgaatttcttatactgcaacccacttcatatcccagcagctatagttgggatgtttgtcccctcaaacttcatcttgaaatttgatcccagtgttggaggtagagcctaatgggaggtgtttgggtcatgggggtgtatccctcatgaatggatgaaatgtccttcctaggggaggggtgtgagtgagttctcactctgttagttcctgagagagctggttgttaaaaaaaagccctggcaccacacctctgcctctttccttctttctctctctcctgtgatctctgtgcagaatggctccctttcaccttctgccatggttgaaaacagcctgaggccctcaccagaaatagattctggtgtaatgccttcctacagcccacagaaccatgagccaagtaaacctcttttctttgtaaattacctggcctcaggtatttctttataaaaatattaaatagactaagacatcagccaattagttcccagtagaagtactatacacacaaggaaataatagccaaatgggaaatatcaccttatggtagccaggcagatgatatgcacccatcctcaaagcaaggagacacaatctcatctaggaacccaggctagtaaattttaaaaatgcattttaaatacagagagaatgaccagcacatgttttctaaccacaagggagcagcaagtggtggaggggctaaagcctctattcctgattgtcgagtccaggaaatccattcgttagtataacaccctcaatgaatgtttgggaactgagaccagtcaaatttgcagtgccttcttccacagccagggaacgagagaaccacaaaggcaatgaaacaaatataagtgttctcatgttcctttacctgttggccaaagctaaatatggtaagacagacagatagtaatcaccttgctccctaatttatatacagctgatttctcttttctctcttaactgacgaggctgtgtggttaactaagagaagcttctctgattcccagcttgataatgctcctcccctgctccttctgattatccagggaccagtgatttggccattcagcacttgcttccagaaatctctgaaacagatcttaataggatattaacatttcactcagaccacgctacaccatggatcaaaaattcatagttctaaacccaagtttacagtgggttccattatgctgtctaatatagtgaacctgaaactgcaccagttcaaataacaaaatgaataatgttctaaatttaaacaacataacccttcctcacattaataagtttctactgactgttctaaaattccctttgatatcatgtaaattcaaaggaattgtagtacaacttaattttcattcacaatttatgatttccctagtctcagctggaagagtgataaggacaaaagatataggagtaaacttgaagtaattaatatgcctggacactgttttgtatgtttataaacattatgaggactttaaaacttacagctcattatacatattccctttataatatcccctttaaaatattgtgccatattattaaaatgctatgcaaaataaaaatttaatcaaggcagtggctatacatgagataaaagtaatacaagctttagagaagggggaaatatgtggcaacaagctgaaaagattatcgtctgaaataatctccactaaaaaaaatctattcagtaactacatttttttttaactgttcccctatgtctattaaaagcactcttcattgcaagtaacaagctgcctggtttggagtgtggtagaattatagctcactgcaacctccaactcctgagctcaagccatcttcccacctcagcctctccagtagctggcatcacaggtatatgccaccatgcccacacaattttttttttttaaaatgtagagactgggtctcgccatgttgctcaggctggtctcaaactcttagccacaagttctaccttagccttccaaagtgctaggatgacaggtgtgaggcactgtgcctgtcatgaaattttcatgaaaataaatttctggggagttagttcagaagaaggtaaagctatctaattttgacaaggtaatgttaatatactattttatgtagttttgatatgtgagtttattaataaccaggatacattacatgtgggcatctgtctcagagtagtgagtactaattttaaatgactttttaaacttttttttttcttcacaaccccatatatctagctcttggaataagctgatagccacttcttgctacagaaatagaaaactgtaaatgtgttatttgtgaaagacacaagagctctggaagcaaatgcccaaggcagtctttattaaggaataaattcatttgactggtttgaataatttgaatagcaatgtgctgtctccacgtgatctatttcaggctttaatgctgttgtactgggttgaataatttacagaaaacatttgaagctattagctctggcattcaaaataccatgcttctcatacatggatagcaatccagacacacttagcctctgtatctttatatacccttatgaccttgtcttttatctcaaaaaagtaaaaaggaaaaactggaggagaaaagaattgaggttgtccttgagtacatgtgttttataagagacagagagattgtgttttctacctctgctgagcctaaaaataacaaacataaatgctgaccttgaggccagaatgttcaaagcttggtttttacaagagttccctagttttgataaattcttgaatctcagtgagtctcctcagcaacatctgtaaaatgggaactgattctgccccttgctatcccacaaaaaaaaattgagtatctaaccaggtaagatgttaaaaagacatgatgggtggtctataaagccctcctgcatggtttaaaatgaaattaaaaaaataatattctttatgggacccatttgtctacacactgaatgctgaaaccacaagttgaggaacctctttataagacacctacctcttctagtttttcacccagcaacaaatctctccagaacatgaatctgtcttccggctatgtgagctggttgccctgtttacaaacttgccagtagctgtggccagtgcctcctctttcccagagaaatgttactgattgagcaaagttatgaaatgatatttaactcaatcctaaaggcaaatgctgaaaagccatcagttttcttatgtgataaaagcaaatgaatgaagaataagaaatctatcttctcatgtacatattttcactactttcagttatctgaatgttttgtcgtagaaacacaaaaaacccataggtgtatgcctcttggaagcttccctacacatcatatctccttttcctaatttttcctaagtagaattaatcacttcattctcagtgtttctggagaatgcttctgtagagttaccttggttttcaaatgtcacatggctttagaatgaccttttgatgagcctaccttccccccaattaaggaatgatttctaggagccccatctttttctttctgtattgccaggacctccttagccctgcacctgtgactcagtagagcctaaggacacctagaggttagaaaataaatacaagaattttcagtgattatcactgatattggagttatagttgtattcgaaactatatataaatgtatacatatatgtaaaaaatacataaatgtttttctaagtagagacatgttttataaaagaaatatgaattattaaaatagttaaatattttattgattatacaaagtgattctgtagccagagattctagtcctgcgttaaagaacatgtataactcttttatctagaaagctttattctttgaaagtaggaaactcaattacattattgggtttgaaataatgatgtttctcattcgccatttgttgaacaaaataattgatgaaagcaaaaacaaattgcacatcttcaattgtgtaaaacattttcaatgacttgtctttcccctattttatattaatttttaattcacttgaaatagcaatgaattctttatacctgtttataaaaatggtgaaaatgtttcaaaatatcagttgggcaatgactaatagcaattataaatgcacagctcttgctattgtaaagggagttggcagcttatccctcctcctagacaaattaaaatgatgactatttctccctgttaagagaaaatgtagtagttctactaaatctgcaagtggcagctcgtgcttcatttgagactaggcttttgtttttaacaaatgaaaataatccagtgtctttgcttggatactaatcgtggaagataatgtcaaactggcctatttctacaattgtcgtaacttgcaaagcttcacagacagctgagttcattatgttgaagttgtcaatcacacaggcagtcgtttatattccttttgaactctgttatgttacctcatggatgactttttttctcttctcttttatatgatgttaaaacattccattctatctcctttacaattgacattctagaaaatacccataagattttctttgccttaacagagaaatacaatactttgttcattcaactaatgttagagatatgattccttaggctaatctcaaacttttgaaatcccattttactattacattgagaatttctttctacctgccttattaaaaactataggatgcaatagcattcgacaccctgtaaattcattataaattcacatagcattcaccaagataactcatttatatctatgaaatcaatagacagcctttaaactaaactggaactgaaagtattatcaatactacagaaatttttaagctgtaaatatgatggagagagcaatgttgaatagctgatgtgggtttttagttctgatcatctaacctccactacatcaaaacagttttgtggggtccccatttcagacaaaggcagtaaccacttatttgcttgcatcagaaaacttgccatcattcttctcagttacaaactttctagcaatcactacagtttgttgtttctaacgccagaatattcctggactttgtgtatatctctccgttctcactacataggtttgggcaatcaacattgatacttggtttattataatacaccttgcatcctccaatcttctctccactccaattccttttccatgtaacagccagagtgattcattttccacctgtttccttaattcacacccagttgccctttgagataaatttcaggctgctgcttaactcttccagtgatattaaatttctcatttttggttcctagacagcatcatactcttaattctctgcagggacaaactgtgatccttctggcagaaaaactacattttcccactagtcttcttttaccctagctaacttatgctcagcataaaagtctcttcactcagaaaaactattatgagctcctacaagtattttcagaagacttcctatatgttctcttgtacattttcattctacaccctacttttcaactgcatcctaattgtttatttacttgtctttatttacttctatgtggtagcattaaagaagatttggggtataatattttcttcaactgttgaagaaaaaaaagacgagtcacgatttgacagcaaaaggcattattaatatacatttcatcataactcgaatttattgacaaatgagcagaactatctaattttcttccagctcaggactttcaactccttagccctatccaagtatctaaaataatgtcattattacaaaggcattgcagttcttttatattgttccaaatgtgttttctccccttttcagggggtggggaattttctgctttctggacaaataaaatccacttttctctcacaatcaagtttcctgttgtataggtgagttattacactgccaaaacaccaaggatattaaatacaatagactcctgggacccttctctgtaatggccctttgttgttcttctaggtagaggaaaaaacaacgtatatacattgaacattttttgttagaagttatatttatgcttcattaattataacgcgtaatattatagggattaatcaaaattatttatccaaaccctcattactaggattctcggttatgtaaatctgttataaacagcataacaatgaatatttttaaagtaaatgtttgcccattcttaacatgtaaattactagaagttaaactgctggaataagtaacaaatataaccaaaagaagcaagtttcctcttgatttggcaactttatctcttatatttccactaagtctaaatttatgtattttttttagtgtttacaccttaggtatttacttggtactttgttagaaatcttttaggaattcaaaggtgactaatatataaaaatgcatatacctattaggattagtgacaaatacagaataccaaaagactgaatccacgtgaattgtggattagagaaataatccagtgtcatccacatataaaatttcctagcacacctacaagtctagttgattaaataagctccttgctttgtttgggattaaaagaacagactgtgtggggcaatccaaatggttaatggtagagatattttaaataatcattgcagtttatgaagaccagagccacagactgtctggtcttttgaaagtggtcctagcctaacctactcagtgatcatcaggaataccacaggcctttcccaatccagagaattagaaaccatgcccatcagtgaggactactgcattcacgtcagagatattcttggcttccagctcattcatgagaccacaggggccaatttaaatttcaaatcatcaatagggctcatttcatttagaatctcctatgaagcatggaaagaaatgcaaagttactgtgttggcaaagcattttatttaaagtatggttatatttaaataatccttttataatttaattttgaattcagaaatcctggaaaatgtccattaagcaaataataaaaccacaggtcttttttactataattataaaattagtttcacaaaggtcaaatttattttcttagtaaaagccctttgtagtaatagtaattataacttggaatttgattgtggttgtttaaagttttaatgtcctaatgcttattaaggaaatctacagtgaaattactactagttaacttagcactctctctgcagtgggacttcttgactacaaggtccttttggtacacaactgggtaaaccactgagataagaatcctaatttgttcagaatattagacttttttctggttcaattttttgaataatatctaagcagaagttattataatcagagtaacttttcaaatataccatctccaattattaatataatttttaaattgttaaattatttctctataaaaaaatatacatgtatgcctgttaaaataggcctgatatggctggcagtttctggtaaagtgccaggccccacataacaggtattccaagttagaggcaaggtttaaattgaaatgcttagttaataatttgtaaaatggaatatagtgatgcaggctcatgttagttcaatatgaagagacattgtaataccacaccaagtaaacttaaaatgtggtcttactgattacagagtaatatatgttcactgtagaaacctttctaaaaagtacttatgaatgataattgctttattggtaaattatgatgaggaaggaacaggattaagtgaagcttttagctatatttcaaatattttattttttaaaaagacagaaaactctgaagctaatatgttaaaataattgactttgttacatctagatcatgggtatatagtttaatttctccatttttgaaatgttttaaaatttaaaataaaatattttaaaacccataagcataccacatagtgataattattaacattttagtgcttagcatttcagcttttgttgtatgaatatttaaatgtacattttgttataaatatggaattataattgttaaatatttttgagcaatgtattttacatttttccataggccatatacagtaaatattaattgcccaagtcaaaataaaaatataaacacaaatctaaatttaacattcttttgggaagaaagaattgcaattttatgcatacataaagaccaggtggtctttatgtctgaagaacaagagaaaattgggggtattataaaaaagaatgttgtcggtggttggagagaaagctcatttatattagtaaagctttggggaactggcaagcttaactggtgggtgatggcagcaagcaaaattagttcctagacttgcagcaagttatctcagtagttatagataaaactggtctcaggttataacaggcagtttcagcagccagacttgcagagaatttcttttctagagcaatgctgtgtgccctgagtaccttgtccccctggcctctagactctgatttagttgagtatgataaaaataatccaatttgcatgatcaactttcacataatatatttttaacagcacactattccattaggcattttagctagctttttaaaagtagaagctgagttaattcctgcaatattggtttaagtattaccaaagtgttctacagtgtttgtaccaaattaaatacagaataaccaatttaaaatcttagtcaactttataggtgaaaagtctttcattgttttttttccctacttttttttccaatatgtggagttgtttcattgccagcgttttgaatagaaacactttcattgaggaattatgttttaaggctacctaagatttgtttcaattagggatggccagataggcagacatggaaattactatcttgaaggaggagttttactgtactcacagattcctggaaacaggaggcatgacacaccatgcagggccacatgaggcagccccacggtcagtcaggaggcagagggaggtggtaaaatgtgggcaagagcccctattgtggtttccatgagaagaaatgagcaatgaccaggtttaggatcagctagtttgaataatttccgtaggcataaggatagttcctagttgtctggtaccagggcctgggaaatttaggtctggtggataatggcctggaatttgagagccctatagagaagggtagttaaggtgtgggctctgtcatggttgctttgcatttgaaaggcaggctccctcatgagttgtctactatatctaggaattgactaacaagggtctgcagggccttatacctcaaattatcagaacatagaaaatagaaaaacatggttaatgcaaattggttttaaatatgatatttctaaatcctgagcagaggtgcataatgcactttggagaaaagaaattagaccaaagacaatacggttgtaaaaattctttattaactcattaggcaaatgtttaccaagcatctactacatattaggcattcaatcatgggcaaaatcagatccgcatcctgctcttacactctgaatttcattttcaaatacattatactggtgtggatttctcatagtttctattaaaatatttcaaaaccaagagtaactaatatgcagttggtatatctatcattatcttctgtcttctacataggatggtttctccagactttcaggtttcccttagtcttaactgtaataatactgttgtatcattggttgtttctaatttggaggaactttggataagtaacaaatttttctttcagtgactcaaaaaaatagtgggtgtactttaggttagaattaaccctgtgatgtgctttagtacttgccaccctctgttaataagaactgtgttggccaaatgtgatatttgaagtatactcgttatttggaaggaaattgctggaattttaaaatgtagttcttatagagacatgtttgattggaaataattaaatgaacataaggaatagcatttgctgtgaagttttacaaagagttttaatattgaattgtgctcagttcacacacggaaatgggtgtctactttagtgacaatggatagtaaatgattaggtttttttcaattatttaaattctgatttccaaggaatcatttgaacagcttttagtagtaaaaaactttattttgataatcaattttggttcctgagctttctctctctgtatatgacagattttctcaaattgatggcttattttgcagtgagtggctggaaaggattttatgttcaaactgctagaggtttatcagcaggtgaaatatactgtcagttgcaatgcatgttttgtaaatatatattttatgttttctaccacagaggtattttgcaggtgtattaggtcatattacacaaactgatttttaaaaatgtctattctaattctgtcttcaaaatggtagaatggaaagaatcacaatgttgtatatggctttcaaataatagactctgacatttcctaagacagccaggcatagtattatttccattggctgtgcagatctctattgctccaactctctaacttggtcaaaatatgtttccctcattctttatgttctacttgcatcttccttaatcctcttttctcatccttcttcatttatttacttatttaccttttagagacaagatctcactatgttacgcagagggcctaggactcttgagctcaaatgatcatcccacttcagcctttcctgtagctgggaactacaggtgcatgccactgtgcctggccctcctcattgataaaacatacatatattctccaaatgcaatgcaggaaaattgtttggctcttaatgtcacttcacactgagttttcttgatgatgacttcaatttaataaaatgtttttttgattcatttctttattattccgtgtgttgcctgatataatatattgctgttgatggtaaaaaggaatttttctaagtctcttcttccttttcttccatagctgaagaaaaatcattataccatcatcctaaatttagattcagaactagtcccacattaaattcatatgacaaagtccatgggacaaaaataaatatgtaaatgtaattgagttattgcctaacctaaaaagattagtgtaaaaatacatagtatcctcccttggtaatgatctaatattgaacaactaatagtttaccaaatatccttaacacgtttataagattttatccttccaataatagttaagttaggcagtcacagatatctttgttctttgtgtgtatgagtgtgtgtgtgtgtgtgtgtgtgccagtgcgctgcgcacgcctgtatgtgtgtgtagtatgtgcatgtatgtgtacatttatgcatatattcatatataatacatagatattttattcataaagataaaatttcaagtcatagacttttgaactgacccaagaaggcacacatataaagtaacatatcaagggctagaactcaacatttgtgtatcttgatttaaagtctgcactagctttttttcctttctaataaaatatacaggcatgtacaaaggaaaaaaataaagatcacccacaatgcctgtatgaaaaggtgttcacttacccagcaaatatattttaaattcctactatgccactttgctactagagagagccatagtgaaacaggtttaaaaaaatctatgctcttgtatagagttcacattctagtggcaatgatttaaatcgctaaaatgtgcaatatacattaagtgataatgtgatggaaaaaaatgaaactgctgagatggaggtgtggaatgcagtgttaaaagatccataatcagggaaggccttgttgggaaaataatgtttaagcaaaagactttgttacaaaaaaagatagtatattccagacataggtgggactgtcatgcttgaaaaatatcaaggagacccatgtgactgcagcaaagtgagaagttgtggaacatgaggtcagacagttggggaagaaggaggagaggaaaagaggcacataggccactaacatagggctttgtaggacacagcaagtactctggcatatttttctgagaaaattatctcctgttctggaaaaaggagtgacatgatgtaacttaagttgtaagaaatcactctgaatcctctatggaaaatagactgtaaatagctgagggtataacatcaagagcagttggtcttattgtgataatccaggtgagagattatgataatagtaacagatgtcatgaaatgattgtattcgagatatatttcccaaagatagagccaagagtgtttgcaggttgaacagatatgtgttgtaaaacaaaacatttaaatatgactcaaagttttgagcctgaacaaacagaaggaagattgggatagaaagacttggggaggagactggtttaggaagaagattgagtctagttttggatgtgttcagtttgagatgtattcatataataaaaactcaatgtcttcatttgagtggagtccagggtttaggaaaaaagttcaggctggagatataaatttgggatccatcaatgtttagataattttaaggtcagggcacactggatgagctcaccaagagaatggaggtaggaaaaaatgatctaataagggttgagtactgaggtaattcaaagatactaacaataaaagagttaattcacctctcaaaatgtgattgagttcttaagtcagcacataagaaagacaaactgtaaacattaatcttaaactccttaaatctcctctaaatttcagtatatgtggcttggtttataccagaggttaactatggccatagaacaaatcgaggctgctgtctgcttttgttttgtttttttatggcctatgaactaagaattcgttttacatttctaaatgattttttaaaatcaaattaagtatattatatcaaaattctatcaaattcagatttcagtgttcataaaaaaaactttaattacaacacacatgcttatttgtttctgtgttatgtatgactgtctcaactctacaacagcaaagttgaataagtacaacagagactatatgtctcacaaacgctatttgctctccggccctttacagacaaatttgccaaccactggtttatacaattttatacagttgtatctatatgtacagtaaagtgtattatataattaagagtgtgcgtgtgtgtgtgtgtgtgtgtgtgcgagatttcttagggtatttaagctttaaaatatttaaagcatttttttcttatggagctcactgtttcatttgcctgaggtaagctcactgttcttagtaccatatttgaacatctgtttaccaagtacattgcaagcattgtatttagtatgaatttgccacgcccattttagagacaaagtcaaggatcagagaggtcaaaacattatgagaatacaaacttgggtggatctgggttttacatctgggatctcttttactttaccacaaaccctgtcctgccctttggagctaaacatgggggcatcagctctcgttccagccaggtctcaaggaagataccagagacttggaggatattctgagatttagatttgaaaactcagtgaaattagttttaaaaagaaaatgttaaggaattgttacctgcctcaagagatgggagctatctgtttagggaaggggaacaacttagtaaatatatatatttgcttattcataaacttgttttaagaaagtggttgttactggagataaaatggtgaatgacacattaggaaaattttcaaactggcaagcaaacaagcaacttcattatgcaagagatacaaataggatgtgatctcataagactactattatacaatagagtgctagagcttttatttcttaaagagtatatttgagtattcattactaatgtttgaaacttacatcaagtcagtcaataaactacaggcatgcccctgtccagcatgccttttgttgcacagtttttttgacttgaaacttacctatgttgatcttgaagatccaagatcttcttgaatatgtgatctcaaatcatggctgtaacattgatatatacagtgaattaagttcatccctaactactgatataatcagaaaaggacaagagtccttccagggattttggttgaatgaaatgaggtaatagattaagaaaatatttaaaaaactttatgagctattcaagcttgggaagatagctgctctgactgtttttactgtgactaattgaacccctaagaagaacattttgcattttgagaggatatgtgattctgtcacttgtgtctatttatagatagaatatttcagcaagtggcaccttagtggcttggaaatatgaatacagctcaaaagggacactcttttctctctccttgtgagtcttatgacccattacttgatagaatatgtttctaagaaggattttatgtattctgtctctatgatctttacagattccttagtagatagtgtcattaacctcagatctagaattttctgcttttaaaacacaaaagactgtttgcaaattgcataatcacatagtaggcatttactaaatttaaagaaaattaatgctacatagttaacaaatagaaggagatcttgcctgttgactcgcctgacaaagacttccagcaaaccattatgttgttgttctgtcatccttttatcttccaactaacaaataacattctgacagtgttaaaggatatcagaatttttctgcagaaaacagccctgagctgacatcaatgctttcacaaaggaataaaataaaactgtgaagatattagcttgacatcatggggaaaaaattgttgaaatggatttacatctaaatccattatcccatttaatctttgcaaaagaccctgtgatgtaagtgttgtcttcgtttttcctatgaagattccagctcaaggtggtttaataatgcctgtggatacataattaagaaattgtggagaaacaagacctaggtcttattctagtttttgttccctttaaatgatacaatcttgcaatactaccacccccacaaccagaaaatctaaattctcttatttctagagcatctcattatgccatcactattaatcatgaattgctcaggtaagaattagtgcgaatagaatttgagaaaggtatattttgaattctagatggagggagagagaaggaaagattaattttgagcttttagaagagttaactggtaattgttgatgggatctatgcccactggaggacaccttaggactcctccaagcactgtgtggctaaaaatagggtcaaaaatataagaaactcagaatatgtggctgttgctaaaaaacaaactccacatgctttacaactttatccctaattagaaatgccttaggatccactatatggggaattgagacaacaaggacagaaattcttaggagcagcttttgtatatctcctaaataaggctttgaaaaagaccttagataaataagtgcttcactcctaaagatattgttgattaatgagtgattcatacttgccactgctattctttcttgacctcttagtagctggaaagttcataataatcctgaaacatgtagaacaaaagaccgatggtccctgagatcaagaataacctcacaaaaggattcaagctcaccaaatggttcaacagttttccatgttccccaggttgaaggtttcctccttagaaaaagcagccataatctaggaaagttgttgctcaagagaactttctgtgataatgaaaatgttctataaatttgcactgttcactatagtagtcactagctatacctggcttctgagtgcgtaaaatgtgcctagattgattaaagaactgagttttaaattttatttactttaaatttaaatgtaattattcggacagcacacttctagaaaaaagaaagggtgatatgctagacccagagcataccctaaaattgaattgcttttgagacccactgaggaatgtttgagtgacacaaactcctaataattatagaaattcagcctcttctgggaactccacctaattctggattggagatccttggagataactcataactataggctcaggtacaaatgctcatttctattgtaaagactttcaggtgagaatttccagacaatggtctcattcacttctttagcaatcagtaggaccttttactgtaatattctcaagagaataaaagctaaagaaaatatttgtagatattatctttcctctttctactgcatccaaattatactaaatctctattcaaaatttccattttagcctatagtaacattccattcctataactgaagctcatatattaatatttttattacagtccagcatcatacaaagtatagaacctttagttctgagactcaggttcaagcctagctccagtctttactgtccctctgaattgagggtaaccatttaaccttgctcagttttaatattatctgtaaaagggaaatgatatatatatatgtcttttacagaattattgaaggaattaaataagataaatatttatgtatttattttaaataagagaaataaatgctttccaaaactaaataaataaaatgctaggaaaatgtcaacaaatataattactgtcaaccatctgtcctctctctcacagactgaaccttcttcccatttctaaagttatatcctgatacagtttggctgtgtccctacccaagtctcatcttgaattgtggctcccataattctcacatgttgtgggagggagccagtgggagataattgaatcgtgggcgtggtttccccatactgttctcatggtagtgaataagtctcacgagatctgatgattttataaggagtttcctcttttgcttggctctcattttcccttgtctgccaccatgtaaagtgtaccttttgccttctgccatgattgtgagtcctccccagctatgtggaactgtaagtccattaaatgtctttcctttataaattacccagtctcagatatgtctttattagcagcatgagaacagactaatacatatcactaataatatcctatattcacatagaacactatattcacagtctgcttttaaatataagatactgcatgtatttactgcctaatgtcacctagattctctcctagaccctggtcaaatagccatgcaaattacatcttctagaaatattctgaaaatagatttgatacataattgttgtatacagtaaacaaccgtgggtttcatgtgttctcatcctggtatgaaaatttttgtcaactactccaaagctgttaatctaatatctaattattttaagtagcaattccagttaaaaatattacctcatgcagaaaattggaaagttagggaaaatacaatgctagaaagttagcatttcattgggcctcaccaccagcaataatgattgttaaaataattaacaagtaattaatgctattatttaatttctatgcttggattaataagttctagagattttgctttgttcagtacttgtatttcctcttctatatactctgcatccttgctattgcccgtttatttgtcaggaccttagtatattgattatcaattcatgggagcacatactgcataaaagatgatgataccacttgatctttcatatttgttataatattttattcccaatgcctttttaaagcttttaacataagttgaggatctaatttttaaatttttatgtacttaaatctgcaattatgcttctctctaaattttttctttattttgtaaattatctgctctccagtaatttgaccaattgtcagatttggtctctccataccaatatgtcacctatagatgttgttttttctcaactgtctttgctcataatattggagcaaatacaattaagagctcaaattgccagacaaagtcatagaaggaaaatgtttggtcttttcaattctgcccaacttgaaatgatggacaaagtttataatcatagattttcactgaaggcaaaagggactagccacatattgctgtaggtgtgtggtatgtgtgaccttctttcatgttcagcacaactctcagaagtagttagtattcttatttacatggtaagaaactgatgctatgagggactaagtaacattctaagatcatactgctagaaattagtggatctggcttccttatccaggttcagttggctcaaagtcagtatgctcttccctggactgtgatatttggaaggccacttaccttatcagaagtgtttttaaaaaatcaagtacattcatattaatgattctgtaataaccactaattatcaaactttactaagaagcagttcctgcttaagacctgtcatgctttatcttatttgagattgactgtaattctatagcattgtgttatatccctgtgttaaagattaggaaacagaagcccaaggtcacagaattatcaagtattggagagaggcttataatcttggtcttggttctaactcctggcgcttaaccactgtgcaatcctgcctcaaactactgtatacggtgtcatactttaaatgacttcccagtcatttgagagtgggaagaacctacccaaatgaatggctacccaaacagcttctttagcatatttgttaaattaggcacttgttatatactcacttccatttgaatagtgttaatagtgcttaatagtttctcggtgttacagtgtgctttggttggttggttggttttaagtatactttctattagtcagagattagagtcaaaagggaagaaacacccacacagtcacaggtttcctggcatgtcctagagctcctttgaaaaatgtgttcattccctcctgacaggagccctgaccccgaagtctgtcagattcataacaaagccatggcatctattttatgtttggggctggcccatctctcatgtgctatcacttgcttcccaaaggtgcatcccagcaggggaatctatttgaggaagtcccaatgtcattttatactagatggtaggaaaaccttcacaaagccctctttgtcactgttattctacaaggtcctggaaatacacttgaatatctagcgctccggagtttgcatgttattcagaggtgagcattcaggatgaaagtgcatagtcagaatcaaacagagcctttccagaagtttttaaagggtcatggaaatgaaaagactagtgaattctttcagataattctgcctttctacatttctcactagatttttagaaatgaacactgaaatttcaagataacatttgttgcaggttcactaaactaccttaaataccaaattatttaaaattaccacaacatttaaaagattgtaacaactcatatgtgctgtattaatcaaatgcaattttagagagtaccaagaatgtctccacaaatgtccacatgagcaatcgtcagtaaacaggcacgtataatccaaggagagagctataaagcaagagcctaaggatctacatttgattatcatcatcattaataattagacacataattgatgggatatgtcattagatttaccctgttaaattttcctatccatgaaatgtggataaaatacaactgttttaactggtttacaagaaaattgcaaggatcatctaagtaccacctaaaatagtttaaagcactttttaaatgaaagaaactaatttctaggttttgctcctccctgaccaaaatataaatgaacaagctataagtcttgaatcataaatatatcccttagaaactggaaaagtcagaatgttctattgcataaaatcaaattattcacaaacaacattgctgttaggtcaaacattaaagctgccacaagtcatcttttagtatgtggatgagcatggcaatttactatgatatcattcaaattgggaaaggccctagaaatggatgtaaatccaaaccctaggttgacacaggtgcagagagagaagccaggaaggggggagatggacatatccagaatcagatgctgggatgatgtccaagccagtaaacagacttaataacctaaatctctggacactgataaataagtgccattcaggcccacaggcaatataaattgggtccagtgttaagtaactcaatgttcttgcacatgtttgccaagcatggcaatgctggatggaaagcagaagtaggaccatattagaggagtccagtggaagtatcaggaatctagccattagactgtgcagttcaaaaacagatgtcagttctaagtgttgctaacagcaaggtaggattttggtaacctaaagtctatgggattcaaggacaaaagaaaaaaccagaagaaatttttatcaaaaatagaacgttagttcagagtgagaatagtagtgtctagtttattcatttgtgcattcaacaaacatccattaactcctgtgatggttaacattgagtgtcaacttgattggattgaagggtgcaaagtattgttcctggttatgtctgtgagggtgttgccaaaggagattaacatttgagtcagtggactgggcgaggcagacccatcctcaatatgagtgagcaccatttaaatcagctgccagcacagctagaataaagcaggcagaagaacgtggaaggactagactggctgactcttctggccttcatctttctcccatgctggatgcttcctgccctccaatgttggactccaagttcttcagcttttgtattcttggacttacaccagtggtttgccaggggctctcgggctttcagccacagattgaaggctgcactgtcagcttccctacttttgaggtttggggacttggactggcttagttgatccacagcttgcagacagcctattgtggaacttcaccgtgtgactgtgtcagtcaatactccttaattaactcactttcctgtatatatctatcatattagtcctatccctctagagaactctgactaatacactccctactatgtgcaaatgaatatgctagtttcagtaatgtgtggcgggggaaggtacagtagccctcatatgctcatgagggtgagcagagggcaattagcattgtgtagcagcagtggaaggcagtggggaccaggcaaaaacttaagagaacttcacacttacagcaggtgttcagtgataagtagaaactagcagttctactttgagaagaatatttagagcagagaaaatgtgtttttaaatgcctgttttattggagaacagtaaacagtttgatgttgatgaagattaaggtaggtatgggaaacgcagtggagctggtggcagggtagttggggacacaggatttgcagctgcaaagacaggaaacttagaggtctgtgaaggttcacgtgtgccatgtaagagcctgagtctgcatcaggaagcacttgaggaggccctgaaggacttgcaacaacaaagaatgactttgcgctttggctgtgattcagtcaaagctttaatggcaagaccatggaatatcttttggaaatggtgtcataaagcttgattttattatgttgaaggatctctgagtaaagctgaatttgtcatttggaaatatgaattaactttatcatattcttcttgcatcttgttgatgtttgccgttgtgagcttcaagaactgaattgaaaaaaaaatgcaatagaccagagctctggccgggcaaggtggctcacgcctgtaatcccagcactttgggaggccgagacaggcggatcacgaggtcaggagattgagaccatcctggctaacacggtgaaaccccgtctctactaaaaatacaaaaaattagccgggcatggtggcgggcacctgtagtcccagctactctggaggctgaggcaggagaatggcgtgaaccctggaggcggagtttgcagtgagctgagatggcgccactgcagtccagcctgggcgacaaagcgagactccgtctcaaaaaaaaaaaaaaaaaaaaaaaaaaaaaaaaaaaaaagccagagctctattttatgagatcactctgtcacttgtatacaataaattttgtataagaccatatcgatctatgtatctatcacaaggaatagtgtaggttctaaacactttgatcaataaaacaagtagttttatatatgcatataaaaaggaagaaataaaacatattaatcaagcatagactataaaaacttctccacagggttcatttttctttgaaacaaactactagatgttttaggaaatctaatttcatgtgaagttttgctgcattttagttccatgaggaaaatttttcattcatactttttcagtgtcatttgataacaatacaaactagttcatatattcttttagagaatgtacttcacaatttgatttggttgcaatgttcataatatgctaccaaaaaattagtatcccttttaataaataagttgaagttaaaggaaatacccagtattgctgcacctgcctcaatcccatttctttacatgaaccggcctcatctgtgcactaataataaagctgaaccatggacatgccactgcagttggcctcccatagctctgcactacctgtttctgttctgggacagtttataagattatgccaagactggtttcccccaaacttgtctttgagtctcaggtagataaaacaggtatttacttttcagaaaagtaaagtccatagctatttattgaatgcttgctaatattgttaggcacagttctaggtgctgttcatgcattgtcacatgtaaggctcacagccaatgaggtaggtacttttattactcccagattacaaaggagaaatttgaggctcagacaggtgaaataacttctcaaagtcacccacagaagaagcagttgtatacaatgagcttgaattgaatgcaagttagtcaggctccatagctcataacttgccaacaccacattcttcttatactgtggtcaatactatgagaaatgtttcccacactacataagtttcttcaatgtacctcctagggttagtactttcaatgtgcctcccacttagggtacctagtcagtgtcctcactgtctttcagctctgtctactgaaatttagcctctccttggtttctgtggaatttggcaagtccagtgcagtgtctaactgggaccatctccttttggcagcatcaagttaggcttactgttagtatcctccaaacttgttgctctggtttgctggcagctggagtctagctttgacagttactcagaaatggagcattggccttttttctctagtgactcggtagttctttgaagaaagtcatgggaagaatatgagctttacactacaatgacctgaatgcaaacatcaactcagccatttattgttgtgcagcttttgtcaagtgatttgacctctttgagcctcagtttatcatctatataatggatattaaaatatatacatcattaggctttttgtcaatttaaattaaataatagaatctctctatattcatggaacccctgtatagttagcactcaatgaacctgccttgttacaactttaaaaaaattatattcacttaaaaaaatggggtataactgaggtttacatatgaagttatgggatacatatagatagtaaaatggttattacagtgaagcagactaacatatccatcacctcacatagttacgtgtgtgtggtgtgacaggagcagctaaaatctaggtatttaagaaagatccctaatacaatacaaatttattaatagtcctcatgttgtatattacatctctagacttgttcatcctacacatctgctactttgtattcgttggtatctccccattttctctcctccaccctgggccctgttagccctagattttttctgcaagtttgacctttttattttaatttcacatgtaattgagatcatgcaacattttttctttcagtgtctggcttatttcacttagcataatgccctctgggtccatccatgttgtggcggatggcaagatatcctttattcttgctgaataatattccattgtgtaggatgggtatatatatgccacatttcctttatccagttgactttggtcgtttccatatcttggctattgtgaacaatgctgcagtgaacatgggaatgaagatatctttacaaggtggtgatttcatctccttcagatatatatcaagaagatggattgctgggtcatatggtaatctatttttaacatatttaggaaccatcatactgacttccataatagctacaccaatcaacattttcaccaacagtgtataagggttttcttctctctacccccaccaccgtttgctatcacttgtctcattgataagagccatattaatgggtgtgaggtgatatttttatagtggttttcatttgcatatccctgatgattaaacatacattttcatatacctgttggcatttttatatcttctttggagaaatttctgttcaggtcttttgcacattttttaattgggttgtttttctgctattgagttgtgagggttttaaattttgaatatcaatcccttatcagatatgtgggttacaaatatttttcccactccacaggttgccttttaattttgttttttcctttgccagacagatagatgccttttagtttgatgtagtcctttttttttttttttttttttttttttttttttttttttgctgttgtagctgagcttttggtgtgatatctaaaaaatcttggccatggccatgtcagtttttcctctacgttcccttctaagacttttatggtttcagatcttacatttaagtcctttgttcattttgagttattctttctggatggtgtgaaatggtggttcaatctcactttttttttttttgaatgtggaaactcacttctgcaagcaccgtttatcgaagagaccacccttttccccattgtgttctcttggtgcccttgttgaaaattagctgatcataaatgtttggatttatttctaggttctcttctattccaccggtcgatgtttctgtttatctgccagacatcatacttcgtgattttaaattataatttgtaaccttagtttctcacagcagttctctctactgcttcttcatgtcagggttcttctactcgaatgccagtgtttctatacatagaatttcccattgttttctctgacactaactttctacctgactggatttctgccattgcctgccataacccttcccagtcagaaattagattcagttggaattgaatcataatccatttaatttttaccttttcttttgtggactgattttggccttacaaatgaccttaagcttttcagaccccactcaactgccattagaatactacacggcagctttgtccccacgcccagccacatgtttttcttcttcccaagctcaggttgtatagcctgtagatattcatacctgaccaagtacttttggatgtgccatctcatttaatttttgcagtaattctgttgaagcactgtaaaaggtcacatgagataacggagacttgccttttaaaaatatttagttaaaccacatgacatggctgatatttggatatctttgacctacaaaaacaatttcttaggattcaatctaatccttccttgaatatgcaagatatgagttcttaaatagttttagttcacgaagcgcatcagcacaggtacatataaatgtcacacttcattctgatattgtatttgccacactaaaatgaggaaaggcatcttatgttttcttttggcataaagcacaggattccaagggactaagatataatatgatataataaaagctcattgtagtgctgggaaaagtaagtcattcattatcattactgctaatatgtgtaactgataaccccagagtttatttataaatgtagcaagtatttctcacagcatccacaagacaatttttagttcgagaggctgcataaaatgagtactttcccaatacccatttaggcaaaattatccactcaataaaaatgttctagaactttggacactgtgttctgaggtcggattgtttttgataatagattatgaggtcatgtttttctcttgtaccagtgtaccaagaagaggatttaaattttcttagtgacaggaatctcagtctgggccttctgactttcttcctgccagtatctttaattgccatgtgttcttattgagaagaaaagttgtcatcaggttctctttgatattaaaatggtttcaaacacctcgatttgatttaatttaggtctgatattgctaagcctctactaaacacaatttcaaatgatttctctttgatcactattctattggtgagataaacttctcagaagtggcttaaaatctgtttgctttgttttttgacaaagttatctacagatttgcccattagctttttcctattaatcaagttaatttaaatctaactgctaagtaggttttccttagaactctttttaaaaaaactgttgaagaaatgtgtctctggtggattattctgatttcctaaactcagactctaaaattgtgtgttttcatttaagagtctgagaattgctagtgttcaatttgctcagattggattttagttatgagaaatctagacacatggaaaaaagtgctttttaatcagttcttgaaatcaatatagcaataaagcaatacatgagaaattattttgaaaaaaattgtatagggtggatgtcacagagtattctacatgaatactcatttcatatcttgcatgaggtactttatcatttacactaaattattctacttaggaaacttcatcactggcacatctttttgtaaataactacctttcctcaattttatatgtccaatatattctactttaggtcagtttttcccaaacctccgccattaatttacttacctttttattacctttgccatattctaatccatatttatttgtttctttaaattgattttcaatcttcttatacttctaactgagccttaaactataaaactatatgttgatgcatatttttcaaatgtacattaaataaatactttgctgttagcacataaattgataaccatgtactacctatagttattatgtcttccactagactagataccataggtatctgtttaggaaaagcttttggttgtcttatatgatctatataaatatagatatttgataatacctgtttttattaacctgaagattgattgaaatgaaataaaactgtgggaacttagtgtataaaaaagaacattatatttggtattacatgaactagaagatctatcttctaattgcttttgtacctcctgcttgcaatatagttttggggacgtacatttccaaggtcaaaccagttgctgcatctacacattaaagacatagaatcattaaaataatctctaagatctcttttagctcttaactttctaggagagtcaaaaattctttgtagcactcttggatgacttatttggggcaatatgtattctaagctgcattactgctatattttgtaattaaaatattttgtattactggtgagtattaacctttaattttcatatttcatgtgagttgtcttctctttattagagttagatgtttgtcctggtgtcccagttctattcccactttctcattcaactacatgcacagtgtaagaagtggggtgctgctgacatttaaggcgtgtaaaaaggcatgcaaattatttagctagctgagtttagtcactagcaggtagtaatcatgagccattgtgcatagtggatgacaacggcgaaaatacctgacttgtatctttcctatgacattaggcaagcttatcaaatattctgatcctccatgttgtcacctgaaacaaagcttcattactgaaggatatgggtcaagggatgactggtcattcactgggatagtcatgatactcatttatatcccagtatcagtcacatttgacattcagctggagtgatggcagatgtagataacatcggtctttcagtgtatgcttcatggaggataatgatggtttgcagctattatgttcaaatgggacttagaaaatagcctactaattaaatgactaaatcaaataaaactacacattttaaaatttctcctttatttaaacttagcaaattatattttttgatcttctatactgagtttctgacttactcatctcagcccaatttgtgtatatctgagctttgagtggaatgtgcccttccaaactataatacttctatagaatgtgaatatttttacacgttgcttatggaacactcaacttcttgaaattctcatctgatttgctttgctcttacacaaattacatgtgctacacatatatacattgaaacaaagccacttttccaaacagcaagttctcttaccatggaagtgtgatccagttatctttgatatttcatttctcttaaatatcttttagcaacacacatcttagaaagtgttgtcattttttataaggtgatatattttaggtgaattttcatatttgtagaaacctattttttccactcttcactaaatgaactcagatttggttactcatactaaatgctctggctaaacatcaacgaacagaaatcatttatcagtctaaaccaactttatatgcatttatagaatatattcactttcatataaaattttacaattccgtatatattaaagcactatctggactcaaaatcactaaatttgaagtttctatgtaatataataacttctaaaatgggaggtttatacaatactacaaaggaaaatcatatttggatccatgggttttatttgcttttttgattttttttcttttcaggattacaaacaataagtcttactgtttttcaaattatatccttatttgctaatttgatttacaaatgcacatgatctttgagcacattttctttgcatcattccaatgtttacgctgctaacttaactacttagatacttgccacgtacagtctctagctctttatgagaagctacaatggaagaaatgtgtgacttgcattcatagtactgtgaatctgttcactcactgaaattcactaaaaacagaacctgttttcagccattccttgtttcaatctgcattccttgtctgaataactgtaataaaataggacaaaacaaattttgatgggcaatttcatcgtagcccatctgttcggttatgctgggaggcaggaacctagtcttatctgtcctgctgtttgcagggctgtcttaataaagtttggtgaatcagaactacaaggtatttcatttacttctatgtgtattcctgtgttttgactttccttcccctgcccttcacagtggagttaaagcaggaatctagtggcatcagagattggagtctaaatgaggttgaaactagaccgggtatcctattcaaggtagtcttgaaaatagagcatcagcgggacaagtcccaggtagccactagggaaaactgagattcaaacactaggaaaccaaatatatactccaagttcaaatgacaagagaaatctaaagtgaagtttcagagccaagagtgagcaggtgggcagagaccagatcagctctggagctgatcataatccagtagggagaattgctgcctgtagcgatggttcctggaactaccattcacctactggaggcttcctagaattgaaagatcatgaaaatgtggacaactaccttaagagctaaaacgaggcaaaggtgagacttacggtcatctcttaccttcctggtaaaatttctcagatcatctgatacaatgtaagacaatctgcttgtgatccataggccactcgttcttcctccaaaatggccttgtacatgttactatattttatttgaatgtaaacacaattaccaagcagtaaataatgattttccttacccattgattagtgcatgttgatactgaagatgcattgatttgtacaagcctagcttgaaatggagcagatgggtatgtaaaggtttactcaaaatcaatgtgaattagattgctgctcctcagtaaaatgaattataagttagaatggctattttctttaacttaatgtaatagaatgctgtctaaggcaatctgttaaggtagacttactgaaaatgtagcctttgatctcaaaaataagcattcccaaaacaacatgatttaatgagcaaagacaatattatgtctaagaaaatgtagttaaggcattgtagcaaatgtcctggaaaaatgtttgacaataaacttgttttcttttaaaaaataataatcatgttctttcgagttatacagtattacactgactgctttttttccttgattgtttgtaaatattcacatatacatatgttacagtggtttaatcactgtactgctcacagtgcagcagtgctgatggatagcttttgttaaagaaatatcattaacatttatatccttgtttactgctgttgcttacaatgtaaagaaaacaataatccatttatagtccactggctgtatattcaggctttgttcattcctttaaaaagaatagtccaaccattcatgttcctgaaatattaagggaataggccattctttgtccaacttcttaaatagatctttgagtttcggaaaaactatgggggagagaaatgtgtcaaaggaagtaccacagactgtgttttatcccagtatagggtgctgctttcgcagaaaagcgaaaaacattcccaaataagagtatatttttgttttgctactggaattattcctcagatggcttgtgcctgtttttagagtgatacaaatttgcaacgtgtacctatgtgtggatggatgtctcataagtctattgtcataaatgtgactattcagtatatctttattgagcacgtatgttgtaccaagtaacatactgtgtactagaaatttaaagaaatagaaagcagagctcctgctttcaaggaactcagtttgatgtggcaccatgatagctctcaggcaatttaagtctatacaagaattcagagaaggaaggatgagattaatccagccaaaaagggttgaggcatttgacttgggattataaagatgaatcatactttagaagcatggggaaggggagtgaagatggggttggttaaaaacctaggaaatttgaaaacaaaaaatgaaaatacaaaacacaatttggaaagatgggttatgtaaaacaattggagcatggagtgagtggtggggaagaaagtaaagtgatcttgcataaatagcctaatttctctacatatttttcatattaaacacccaaaagaacagcttatttttgtctgatatttaagttatgtttataaagattttattgagcagaatgtgatcaacactgctggtattacaaagcataggggcatgttgtagattaatttgtatgatgtatccatatacggtttatatgcatatatagcataaacgcttccttcaagattggtatatgtgtaacctaaattagtctctagctccaattctgatactgtttaagtatgtaacattggctaagttataacatttctaaaatgtaactagacggtctataattctttcagccaaaaccttttggagtgatcttatgactttgtgattcaaggctgaatatttggaatcagactgtcctggattgaaatcctagctctcctgcttgccagttgtgtaaactttatcattttgctgtaatacagtgcattctctaatcctcaaatccctcttatataaaactaaaaatagtgtctatctcataggattgcctttagatttagtgtaaagtgcttagcccatttctgtcacatagtgagtacttaacagatgctgcctattactattgtgcgattccatactgattagtaaaagaatcatatccacttaatttctgggcctttgaatgtcaaaaactaggcctgtgtcattctaataagcatgattaggctttttaaataaacattattcacctcagtcttgggcagtgatttctcatgcttgaattttagttttggctttcctaagacttcttagtttagcttctggcactctttccaagacttatttattttggaaaactaatatgactcatctctcaagataactggcccttgactgccatacttgatttagtttgcccacagttcttggtaaaagatcctgctactactgagcccagtcccatggaatcagctctaactaagctatcacttcagacatagaagagtaaagaacaaagagtaaagaaggcaatgaagataaacaactgagtgtccacaggaactggtggcaccctattttcacaaaagaattggcattaagaattggaatggtccttggaagtttctattctaacacatattttcagagtgtaaaaaatgatcacaaattctacccccacccccaccccaccccacatcaagaagtgagtctatctagtttctcgcttcttgagtctggactagtcttattacttgcttttctgacatacatgacatagaataaaatagagtaggttttgattctcagactaaagatttgtatatttcatctctctctctcccccacctctcctttcatcttttcctctctctctttctctttttctctcggagaatgtttagcatatgagcaagccagtttaaactattggtgggtgagagaccatgtgtagagaggtcccattcatcccagtctttctagtcaaagtcatcttaaactagccaacccccacccaacccaaaagctcttgccaaatgcaagagaaaacttgatatacaagaagaaaaaataaagcccagctaagcccagacaaattgttgacttacagaattatgagctaaaaaaactggtcattgttttatgcactaagttttgcataactgctatactaagcaatgcatgaatcacctctaaaatactgcctacaagtggccaaatagctattgcattaaggaagaaattttctccccacattcattttcatgagtgtgaggatactatatggctcaataattagcgtaggtcaacctttcaaaccctttaaagtattaaagtaatcacgtgagttttcattataacagatttaaatcacaaatgaaattgtcagtttatttttgagttaccaaattccttacacagcttttaaagttgcattgtacactgttttgctttctcatttactttaacccagaaatactttctaagcttaagtacattcaaaacttgtttttttctcacctgattctactgatctctgggatttgttattttcagaatccattgtttgttttgctaactttttctcgcactgtattacctttcttggcttaaaaacccaataggcttggtaagccagatgtacgcctgtccaaccagctcaccccagtttgaatcactactctttcatcttctctgccttcccagtatggcttagatattctcaagccttggcttgcttccagtcttttcagaacagtattctgaattatgtctatagcatttgttttaacttttttttgtggagcggggggaagctcaaatgttctgattatttattctgtggatttctgcagtggaccagtgaggattctgcctgtcatagttatctccatcaatccatcagctaattgcacgaccttttcttaaaaatgcaattttgttgcaatcactgttctgcacactctgacccattatggtgatgaaagaaaattaaaccacattctaaaatatgaaaaaaagcaaagaacagtgtgatgaaatgaaatggttatgtctatatgctgaaatgtaaatgtgggcaaattctttttctgtagggagtttttatgtgaagctcttttggaataaatataaaagataaagactggagttaaatagaagtgttgaattgactccccagacctatgccttccacatcatgtttatgcaattgtgttttaaagtcaatgtctatattcatctgaaaatatcacccaagtgctttatcccatctacaaaaagaatcatatttgagaactgcctagtgggtaggcatagacgtctcaatccctgtatagccttgagatgaaactatctagggggtctaaaaaatgaaagtcttcaacatatatctttcaataattattttttgtgttaagaacattaaaaatccatcatccttgaattaaaaattgcatgagctaaaaatcacacaggttatatatattgaatggaataaaatgagaagtatactatattgaccagaggtaagatactgttgtattatccttacagaatttaaatgaaatcataatttctatttataggcaagctatatggtattgagacaaggaaataatttacaactgttatagttatagaaaggttatttctaattttatctcatggagttaaaatagaaacttaattttaagttaatctcacttttgggagtgtaatagtgcaacctctttgttagcaagaatatttttaacctaactgtataaagcattaacacattgtgtaatatcacttatcctgtaggaaatcatcaaaatctgatgattacggaagactggctttacaagttcaagggagaatatctcgactccagtaaattccatcaagactgagaaaagtgtgatcacgggcagttagaaagtatagcaaattcatatccttaggctgctttctaaggatatcagtgaaaatgaaatcagacctttcttaaaatgcggttatctaacacagtattttagaattaaacttttaatctgttttcttatatgactattgagtattgttatccttcacttttgttgttttgttttgttttgttttgttttgttttgttttgttttgttttgagacggagtctcactctctctcccgggctggaatgcgatggcgcgatcttggctcaccgcaactccacctcccgagttcaagcgattcccttgcctcagcctcccaagtagctggaattacaagctcctgccaccatacctggctaatttttgtatatttagtagagacggggttttgccatgttggctaagctggtcttgaactcctgacctcaagtgattcgcccgcctcggccttccaaaagtgctgggattacaggcgtaagccacttcaccaaagagttatccttcactttttatgtacatttgcattcttgtactttttgcaaaaatataactgccagtttagcacctactagacaaactagttcaacatcgttcaattttcacatgaaaattagcatcccacctagttggggtgatcttcccattctgttcttttttcttttcaaatgagtaaaatcattaacttcatagaggctttatttatccatttatcctattcactgaacacctttaccaagtgtgttactagtttagtctctgggtttctaagaatagatacgttttttcctaagcaggtcacaatcaattgttggatataaatgattttcatacaactaattcccaagcatacccttcaatttaaaccagagcaatacagctacccaccctcaaagacaaaaggaaaaatatatttgtgctctatttataaattgccaatattttaaaaagagaatgaaaaactttgaccttatgctagaacttgccgtttttattataaaaagttccacaatttcatctgtgcattactatgattcatcccaaaattgttttaaagggtaagtattcccaataaaattaagattcaatttggaaacaatatatctatttcataaagtaaggtggacttctgtgacaagatcatcctatagatgaattgagacttgactgaagtaaggaaatgtttcttcaccagctttattcagagaaagtggcttaagtcatcgacttaggattccattgtctgcattctttcctgttagatactcagtaaatataattagattgattaactgactaaacaagtcttacttactgcatgagaagaactatctctgtaaaaggaaatctcccttagcagccaaattttctgaatgatgtcttcaatgtgaagagtaataagtattttcctccacagaaacctgacccaatatcagcctggtgaagagacctagacctctggccattagtgtgaagtcaatgctattgacaatcatcaaagattttcatcctttccactagagtacttaagaactaaatatcattgatgagaactaaagcctgttgatgtgttcctgtaattttaattaataatacattaaatttttttcctgattgtatgaacatatatcatttaacaatgatttataccaaagccattaggaaagatttagtgtcatatcacagccagttattctcttttcttcttccttacccctaaaaaatgtcccagatgcagaaagtcataatctgatattcagatatttacatttaaaaggttcctgtcttttaaagagttttcaaagttctatctttgtctaaaatatatagtttagaaaatataatgtacatgtgtattgcatatatgtatattacaaatttaaggatgtatatgtcactcgctatatatgtaattaacatatttaatcatgagcactatgccttgcatatgtagcacagcctcagacataagtcatacctagagaggagtgtgatggaaacaaccagaacctcgtaacaagattgagtaaaccaactgacatcttttagactgagatatcaagtacaatgagttaaactgttaaagcaaattcaaatctgctccaagtgagcattaatttttaacatgtattatacatgtcacgacttctgagcagtgttaatcaggtgagaattctcagatgagaactaaggttatatgtcaaggaagcgggaatttgcgcaccgtgggaagaattcctctgtatgatggacagaaacagagttggagtccaacaatgattactgtgtggaaagtgatcaccagagaagagggaaggcggaaagtatagttacacaaaaaagcaagtctaagtttcaatcaggtgatctcaaataagtcaattccaaatgtcacttaaggtacagggactccaacaaactgtgtcaaacatttaaggtgagcatatagggactgattagactggattatgaatgatatgtaaaggaagaaataccatggaatactctcccttagaccaggttggacactgtgaaatgaatgggtttcattgttgctactttttatgttcattattttagttaaataaactccttttttaaaaaaaaattgaaattatataacagagtaaaaatagaattcactttttacagtgtagagagtttctggttataaaacagctgagatgtaaaccataaatgagatgaaacataagtgattcgaacataagcaagatcattctaaaaataactatcagggaacaagggagttcaagatgttaagatcccttatctatgtggaaaaatggatgataactttgtcaatcccctctctagaaatgaaaacaaagaaaaatttaaaaatgaaaaggttattagcaaatggtccagaagtaggccaggcagtagaaagcatgattttgttagccattagttacatagagcaggttatgtacgtccctacctggaaagtcataaaacattcctgaaaatcctagctggcatttccagcaaattgtgagagaacacagtttacattctgaagcccaagaagcattgtttttttaatattatgtaccatttcactacttaccatttcaagagtataaaataacaatagaattggccttctcattctgatattttagaaaattccacattttcacggttcctattgcaaacaagaataaaatcttttggcagagcctgactataaaaagatctagaagctattcttataatgtaaaaaaagagtatgtttttatgaccttgccaatttctctattgataaagagtaggaagtgtggatatgatctataaacatatttttaaatgacaggcatagataaagaattctctgaagcagaataatttatggaacaaaagcagttaaggatgaaaacatttatcatgggaaatgggaatactgtgagtaaaaagttcaagaataaagtatgatttatgataatagagattctcacaatattttcagaactatagttgaataaaaatatgtagtatttgattgaaaaccaaaacagtggattaatgtaactagaaaagtttgggtttgggccaacagcggacattgaaatatgagtatatttttagaataaacatctatatatagctccagtgaattcactttgattaaaagataattcaatggataaattggataaaatatgtaaaaaaaaaattctctggctctgatgacaaaaaggcagtttcacagatttgctatcagaaattactttttcatagaaacctacatatatttctcttttattctgatatgagcttctcatgtgagattagtcagtgtgaaggccagtatagctcagacaaagctgaccacagcatagaaacccctgccaacactaaggtcacacccctctctggggtgtgactgaccagatgcaggcctgtctttcccaaagaaccatggctgccacttctgtgggatgaaggccttttttaatggagaatatctagtcaaatgtctccgtaatattaccttcattgttcgtagagtaaaatgtaaagggttttaacttcagaggaactgtgcacaggcagggaggtgggtgaagttgacctaatgcagagatggggagccacagctcagggtcaggtttgtcatctcttaattctgtttatgccattgacttgttattggatggtgcacaggtaattgatttatctggctaagttttcttattactaaaatgaagttaacatctgcatcatacagttataggaacagggcctgggacagaggaaactctcggtaaatgttggctattgtaattattaccttagtatgacatcctcccgaattcttcataactttttggtaactggtaagagatgttgaggggtaacaagatcctgctggggtaccattctccttgacttccttcaaaggtcagattttgctggccttaaaccacaagtcatcagtaaatgtaccattgtgttccggaattgtaaagtatctagtggaggctttaagaagacaccgagttgttgttgttgttgttgttgttttcaggattatacttaatttagtcaagacagatttcttgtgatgtaggttccgtgtcttgaataaataagtacaattctggaaaaaaaatgtttcaaataatggtaatattagggagacatataaaaaatttagggagccctaaaaagcctgagatagaattggtttcagatgacactaagtatctcgtatttccaaggtactttgggagaggcagcatggcactatagaaagagcacaaactttgtaaacagactggactaagtcctgctcacttacatgtaacctggggtaagattcatttatagaagcttcaattttcttgactgacgtaatacatatgtgcctgatttctgtgaaaattaagaaatgaatgtacaataccaaaataatacttcagtgtcagctctcaggaaaggaaaatcaaagacctctgtttaagcattgcatgtttgctgataccatgtcagtaccacacatagcttcctcaaaccatttgagtaattcttagatcctggattctcttgggttctatggtttgaatatttggcccctccaaagttaatgttgaaatttagtccatccataaggacaaagccctcatgagccagtctcctcttaaagtgccacagtagagattaagtttcaacatgaggtttagagggggcagatattcgaatcacagcaggctgctataacagaataccatagactaggtagcttaaacaacagaaattaattcctcaaagtgctggaggctgagaagaccaagattaaggtgtcaatgaagtttcattccaaagcatcttctcttggttgataggcttctcgctgtgtgctcacatgaattctttacaatgtgtgtgtagagggggagaaagatatttaaatttctgcccagtctcttgaaagatcaccttggctttcatctcataattctcacctgatccatactgttcagaagtcttaacatacataatccattttagaaatgatgtggccatgaatcctattggattggagccctgccctgagatttcattttttaaattttcctctgaaagactctattttcaaatataatcatattgggggttagtgtttcaacatatgaagtttaggtgggggatacaagtcagtctcattgaagataataaggcataattactgagggggatttatatataggtagaaaagtagagtgggaacagatcttgaaggtcttctagactagtctaaggggtttgattttatcctaagagatccaaaaatcattgaacaggtttaaaacaacaaagtctgatatgcgtttttcaaaaaattactctggtggctatgtggaatattagatgtaaagaggaaaaagcataaacaggaaaactagttaagactacttcacagtcaaaaaataacttgggtgaggacagcagtaggagaaatggcataagtgaaatgggctaagatatgacatagagttagtcaacagggtttgtgaataaagttaatgaaagggaatgatgaaatagaagcacaaagtcttctaagtttcttatgagctgctgtgtggttagaggtaccatttgctaaaatggagaagattgaaggaagaacattttggggttgggttgggctagatccagagttttgtttttagatttgttgaggtgcccttctagatattcaagtgtaggtgtcaaataggcagacttataaatcttgagttaaatcaggcttagtgttaacttaagagttatagataatatttaaatccatgtaacaatttgaaaattatagctagtatttaaatccactggactaaatgagatgccctaggaagaaagtttccattaaaacaaaagagtctcagaattaagtctcagggcacaacatttagaaggccaacataagaggaggcaccaacaaagagaaccaaagatggctataaagttagaaaaccagaagaatgtggtgtcatggaagccaagaaaagataagctagcaagaagggaataggcacctgagtgaaaccctgctgagaagggaagatgaagacaaagaagtgactatgagatcaggttacatgggaggaattggtgacttagaggagtttcaatggagtggtgttgatagaagccacctaagtgtagattgaaggcagaataggaagtgtggaaatggaaaatgacaacatatgctagtgtcccttaaccccagatccacccatggaactttagagaatttccaatgcctgatcccataccagaagtagagggatgaacttgaaagtatttttgaagctggagtatttttaatgagtttccaggtaattataatgttgctgtcaatgttgtgaatcactattatagacaaatgtttctagaagtttttgagtgtgtgtgacagcagaggggtgaccatgtggcaagaaaagtatatgttgttattactgtagttttgattgtatttttaatagaaaatacaagaggatattatgaattcatgaggaaaatcctatataaagggagagaaactgatgattcaggattaagaggaaacaatagcaaaaggaaatttcttgaggagggcagaggggacagaaactctgcataattttagaaatcacatctgatggtaacaagggtaggcattttcgttttaaccactggaggaactcaacttgcttggtttgcacctatactctgatcctgagtagggaaaggtagaaaacaaggccttaagctttttttgtgtgtgtgtgctttaattaaatcttaatttcccatagaaacattagtcttggagtcatgatcaggaggtaagtcaacatacacataaaaatactcacctatcctttatttagttaaataagaatggacaatccattaatctatttaatacagaactttccaaagtttaagtacacaagtttaaccacttatacctgacatagacaaatatataaataaaatgaaaattcattgcctaaactgatattcaatgagttattacaacatattaggaagagatgctctcatcaagaatgggaaataaaggttacttttcagtcaatagtacagaaagctttgaagattctaaagcttaatgtcttcataaaaaattagccttttctcagattgtaaagaagttacctggatttgtaaagaaaagaagtggtttaattcaacctccagaatccaccaaattgagtgagattttattgtcacactattttgaaattcgtctagttcaagagaagaatagaatttgctcagggttgtaatccaaagaagtcaagacctcagcatatggaagaatcctctaatccccagatgtactgattgatttgtgcggctgcaaatttttcctaacaactagaggcaatagaaaatagatttctggtccctggagccctattaagaaataagtttgcattcagatatctatgtacaaatgcattcatgccaatgtcatttgtaataatacttgcacacagataaaatttaacaatcaacgacaggggaccaatcaactaaatcatgatacttctattaggttatgatacagccattgaaatatttacaaggtgtcttttattaagaaatttcttaggaagtgaggtaaaatataaacacacaaaatatagtatgtttttagctagccgaaaaagacatacaaaataaatatcaaaggtaatgttacatatgcttatttttgggtagtgaaattgtctgtgattatcactttttattcttccctttcagcatatttgagttttcacagtgtgcatacattgctctatatttgaaaaaaaatcattccttttacacataaacctaaatcatgaaaattgtataaactccatttactttttgcccttttcaatatgataattttaaaataagttaaaagataaactcagttttttatttaatcattaatactctgtcaaaagaattcttagaacactttcctttttaaaggacactattcctaggagctaagataactgaaattatattttggttttaaaaagtcaaaatatttaaagaagtattttaatgtcaaagtcaattagagtactgaaaacttatataaaaaatgaatcatttgcaaaaatatttcctcagttttcatacattttatggcaaaccttcaacacttatttattccagatgctaagattaagacatctggtacagtgtgaggaaacactatttaaaaagaaaaaatacattgaatttagttgtgctagtaaccaaattaagtataagaaatgttataacaaaactgagattgtattacatatatgtacttgtcatttaaattgaggcttgaatcataatggcaccagaattttctgtttccttcatctttgattctgactgtccatgtcttgatcattcaaaaccttgaagataattttaaattcaaattcaaaaccttgagagctgattgtctggttcagaccttcaatctgcttagaaaaatgttgtccaaaaagatatattatttgttgaagagcatatagacagtaagggatagaacagacaacttcatcactggactttttgccctcaaaagatcttgtataaaaatcagacctgcttttaaaataaaagagcatcccatgtttccactgctttttatattgtctttacttacatcatcattaagtcaaaagacataaaacaggttttgattgcagaatagtaacaacaaacgttttcccatattgggcacaagtcttcccttggccttgtaatagccacttaacaggtgtggcaggagtactgttttaaggactaaagattcttacagagtgtgaacaataacaaagatactcagagctctgtgggttttgtttatgttttgctttattttatttaagatttcatacttctgagtgccattttttggtctcaagaagtgaggctaaagttgtgttcaaaatttgctacaactcctcaaagccttttgtgagtgcctccttcagacttgtcaactgagacagttcaccagttataacatgaagtactgtctttactcccagccttcttcctttcccggctttcttccttcttcactcttgtgcagtatagaattgatgttgtgacttgggagactgaaacctccattttgcaaattggtaatatgatttaattatctatattgctgaaagccattgagatacagggtgaatttctaatattcggtaagcatcattcaaatattttatctagatctccctttgttgaagaaggaatacttattaatctggagaagttgtggtagttgttgtttttcaaatcttaattaagcactattgcctttttgtccttaaaagcatatggggagacagttaaatgagttttcaatgaaaagtgagctgatggctcttgtttagtacaaggaaaaccgatgagctgttggaagagttagaagccattaccagagataaggctctaaattaaagctgaactataaacttcaaaattgagtaaggaaaaaaaggatgggagaaccattacctatctaattatgatgcaattcagtggcaagtatgtaaagtttatttcaagtactctaactataccagcagaagttgtcattgcacataattgtttcattagttatgacttgtaaacacatggaaacatgattcaactgccccttttgcagtcaaagaaaagtgtggcttccctgatgaagtgttgattccatattgaggtttgaactgacaaacccagcttatactgtactttgaaatgctccaagcccagatttttatttttttaactacccttgttttaaatatctttcaaaaagacaacgagctaaataaccaatctaatagatagatagtgatttaattaacctcaatgattaaatctgatcagttatttagaatacagtcattcatttcctggacagggaaatgtaaatataatctatagtttttcacagaaataattttgttgttgttgttgagacagagtctcgctcttgcccaggctggagtgcagtggcgcaatctcggctcactgcaagctccggttcccggggttcatgccattctcttatctcagcctcccaagtagctgggactacaggcgcccgccaccaagcccagctaattttttatattttttagtagagacagggtttcaccatgttagccaggatgatctcgatctactgaccttgtgatccgcccacctctgcctcccaaagtgctgagatcacaggcttgagccaccgcatccagccagaaaaaaattcttaagactagtaagaagacagagaggacaggcccaagataaaaagatagagctatacatagggacaaggaggaaacacagtaagtcttcactttagcatcaccctccggaaaaaccctgggctactttcctttgctcattccaggaggatctaatttagagtgtccttctttgctcattgggcgcttgcttccaaggaacgataatggacggaaagagatgtaaccactagcctgggaaatttatcactgaaaaagggcaacaagaacgtggacactaatgcaggaagacaaacaaacccacgcagccaccaagagactagcttcaagaatcaatttattcttcccattctcattcacctcatgggggtcaagacaacttgactttaataatgcgattttcaaaccacttacaaatcacgcaaactgtggtctttctgatacgctcttaggagagggactgtttttttgcacggagggattagcaaatccgactgcatgtatgcttttgaagcagctttaagttttaaaagggaaaggcttccatctactggatactttgagtaataaagactatgagaatccacatgacagatttccttttgtgccggcaatgcataacctggcatgttcacttagaggttttgtaattcttttaaaatacattttgttggaaggacgtagttgttactgaatacgttcagcttttacaaaatacaaagcccacaatatatcacaaaagagagacaaaaggaatatataatttgcccttcttttcatttggaaacaattggatggaacagttaaatacccaacaaagacattctatttgttaagaaaatccacaataagcatagctttaactggaatatgaagatggttgaaacagaatggggtgtttcagtcacctcactttttttcttttctaaaaattgtattacttttaatgagcaaatctcatcttcattagagtctgcctattttgagttcagctacttctatttaatgacacatatttttgctaatatattgcattatatagtcagataagaacacgggtcttttcctgggcatattttgtagatgggatacatttgagctaaatcatgtaatctttgttcaagtcagcacataaagataaaaaatcttttttccagcagatagattttttaaaagaatgtaagaattaatgcctttatttaaaacaaatttagttaataaattttttaaaagtacacagagtacaacattttagtgtctgagtcttaatgaaatctcttaaatttatatagaagtcaaaattaatatcaaaattgtactgaatatcttttataccaaagaaaacaagcaaattacaggttaatagtgtcaacttttaactatgagaatattatggcaaaaaggacaaaactgaaaaatcatgagaatttttttaattcaaactcattaatatgtaggacagtattattcgtggattttccatgtttccataaagtgaggttgaagaaataaagcagaaaaatcttaagacttgccccctaaactatagtaaatatctaaggatttgcagatgcgttctctcagctttataccttcctttataaattaataaatatataatccctcacacctagaaaagactaagtcttgctaaagcagattcctgtcagggttactgtagaacttattttgaatattcttagtaccagaacctggaatataatacaatgttaggatctacctagttcagatatatctttataattctacctgcaggattacctcaaaatagtatttttgaaaacagtgaaatgatgtgctgagaataataggcaatgtaaattgttcatatttaaatatatattagcttggtaagtatatacaacaaatattaaattacagaagatactatgataattcctctttgataaggacctaaatcttttcattcagtgatatcttttctgggttgtctgggttctgttcattgtcttttttgtgaccaagcttttttacacatttatggcccatgctgattgacaatggaaatgtttatttcatttttgcaactgaaaatttcttggcatttacagaagaaagaaaagaaagaggatggaaagaaggcaggcaggtaggaagggagggagggaggaattagccttttctttgcacttgctcctctaactaaatcaagcccagaacttctaaatataacaataaaggaagaaccgctcataggctttagtccatacattcacctcaaattattcaaatgagacttcgctaaagcctaggggagaacacaaaagaaataaaaatgaaaagttacattggcgtagttaatctgacttaaaaataatagttcattcattcatcatttattatctaatatgtcccaggcattcctctaggtcctagggatctagaagtacatgaaacagacaaaatattttttcttcattgtacttcccttctagtatgaagacagacaataaataagattatgatagtagctgaggaaattaatagatcatgaacaggaactgggtgaagaagcaaagtcattttagatagggtagtcagagaaggcttcacagaaagagtttagtgttttgatcatatgatgctgtgacctagaggaaatcaaagctcaatctctaaagacgtgccacccttttggagtgcattcctttttggctggattatcttggctttcttccttgtgactacatttatatgacccttgtccttatggagtgcccccaacctcatatacgctgctcagatttcagacccacagactattttaccttaagttccctgtctggagaacgaacacagagaacgccaattctctgtaaaggaaacacaccacatttaagtacaacccacattcaagaggttcactgggatcgcaggaggaggctgttctgctatacttgctcaatattcagattaagaagtaatcatttatcacaaacgttactgagactccttggttgactatcttaggaatgatttgagatgtgcagccttgtgccttcacttgagacaataaggaaatacgtaactaatattttaagttagggagaaggactcacttccacacctcctgctattaggaaacgcttgagctctaggaaatatatttcaaaaccattatccatcttctctgttgtaggcaactaatgtaatgtagtttacacatgcacagaattgcattttattctgcctatgtttaacaatgcagaccgcagattggttgcaacaatttgctgtcttacaaaagtatgtaacaaatgtgaatttttaagtcacagataatttttcttcgcacccattgaccaacctctcacattcctcccctcccgattctctggtatcgactcttcggctctgcttctattaaattttttttttaaatttcacatatgagtgagattaaccctgatttgatcattatacaacatatatagtattaaaacatcaaatcgtaccccataagtatttacaattacaatgtgtcaatggaaataatataaatatttttaaagatacttttccttgaatgaacaattgatctgcaacattttgtcatgatgcctctactttggcttggattgtcaagactcttctctcttcatttaaaatttgataaactgtgactttaaaatgtttcaggcccagtctcaaggaaatttcctgttacagtacgtaaaatgaaaccataataacggcagtaatttcagaggacatagaatatgtggctagaaatacataatgtgtgcttaataaatgatgctagcccttttaaagcagaaaacaaaactacattaactatgatattaaaaaaactaaatgttatgtcattcgctcatcttagtaaaatggttaaaaattttgtattttcatatgataataaagacatatcatattgactaaggactaccaatatgtcttaataaaataaactcaccttgtaaaatgctatgtagctttctctacttttttttagagccttaaactagattttcataaaccaggttttatcaaatgttcttaacattttcttaatcttactacagactatctttaatagtagatatcatggttatgaagctgtgaatgaaaattaagatattgcttaagtgcaaataattttaaagtaattaatttttggtctattaacattgtctaatagtctcctacatattcaattccttagaaggctgtttgattctcatgtatttaaaacaaactttaaaagtaaattatctagaaactacttaaaatgtaaaaacatactgatgttttaataattaatgagtagtcctataatgtctgtgttcttaaatattgaaactcagcattggtttattgtcaaacagaaatctataattacactatgtagtaactgtacaattttaatgctgttaaaatttacaatgaattctgcaacactgccttgctgagtaactcttaactcagtaaatactgaatcctgggcaggaaaacaattgcaaagttaagtatgcatttaaaaagattaaaggaattaagattactgaaccccatgaaaatattaataaaacacttatcttaatgactgttaagtgaagtagcaaatatcttaatctatgactaaaatcactgaaaattgctttcaaatttttttatctagcagaagaaataaaattaaacttaaatatttctatttatgtctaaaaattcaaaaagtggaataaataagacagtaacctgttattagattatgaaatactttaaagtttttataactgaacaaaaggtatttatcaggtttttgacacgagttaacattctttaactctcactgtgccaaatactttgtatatatcattctatttatttcctcatgataatcccatgaagtattaaaaattatatgttttacccaggagtaaagcaacttataaagggtcatatagctagcatatgatgcacctgaaatttatactcagagggatcattcacatgaatgaaattaataatctaagtctccattgcttcatggttttctccctaatgctttttagattctaggatgacattttggtaaaaggtgatagcatatcttttttaatgtagccttaaatagttatgtgttaatatttccaaaagttcaactcttaaaatatttttaatgtatatattaagaaattaaatgatgacctaaacaaccttatagtcatccttccagaatttttttcttcattttctgggagattttcataagatgaaaaaggacttaatgctatcagcatcaaaagacattccaagtgaaatctgaagacacaaaggggcaacatattgtctatcaatatgtacaaatatgtgtactaaattgccacgaacttggtggctgaaatccagacatatttattatttctcaagagtctagggatggcctagctggggcctctgcttcagggtctctcacatgcctgcaattaatgtgttgatgggggctgcaatctcatctcatggctcaactggggaagaatctgcttccaattttacatgtcagaatttagttccttggagattgtcaggctgaaacctttagtttcttgtctgtttgccagcattttcttatgtggccctctccataaggcagcctacaacatggcagtttgcttcaccaatgccagaaatgcagagagtaaatagagttcctgctaacaagatgtaatataatcatcaaagtgacacctcatcatttttgtcctattttctggattagaagcaagtcataggttctacctacactcaagggcaaggggtcacacctagacataaatatcaggaagtaggggtaatagcctttttagagtctctttgctacagaaaataatgtggaaccaaacaagtaaacaatccttggaaatagccaaataaaaaccactttttatcaataaattcccaaacaattaaaccaggaggcactttctgtaatgctcacccactcttctctatctcatttcccctacctttatatctcagctcaaagatcactttcctcagagaagacttccctgaccaccccttcctgaccaccagtgaatcagttgcctattctttgcatttattctctgtacatctctcaaatacacttgtaatctcacatttgttaatttttgtgtgggctatcttattaaatcctgattaagctgatgaggaaagaaactgtatagaggttttgtggaacattgtatccccatcacctaggacagtgtgtaacataagatgcacaacaaaacgtgagggaaggaacagaggttaaggacactaacctggaagtcaggaaacctagtttccaatgtgggttctttcacttactagctgttctgtttcacccaagtccaatcatatttccaagcctcaggttattcatgtgtgaaaggtcattttctaatgcaaatggttggaactttgatgcaattttttgattttatactgttgttaatagttacatttttattgtattgaaattttttccccagaatcttttggcagctgctgccttcatcttttgaccagtgattttgagatatgcccaaacagtttgcaacaggcaaatttagaggataagagaagtaatgtgagaagcttaaatcaacatttgtaaattacatatattttaagaaacactcctgatgctcttcagagtttgtgcatttgaatgccacagctatgatataattcaaaatgttttcctttcccctagacaaatgaaaacctcaccagaaaacaaactacattacacacatgttgtttcctttcaagatgttggcatcctgccttccccttcagctgcccaatcccctctatggacacagagggtttgttaaattaaatggtagcatagtcctagaccaatgatatcttgaaacaaatataaagctctaaaaaagaagagaggcatgttagaattctctatgtaacagagaactagactattatgtagaagaatattttagcatcacaatagtacagctgacatgcttggcctgctttcatcatgactgaatgttacccttatttagtgattactgagaagttctcataccaagcagtgttaagttcagtttttgaagtgtatcttatgtatgcaataaataactctgcattgttttcagtatcaattctttgacatgaccagtgctagaagaagataaatactgcatgggaaacccaggagcagtatgttactctaccattccctgaagtcatatgtcaaactcatggttattgaaattttcctcatagattgttccacagttaacagtgcacagtgtcctgcgggtaactaatgattctcctgtagccttttccagcttactcatttatagtagtttaggacagaaggggaaaattggttgacagttgaggccatgaatactttttacaattgttctttcaatccacaaataacatgttctcttaaaacgttttttttttttaaatataagtttctactgttcttagtagtgtgtcttaactgagagactgtggttatggaatttgtgtttttctttgttactgtgtggcatttgtgtcaaaatcaccctggtacagaaatgtagataggagaaatggcaagtgcagagaggtggggagcatcagtttcatgtttattagtactttggggttagaaaaatccacgggccaagaccttaaatgatacctctaagagtgcgattctgagacacactggaggtgaggtatagtatgctgctcattgaaaagacatctgagccagagtaagtggttgatttcccacttcgttcatctggtatacaacagaagtacacaatcccagaaaataggctagcctactcttctgttaggagatgatgtacctcctgaggtgcatatacacaagaaaacaacagacataatgggtaacatttagtgagtatttactatgcatgatgcactgtttgagtgttttatatgttaactcatttcataatcatagtagcactcagtaaaaggtgctattattagcactgctgtataaatagaaatctttagatgtcataaagaacattcctgctgaaaaaaaaattatatgccctatgtttacagtctgcctagatagtcaacaattgactattcatagttatttatttccttggtttgagttaacatgttccataatataatctcagatgctccttgagttactaaattgtaacaacaattcacagtagtcttcctgggtcatactgtgttttttctttactaactcataattttaaaacataattagattttcttaactgctttgcaaaacagaatgctgactaaatacagactagaccaatgcactttaataaatattaaaatattactgttatgatattcttttatcaatgaggccaactaatactttgaagccgatttttcataaacttattgctatctatatagctatatctatatacaagagtaatataaaatatatatctgaataagtccaaatcactttttagtaagtgtaggtagtaattctaagacataaaagcaaatatatagagatatatttctaaaacatacatatatatgtgtgtcagagagagagagagaataagacagaagagagggcacatgacagagctctgcaaatagtagttcagctaatatttagagaatgtctactgacaccaggtactgttttaggaactgaatgtaaatacacatatcagcaaatatgtgtttgctaccattgtcttggtttcattaaaaatttgtgattaaaacttgttaatggaagaatttgaaaagtacatggaaggaattatgttttgttcaaaaagatttttctctaatgggatcaatttatgttttgctagtgactaatatttttggttaaatatagaaaatacaacaaagctgtgtttctcaaaatattttcagtggagcactgttgtctcaaattctggaaagcggaaaatgaatctagaaaatgtgaatgcctttggttattcatgatgcactttaccataataaataaagacacctatttaactttgttttacccattctttccattaaaatataagcagattgtaaataattaaagaataaatatatttcatctaatttagactgccatcaattgaaagatcaccattatataatatatctctaagaaaaaattgtttaaactataatgcaaaacttcctttttacctagaattactttgtccctattaaaggaactcttttagacataactaattcaaaaccagcttttaaatcatatgtcattcatgtatatacataaaaatataagcaaaggaattgatcaagcagctttatatttgcaggatgactcttttgaatcacttttcaatgcaaattaactgatgttcatgtgtttcctacccactgtcattctcagtgccattaagaagattgacaatccaggctatcttaaaatcatgattcagtattatgccgaggatattctttcaagtccctgaaaccattcaggaaatttttatcttggtacttttttattttaccagaagggatcaaaggaagctttttcaaacaacaattaagatgcattaaaatgtcccctaatttaaatggccataattatctactgaaactgcagttggctactgattttagagatgggaaaacatatttgcacatgctaaagcagtgacgactacaataaagttgctttctcaccaacagcaatggtaagatatcattgattataaaacatagcactatttcagaaaggttcaaataagatagtatgtggcatataactgaagaaacagttatatctaactagcttcctgcagcactagtgatggatggggcataattttaaagcactttaggaaatattttcgtttgtcagtcaattgcacactgaaatcttctggcttgtatttaattgtcagatcaataaagtaactcattatatatgaattcaagtttgggatcttggatcaatcacactgatgttaggtcagggagaatttgcaacgtgagtcctatcattcaagggatgataattaccatgttctgtacccaggaaaatatttccctttataggtttttcaaacttcctccagtttcatgacccattctagtagagtgaacaagagcatggattttgatattagataaaagtgaacaacatttgaccctacttctgctattttctaagtatacttaataaagttatttaaccattcaaagtcttaattctttcatccttaaaacaagtaacaataataatagataaaaatgctatatagacttaatgagaatgtgtatccaaaagtgcttactatgtagtcgggaacatgaagtcccttaagtaatagtttatctgttgttccagtacttccggtgcctaactaaaccatactactccatggagggatagatgagtgtcctctttcaataatggtccaatatggctttctacattctaaattcttatgatacatgggaagaacatagagggatacctcatcaattataaagttagcaatatttgtcagatataggaagtcagttgctaaggaaaaacacagcttttcctgcttctgagtccacaaaagaaattactcttgagatttctaataaaaacaaaatgcaaaacaatagcaacaacatgtatgataagatagtcaaaggcctcagcataacacaaaatgctggtacaataacaagtttggtgtcactatttttttttgtactgactctcaatatcttaccaagacaccagaaattcagtcttaggtcctgctggttgctgcacagaaattcaatcaccaagacgatgagtattgccagggaagaagacttgaaatcagtgatgcagctgaggagatgggagatagtctcaaattcatctcctcaactgactaaaattaggggtttatatagcaggggaaaaaaatgtaaccatgtgtgggaaaacagaataagggaggagtaaagaagtggagttgatccaaaggaagcaggtggtaagtaaggcaatcatgatgggtcagtggtctgtaatctcattgtccatatgtggtgatctggtaagtttcagttccttgatactatctgggtggcctgatggttggtttcctgagaaagtactcagataagacaaatataactttctcaagtttcaagactgggagggtcagtttttatgcttattcaaaagaaatgataagcatcagttctgtgggacaattggaccagtttcaaatgaaaaccaatatcataattccaaatcctcatttagacttgataggggtcaagataatgctgaaatatacagctatatattagactgagttaattctagataaaattttgatagcctgcagactgttcagtctgtgtttgtctcaatggatatcaaattgttcttttattttaaaagactactgcaaatactcacttttcttatttcccatattctcaatgatcttggaccaagcatttgaatatgagatctttattgtcacactgatctgaagtttgaggtaattgcctagaaaactcagcctcaagacctgctgtaacttttgactgtggatattagagttaaataaattgaaagttgtctgataatcctcttcctgtgtgacagctctgtgcagaagctatgattttgtaaaattcattatctcatttttactccattaaaataaaattgtggtaataatagtaaatgataaattcaacacataatcactatgtattattagttggaatagtcaatcagccagttaatgtagttctgtccactgacatgctaatgagaacttatgagcctgggtaatttgtatggacatagggaatagataaaaaggtagattaagggaatagttttaaatttaaaaacaacaatgataattccaagaaatcgcctaaacctctgaaacaatacagtatcatttatgtacttacaggcttattcatatttttaattgacaagttttaacagtaatcataaggcacaatgtgatgttttgagattacacatacagacacaaacagtatggaataaataaatcaagctaattaacatagccataaccttgcttacctattatttttagtgataatgtcctagttatttgaaaatacacaatgcatcgttgttgactatagtcacctgatgagcaatagatcccaaaacgtgtttctcctatctgaaattttatagtctttgattaataactcctcattcctccctcctcatgcctgtagcctgtggtaaccatcattctattctctacttctgtgagtacaactgtattagaatctacacataagtgaggtcatgtggtatttgtttttctgtgcctggtttatttcacttagcataatgtccttcagcttcattcatgttgtcaaaatgatgggattttcttcctttttaaggctaaatagtgcttcattgcatagaatacaacactctctttatctgttcatctgttgatatacatttaggttgatcccatttcttggctattgtgaataatgctgcagtgaacaagcgagtgcagatatccctttgacatattgatttcatttcctttatataaactcagaagaggaattacagtgtcatgtggtagttctatttttagttttacaaggaagctccataccacttttataatggctgtactaatttatatttccatcaacaatatctaagaattcccatttctccacatcctctccaacatgtgtcttttatatttctgataaaagtcactctaacaggtgcgagacgataccttattgtggctttaatttgcactttcctaatgattagtgatgtaagcatttatttcatgtgtttatgggccatttgaatgtcttcttttgagaaatgtttgttcacgacctttgcccatttttaatcaggtgttctcttgtttttgagttgagttcctcatgtatttcagattttaatcccttatcagatccatggcttacatttgtaggctttctcttcactttgttaattgtttcctttgctgtgcagaagctttttagttggaaaccatcaaacttgtccatttttgcttttgttgcttgtgcatttacagtcaaatcaaacaatttttgtccagacaaatatggactatttctcctgtgttttagtacttttacagtttcagatcttaaatttaaaattttaatccattttgatttgatttttatatttggtataagataagaataagatctaatttcttcttttgcatgtggatctccagctttcccaataccatttacaatttggtatttagatgcaatagaatacaataattgctagctggattaacaatggcttattattatattattttaaaaaggagaaaaatgcagattcttattcatgaagttcataattacaattactgagagtaaataacaaaataaagtccactttctatttggaatttagaaaatatcacaaaaaaattattagcttaaactgtatatactggtctactcctgtaatgtgaatatatatcattaatatgacatacataacaaactttataatcaactgcatagttttgactgttaaaggtaaaaaggagctttatctcaattttttattatttcatatattttaattacaatagctgtataataaacattcatgtggcttaacatttttccatattcttacatagacataattattttaatacgagagttgtattttgtcaaccagatataactttgatttgcttaagcattctttttgttttgttttgtttttgtttttgggggggtggttttttgagatgtggtctcgctctgtcacccaggctggagaacagtggtgccatctcggctcactgcaacctccacctcccgggttcaagtgatactcctgcctcagcctcccaagtagctgggattacaggcacccaccacaactggccagctaattttttggtgtttttagtagagacagggtatcaccatcttggccacgctggtgttgaactcctggcctcaagtgatctgcccacctcggcctccaaaattgctgggattataggcatgagccacagtggccacttaagcattgtttattgaataaaaataatttcccttttaagttatgctgcaatatgtattcttgtgcatgaaattgtaagctttggcatgcattagggtattctttcttcaggtactttgattttagagagacagaactattagacttactagacatctattaggggaagaatttaactgaaataattattatcattgaaatgccaggggtttggtctaaggcccattgcttgcctcacagaagtccaatccctgagacaatgagtattgccagggaagaaggctttaactgggtgctgcaaccagggagacaagagagcagtctcaaatccatatcctcaattgactaaaattagaggtttatatagcagcaaaaaaaatgtaattatgtgtagggaaaacaggaattagtgaggggtattaaagaggagctggtcaacaggaagcagttggttggtttaggcagtcatgatgggtgagggggtctggtgtctcactgtccagatgcagtgatctggtaagtttcagttccttcaaaatgtctgggtggcctgatagttgatttcctaagaaaggaacttggataagacaaatacaattttctcaagttttaagactgagagggtgaatttctatgtttatataaaaaaatcataaatatcagttctatgggacagttgagccagtgtcattatgatcttccatctaatatctatttaaaatttaaaacatgatttctctaaagagtgaatttaatactataatgcaatagacttactatgaataaaagacagatttttttatacttaaattcagggtgcatgtacagatttgttacatgagtaaacttgtgtcaaggaggtttgttgtacagattattttatcacctgggtattaaccctagtacccattagttatttttcctgatactctttctcctcccaccctccatcctccaatagactacagtgtgtattgttcccctctatgtgtccacatgtcctcatgagttaactcccacttataagtgagagcacgtggtatgtggttttctgttcctgtattagtttgctaaggataatggcttccagctccatccatgtccctgcaaaggacatgatctcgttcttttttatggctgcatagtattccatggtgtatatataccacatttgctttatctagtctatcattgatggacatttagctggattccatgaaaagacagcttatttaaaaaaaataggagcccataaattttatcatttacctattaatgaaacctgcaaacctggaattaattaaaatactcttttgttggtactcattatgcatctttatttcattgtcaaagcctttacatggcttttgcaagttccattgaaagacttgccttaaaaacttataaatttttgccacagcgtgtgtcaccttctaatgtatttactgtttatttaggtctttctccagtagaatataaactccatggaggaagataattttgttttgttcacagatatatcccaagtgcctagaaaagtcccttgtacagagcttgaccacagtaaatatctgttaccttaatcttggcttggcctctgctgtctatctttagatagtcttctcttttacgctcacactctatatctttccatatgtggatttatcttacttctatattggtgtcactttcataggcctttgttgtatggtagccccaaaaactccaggcttaactcatctatacagctacccagttccagaggaaatagagtttcaactttctaatagccctagtgtattctcaagggtatgcttttattaggctgactggtttatttgcccattcctgagtcagtcattgttatctgggttatatgtaaggaattgaaatagaatgctctagttattttgggtgctaatcaaaatctggactgagcaaaagcaggatcccttggagcttgttagaaatatggaccctaaggcccccactccagaccaactgaatcaaattgcatattaactagattttctggtgatgtgcctttagtctgtgctcacagatggaactggaagagtggggaaggcaatgaaaccagccccatccaagctgaaagtgaagtgggagtggtttcccagagaaactcaagtgcttttaccagagggcagaatggatgtcaggcgtgcaaaacaacagctatccaatgcaatatatgatgtgtattaagcaattattatattccagtcattgtactaaaccttttccaggcattatttatttagtagtcacaatatcttgtaagatattatcaggtaggataccttatccttcaaaaaagataactcatcatccaaagtttttgttgagaaggcagtgagcaaagtgatctgaaatatgatatcagatagtaataagtgccatggaaaaaaattaagcacgatagagggataaagacagacctaggaagatgagagaaagtgatcaattttgataggaaggtcagaataaacctgaagaagtaaattttcagcaaagacttggaccaagtaaagaacaactcatgaaagttgcagggtaacaccattacagacagaaaaaaagaagtataaagccttgaattgttgaattatgaatgaacgtgggatgtttgaagaaatgtaaagaatgaaaaaaagtggggctagaatgaagatgttactgaaacacaggggttctgtctgtgtcctgctgcttgctgcactggaagtcaatcaccaagacaaccagtatttacagggaagaaggctttaataggttgctgcagccaaggagatgggaaatcagtctcaaattcatctcttcaactgaccaaaattaggggttgatgtagcagggaagaaatgtaaccatgtatgggaaactaggaattagggataaggaagaggaattgatcaacaagaaacaggtggttaggcaatcatgacaggtgagggggtctggtgtctcactgtccagatgcggtgatctggtaagtttcagttcctttatattatctggttggtttcctgagaaaggaacttagatgagacaaatgtaattttctcaagtttcaagaccaggagggccattctttcatgtttattcaaaagaaaccataaacatcacttctgtgggacaattgggctggtttcaaagtgagtataaatgaattcaaaaagccagccaagagctattttctaaaggatcttcaggcaatggttaagacagattcaattattcttagtgttatggaaaatcacggtacacttttggtcaggggagtaacatgatttgatttgtattttaaatatattgactaaggaacaggcaatagtgaataaaatataggtagaggaatgtaaaatgttttggggctagttaggagactattgcaatgctagtgtaagcaagagataggagaagttaggaccaggatggtaacagtagagtggctgaggatatattgtgaagtagagccaacaggaattcctaatgagttaaaaatgtatatgtgcgagagaaagaaaattatttgtttttccttgagaaaatcagtggatatttgtgctagatactgaaatgaagaaccttggagatggagcaagttggagaaacaaatttttgacttgtcaaatttgagatgcttagtatagatcccagtaaaattattgggtaaacaattggataacctactttgaagaggtttgagttgcagataagagtttggggaacaagtaagattacatatcaaaccatggatctgaataatctaattcaggctctacagtcactaaatcatacagcacaagaaaagtctctccatcttgtagctgcacccactgggatacaagtcctcctcagtccctgtggcaaaggaaaagaaagctctcatacttgctttcctatctttaaaatcagaagtgacataacccctttctctcacagtttgttggccaggaccagttagatgtccttacctaactgcagggacctgagaaatgtggaggagtacatggagtgtttgtgaggactgttgtctcttaatatgtctcacttctaagaagaaaaacatggattcagagagaaaaagccattctcaccaaaatgttaagatagcccaccatatttttttgtacatttctaaaggtaatttagcataattatctaggattagaacaaaagcaagttgcagtggaaatgccagggggcggcttagaggtggcaggataagaaggcttttgctttattcagtaatctctataattccccattagccactttttgccaaatctgaagtggacaattaatgttttctctgacctcatataaaatggtatgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaggtatgcaaatgaaactttaaattttcatttcaatcagataactgctcagaaaaaccttctaggactttatcttttagagcagaggttggccactgtgacccatgtgccagaaccagctcactgtccattttttaatgacccaagatctgattttaagtacttgaggaaaagtcaaaagaatagtatttcatgacgtgaaaattatgtgaaattcatatttcattgtccataaataaagttttattggaaaacacatgcacaaagaaacccttctaggaagatgttatggagccagaactaccaaatcttaacatgatgaaaaagggaggatgttgatattaaataagccacctcaattaaatccacccacctcaaaaatgaaaacagaacagtaaaattgactattgaattaagtcctctgaagatacagtgttttgcctccccaccaggcacaatgtcatctctttatatgattttgaggaaaatgtattcaattatttcaactgtaataatacttaacataatgagaaattcttctagtgatttatttttgtaaatactaaattgttttgagcttcttattttgaaggttgcattccggattggaagttctgaatagaattatttcgaaagcaaatatttatctgtttaaaaagcccaaagaccttgttttttctgcccaaacaccagctaggaaaatcaatattttctcttggaaggaaatggtttggctgcttcagcatcagaatgctttctaataacactatggcatttaattttgaaaaaacaaaagttctgaagagacaagaaggtcggagctagtgaatgatgagttttgagtgttgctgctttggaaaatagtggcttggtaatggcattagttaaagacatttagattgtctaaacacttgctctattttagacaacaattggctggctttgttacttggttgggatagaatatcctaaatactaggccattttgtgccagcatgttgcatagtggccttaaagaagaaagttaaacattgaaatattttcagaatattctaagaataattgctgtcttgtcacagttattacttatttcaatcaaatgccaatattaatattgagcaaaccaagttgtcgtaaaattttttataaaaattagtagcattattattcctcaactagaaaacattcttttctgattttcagtggaaatattcatttaaatatcaaatattctattatgtgaaataaaattaatcatttttcatatatacatgtgaatatatttctgttcatttgtttgttagtttctttacacttagatatttgctaactttttcaaggacaatggtagcttagaataactcaataaatcaataaaaattaagtttatggtaactagatagaagttcaagaaaaagaacatatgtacagtctattacgtgaattattctatataaatttcgtataaaatctacaggtggtgaataagtgactctatagggaaagtgtgaatattaacaaaaacattggcactactagaattttttattaaggagaaacagacatattacacagctcagttaagctttgattatgagatactaaataccaatttacatttagttaattaattattcaatctaagtagtacaagtacttggtgataaatatttgtatttgaaaagtcataaccaatgggagaagtgttatttatatctatttaatgtactaattcgatggtagtaaaaatccagtggagtagcagctgcatatgcaattgaatttgctggaattatgaagaagaaaactgatagcaaagtaaatgtagtaaaacagtactaaaacaaaaatagcacaaactgatttgtgtttctctgaaaaattccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgaggtatgaattatttattttggttaagttataaatatattttgcaaatggagcaatttctaaggagctcagtattttttatgttatgaaaatgctgtaagggatttttaattagatctgttttaaacaacttctcatatttcaaggaccatgaagtcttcatcataaggaatcataaaaatgagcagaaattttaacattgaacaaaaaaaaaatttttttaacagttctaaagcttttggtcatttacgttcttaaaatttactgtgtaccccaaacaccttttgttcatgtgggttacaactgttattaatatttactgtatttaaattaaaactgagaactttaaaacccattttttactaattaaacgttatataataaacaattacatgttaatgtaagtaacatatttttgaaaagttaatatattttttccaagcaaaatcaagtaatgataagagagtaccattgattgtatttttgtaaattgcattaatgtctggcttaatagaagatagctggattgtcatatgtgcttcggtattccatctattgctgcaatacaaggcagtctattacaatagcctctagaaaactcttatacactcaggagaatgtgaaagtgaaaactgcaagtaatatcttggtactataacaaaagtggtattgacgttgtagacactctgagaaccattgatctgcaccattcttttctacatatctattttatcttgaaatacaaaaatgacttcattataactatacaaactgtatataatgtatgtataatatataatatattcatactatagataattatatataatatattcctgtattcatctcatagattgatgattatatataatatattcctatatagcatatatatctcaattggtcaaaacaagaattatatttcctttatgaattatatcctccatattgataattttccactgaataggaatcaaagctaccttaatattggttgtgattaaagcatttcaagagcaataaataggccgggagcagtggttcacgactgtaatcccagcacttcgggaggccaaggcaggcggatcatgaggccaggagatcgacaccatcctggctaacacagtgaaaccccgtctctactaaaaatacaaaaaaaaacttagccaggcgtggtggcaggcacctgtagtcccagctactcgggaggctgaggcaggagaatggtgtgcacccaggaggtggagcttgcaatgagccgagatcgcgccattgcactccagcctgggcgacagagtgagactccaacgacaacaaaaataaaagcaataaatatgcacttaggaaataattatcaagtaaacatattcttagatttaaaatgccattgttgtagaccataatggtagaatatctgaaaatgtatatggtttaatctaatacttttttgggtcatctgccttaatgctctgtaactttataaacatatcttacttacaattaactagaaaaaatgaaagaaaaaaatacttgaggtgactggaaccctagctgaatcgtttttaatgactgatttaagtgccatattcatgccttattgtccaagtctccacttcctcattagccatgtaaatatctctctatagagcttgatttacatatatttaactttcatctgaataatgtagtgaaaaatttcatgtgtaatagcattgattttaccactttctaagtgtatgactttagactagtcacttagtcccgtacctcaaagtatttttttgtttgtttttattggagaaggaggtattgttgctatcattttcaaatgtgtaacatcctcatgttggcactgatctcacagggatttatatttaatgcagaaaatatactacagtgctttttaaaatagaatagtctttgcatgttagttattacaaatcactgaagatctctgataaaatatttaatacccttatcactttattgaaaatttgtttgaacattcatgaacctgactatatcctcagaagaaaggagtttttctgttcttcttataaaatgtttctgtcactgttgtcagtggacccaaatcattagtaaacatcgattcccttttctaaaaggaggaatgaccaagggctataacaggacagaaatgagcaaagaggacttttggaaatcctctggggccaccaaggtgactcctgagaaagactcagggctctgtaacagaattagatgtttagttccaagttaaaaatccaattttatgctgtcctgcactatatcaaggaaacctaattcactttctaaaatgtaaaaataaaatatagtgtgggcaaattcctttgtacaaactactgatttcaaattagctatcttctaaatggatcaggtgaccatattttaatctgtagaaatactttaggaaaagattttaaagagaggaattgagcctttcatagcatctaaaagaggcagtatggtgtattgaaaacattccagcccctgaagtcaagcataggagggttcaaatcctagccttacagctttcattttgagtggcattaagtatcctctctactacctctgtcaacagaataaagataataatactgggttatagtgatgactgaagacataaaacatctagcccaatgcctggcaagaatagtagcctaccagtagttacacttattatatctaccatttattgatttcctatgccaacagttattctaggtgctttagatgaattacgtagaaattagaacaactttcatgacttggattttattatcgcagggttaataaggaaactgacacacagaaagtttatgtgcttggcctataggtcacacagctagttaactattgaagttaggataaattacgtgctagtccaacactaaggctcactttttcttataactagaaggagaaatagatgattttattatattttaatcattcaaaatgtttttattaaataactaagagcatgaagctgagtgtgttggcaggtgcccatggtcacagctattcaagtggctgaggcagtagtatggcttgagtccaggagttcaagaccagctgagtaacatagtgagaacccatctctatttaataaaaataaaaaaagaacttgagctatgtcttagtccattagggctgctataccaaaataccttagattgggtaatttataaataatataaatttatttgtcatagttctggagattaggaagtccaagatcaaggtgccaaccgatttagtgtctgataaaggcttctaggatggcatgttgtcactaagtcctcatatggaaaaagaggcaaatgatatatcctcacatggacaaaggggcaggacagctcccttcaacctcttttataagggcactaatcccattcataaggatgaagccctcatgacttacacacttcctaaaagtctccacctcttgaatcttctgattcatagttagacatgttatctcttgggccactggtcctcttggctgcacctcttaataccactacaatggggattagatttcaccatgaattttggataaaggcattcagaccatatcaaactaaaccttttgttatatgttgaaaatacaaagtcaaataaggaaagacctttactcttaagcctttctaccaaaatagggatgcagaggtgggtagggcaagagagaatcaaacaagtaaagaaattcagtagaagtaaaagatgccctgcatgggttatatggtataacggctgtttaaaaaacctgatacatttaacagataaattaagttctgtgctttctggagtattaatgtactgtagttttccactttaaaactagccttaaagaaatgcaatccagcatctgtttccatggaaacagaaggacaaattcaccaagcactacctcccaattcaattttgcatggccacgtatacataatttaagatggacattttgataatgagttagagttgaactgttaatgaacaacagtcattttctaaagctttttccttcttactgcctgttattaacctttattggaaaaatgtaaaaaggtaatctttccttatgtataaggcactttctcttaaataattagagtcccaaagcaatatcaggtgttcaagctacttgccatcaaaacaagaacaatatttctttgcagtatattcatttgtacttctcactgaatttgaaatgaaattgggtggctttaacaatttatatatttttaacttcaatatttttcaaactctatttgatattgctgtgtattggtgaatataaatgtttccttgtcaatttccttttataactttccttgctgtattggaatatatagaggcaaatatggtattcagtttttctattatataccatcaccaaagtcaatagttattgatatcagatatctgtatcttaatttattttatgtttgcatcttactcaagtaattgaaatattactttatccagcccatgaattacatgcagtttccaatgggaagttaaaagctgtgcaattgctttgaactaaaacctttaagtaagttaatgaagcatgtgtcttttagactcagtaagcagatcataatggaataaggaagttgagctctttgcagcattaaattctctcttaactagccctgaagcttatgtagatttaacatgctcggttctgatcttgtaaatttaagtgtaagattgaaagaaatggcattctaaaatagaatgtctcagcccaaatttttgggttatgacaggctttctgaaaaaaaaatacattgtgaactaaaattgaacacaatctgagggcaaatgaaggagatgaggatttcaggagccaagtgacaactcttggtgcttaaaatttgcatttgcatgttgctttgaagatgtttcgacattagcatatgcattttgtattgtgtacttaacctcggggtttctttttcctcttgtatcctttagccatagtaagtagttaaagttcttgcctatattggtattgtatgccttaaatattgctgaagagcaaatttacataatggaaaatagacatccatgaagctgctaggctgcagagattaagggtaaaatcagttactgccaaatgcagaagctaaaacgcttaaaagtttaccctttctgttggtaatcagatctatttatagattcacagtcttcttggccctttaataggatgaccagcaagaaagccttattttaggtgacttacgtaaatgcggacatttttctgttcattttatttccaaaattcttggggactcagtagctaatttttatcccagggtttctgaatatgtgtatgtgtaaggagaatatgtcaccctttattggatggctaccttaaagtatgttgggctaggcaactcacctgtgaacaaagtgagctatttttattacttgaaaatattgtatttttttaacttcatatttctaataaactaaaattcattctaattttattacttaaatgtgtattggcagaaacagctgcaacaaactatatgccagtttggcatttattcaattctctcaggattttggttgtcactgtttttgttatccaccaaataaattaaattgtttattttgctatgttctttacttttggggggaagggatttcagatatcagataacaataatttttgaatctcacagtcattaatcaaggaccttctaaatccagttctccataagtgaagtcaacttgaattgtttcagtatacagattttgttctcatctttctgatttattcacaattagattaaacagaaaatatgctttaaatgcatatccacaagagcaatcatattatggaaatattaacattaagctctggaattcactgcaaatgtgcttatttctgtctttacaaagaaaagagaaaacaaatgaggttgacatttgtaaaataatgataaaaaataatatgcaattgaaggataaacgtatgttgggataattaaagtaaaataatgctagtttaagtttagactgtcttatctttagaatggattttctatgagtttttaaaacggaaagattggtggtgggggcgtgggcagtatatatctctctcttttagaaatggaattctcattgctacttgcttttacattccagcagagggagcaaaagctagtgaacaaattatataagtgatacgaacactaccaatgatgctgcaatgcacagaaacatttagaaaaagtcttgctgatttcaaacatcaaaacacaagggggaaaaatgccctcaagtttgtgtcattaagaattgttttcaagcaataaaagattatgtgtaaacatagaaatctcaaagcagacagccaattaaagttaaaactatcttggccttgtgccatatattcaaacatatgtaacatatgaatgagtcaaaaaagtttaccagatcttagagctaccagtgtgcgctactattttgattcaagttctggaacagactttgtgaagaatttttaatggataaagttctttagttgttggttgctttgatttttctcaggattaatgacatgaccaagccattgttactgtcaggtaatatggtaccgttgacaaaattgcatcttttctgaaattttacttcttcccttgaacaacattctttgtgagtatatatttgaggtctcaaggtgttcttagaaaagttctgattttaaaattatacatgatcatcctaaatttgattatcctttacatctcaaaagatgagatccatagtttcaactctcccatatgctagtattgagatacatgttaagatttgtttgttaagaattgttagaaaacaccagtgaccatttttgtattttgaagacaatatagcagatgcctacagggttgggctcgctcactcgggaacaatttatgtgcttctatctgccccctaggtgtgcatggctttaaaaaaaatctgaatattttaggcctagtgataaaaacctttcagattttaggccaggcatggtggtttacgcctgtaacctagcactttgggaggccgaggcaggcggatcacttgagatcaggagtttgagaccagcctggccagcatggtaaaaccgcatttctattacaaatacaaaaattaggcagttgtgatggaattccatgcctgtagtcccagctaattgggagactgagacatgaaaatcacttgaacctgggagttggaggttgcagtgatctgagatcacactgctgcaccccagcctgggtgacagagctggactccgtctcaaaaaaaaaaacaaaaacgaaaaaaaaagctttcagatattgtctctatcccaggtgatatgtccctcttatttgtttaagatggcaactgatatcctgatttcctgacactctgtcctccacactgcttatctctcaggtcaccctggacatagatagaaattatttgcctgacctcagctcatcaggatggcactaagcataaagaatactttgtttttaggctttttgacctggtcccccaggcctaataccaggttgcctttatgtatcttttttcatgtgtcttcacctgttgtctagataacctctggttagctctgtttaagcagaactgagtcctcccttgctccttccaggcctccgttctaacaaacactgcctccctgtctggaagtcaggactggcaattcccagactccatagaatacctttacgttttgttttggcaaattagttaacctctctgtatcttaatgtttttgtttgtaaaacgggagtaataggttggcacatacaattcaaatagtttctaatttatattattattatcatcatattggaggtggtagtggttgtctctcttttctccctgtggcaggtttcctaaaccattgactcctgtctattgctattctcccagattctacatccagccagacttgacttcagttcctattttgtatccacttagcacctgctgcattctgaaggacaagtaatattacacatccacaaactacaaaaccacattgaatgtggagtagttagaatgtgccagaaataggataggcttcttttcatgcagtccccaagataagtctattctggaattctggaaaaattggtggcagcaatgacattatgtgtgaatctctgaattttcccattaaaacagaaaacgactagaacagcaaaacttaaaagaatgataaacaattttgacaacaaatttaggtggcaaagtgttctcacagattctcaaatatgagctgacattgtcatgacccagatgatactacaatttttgtaggagacaacagaggaaagcaatgaggtatttgatggaaatgaggtcaggataacacccaattttctaatagatactcatgagaaattgtttcaggccaattggataatagtagctgaaaatgggagaagtactttgcaggtgagaaaaaaaactcctctctaatatctgaagggtctgaacagtctgcagtctgtgaattcttgaaactcactagctgaagctccttctcagaagacactttggggaataaagcccaactagagtgggaggaaaaggaaatgaatggtccagattaaaatgggtgaggtaaatggggtcaggaggtctcaagaaatagaagggtaatttttttttttaacacttcaaaaactacagaaaaaggtgttccatatttgtgaaaatagaaatggtcttttgatcaatcatttccccttaaaagactaggaaaattgatcttatgcaaaaaaggaaagaaggaaggaagaacaaaaggaagagagaaaagaaaaactagaaaagcatgactgatgtaagaaaaagatagtaagaagtagaatggtatctctgcaaacaatgcaagcacaccagtactttatgctcataagacagaggaaaagtgtaatctaatatttcaaaagatgctaaaataaatgctctaaatgatagaatatagaaaagaacaacataaatttagaaaaactgaaatgtgcaagtataatgcaggaaagaattagaaatcaaagactaaatcatttcagaaatgaaggccaaacttgtaagaacacatgagtgaataataccgagagcatgccataagaattttagaaaagaaaaaggagcaactaaaaatataaaaattggaaactaaattgttcaattgaaagtgacacatatagaagataagcaacaagaccaaaaatattaggatttcctaaagagaaaaaccaatgaaataaaatgaacattaataactataggcagggtgcagtggctcacacctgtaatcccagcaccttgggaggatgaggctggtggattacctgaggtcaggatttcgagaccagcctgaccaatatgatgtaaccccatctcttctaaaaaaaaaaaaaaaaaaatttgaccaggtgtgatggtgggcacctgtaatcccagctacttgggaagctgaggcagagaattgccaccactgcactccagcctgggcgacagagtgagactgtatctcgaaaaataaaataatgactataattccgggaaacttttctgaaaataaaattgcaacgatattgtgaaaaggaacactacatccctgcgagagtgatccataatgagtaatgtcaagatacattgtaggaaatctcccaaacttaaaagataaaaaaatcagtttggcttcgagggaaatagatacttgtaagaattaagagggggaaaatcccagattgtcatcagagttttcaaaggaatcctttactctggaagtaaatggagtaacatttaaaaggtagtcaagtttggtgagtcatggattttagatctatcaaagtgattttcaagtatagcagccacagatatatttatcaacatgcaagaactcaagactattgttcctggtaaatagaaatagcatttgcccactcgttcaggcccaaagcttggcatgtttcttgatgtctttatttgtcttataactcacattcgattcaatggaaagttccagtggctctaccttcaaaatatatctgaaattggaccttccacccccattgttattctgttaatcaccatcatctcttgctggcatgactacagtggccttcttccttgtttctctgcttccagtctttcctccctctaatctgctctttgcacagcagccacaataagctactattataccatgcctatgctaaaactctcatgattccttacattacttagtctgggatacctctctaacctgccccttgctcactgcagtggtggtacaaggctagtccattatttcactcagtactgtccaactacagggagcatccatttgctgttcccctgcccaaaatgtccttccatagatgaaaatatggttgctctcctcttcattaaacgtcttttcaagtgtctttattccaactgacctttcctttctaaaatagtaccatctccttcactttatctacccttacttactgtgctttatatttcttcacaggacttcttgattttctgacatattacaaatctatttatttgttgctctcttcccttctaaaacataagctttatgaaggaagagactgtgtttattttgttcctttctgtctcctcagcacctcaggtagtgcctggtatgagatatacattttcctgatactactactcaattgaataaatgaattcacaagaggtgttacatactaaaacattaaagtgttatcttttgtagaaaatagatcaataataggttgttactgaaggcaaaatattttggagccattcttaaaggtatttcttaatttgtcaaagagtaagagggcatgcatctccgataagtccctttccagtaccactgtcagagtatgtactaggctgaatatggctttgaattttctgctttccagcagagagagaaagccttacaaacaattcaagctgtaacccctgtaattattaattagtgcctattcaagtaccatgtacctagcagagattcttctaatcagattgcataccttacatctaaaaatgaattcgtcattttgtgagatatgtatttctctaagtataatggcattatactgtcctacactcttttaggaactaaatagcaataatgtataatcttattttcaagaaatcttccttttatgaaaagtcaataaaatctgatgtaagggatttaaaaataattcaacttatataatttgatcagactatgtgcaacctataccatcctatttactacatcatactacaatttatcagttgttaccttccttaatcctctccagctgcaggtcctgaaaggtcttttgcctataggttcaatcccttctagtgtctggaccacctgaaatcagattgagaatatatttcagccctatatgaacaggtaccgggttttgcttctagaagcccgtgccctttccttgtaatattcagtgtgtgttttgtcttttttaatgggttgctgctcagatttttttatgaaaacacatataactctgctctaaatctcagccccttgaaacagggcttgatgactctgtccagttttttctaacatttaccaaatgggaattctgatccatactattctcagttattgatgggggccttaatgcaagtcataccactttccccaactccaggtactagtacttggccatgaggttctgcaccacagaaaaagtgaattgtataaaccaaattcatcctctatatgtttatgtagtaagtttcctgtcttattcattagccaatgtgaggaaacatgtactcagagcatagataagtaaatatatgtgtccaataattctaccaactgaacagtaaaatatgcatgtctatggttcggagatacaaacttttcaaaagcagagtggacaagcataaatacatacttggggttgagactaagtaaaaatctgaaatatcccatttattagaaggttgaaggtttttttcttttttgcattcatttgttcttgattcagtgagattagtatctttaaagtcaattattggttttgtaattacatttggcacaaatatgtattaactttatgttaattatgggactaatgccatgtttgaatgtaaaccaagaactttatgtctgtagtcagcaattcaatcttgcttttgaggaatttgtaatgtgaaatcactgtttagcattgtaatagctttccttagggtcaagcacttcccaataagtttgacattaggcatgaaagaagatgcatgaaaatgttttactcacagatataaacagtgtaatctttattaacacacagaatggaacatacagtaatgaagcaatctaaaaagaacataaatttcaatatttagccaatttgtttttatttccttccatgcaatagtataggagttcaagaatagtcaatggttatttgagtggaatatgaaaagtgtgtcctaattttcagaggatttggggaagaattcctaattcataatatgcagctgcttccttcttctatgatactatgctataaacagggaatgtttcttgattagatgccaatgccaattctgttcaaaaacttcaggaggagtttagaaatgtatacaggttaagaatggacactgaaaaagacaaatatttaaagtaatatgtttttcttggagaaattttcttatgaagttgtattattcagttaacaatagatagtaacatgagaaggatttgatgacttaaataactgtctgatttatgttttatccccccccttttgtgtgtttcctttagataagaaatgttgaaaccaatcagtgtttagacaacatgggccgcaaggaaaatgaaaaagtgggtatattcaactgtcatggtatgggaggaaatcaggtaaactctccctttttatcagcttcatgttttagagggaaaatattgttaaaactatcagtggagaccatggctcacatgttaataactataaactgagcttaataaataaatgtacactcaaatctagaactaatttggctattttattgtcccaaggatcttaaaggagagctgaaaaattaaaataaaaagagcaacactttcagtgtgcctacagttaatgaagatatccaaatattttagacacatctcattttatcatgtattagcaaatgagaggagtacattttattctattaactgaatatagaaaataattcctcaacatctgtgatgttttcccaatggttatttttatccatctcttttcagatttttatgtatgttatgatttttaagagcttttgaagtttaataaaatgtttaagtatatagttcagtgttgaaagctgactaaaagtcttagacagcctttcttgtgtgtgacaagagttcttgtgctcttcttaagcattggaaaaaagctttgcatggtgggccacatggaggctatttggctgtgagtcttcaggacagagctattttactgccatggccactttgagaggtagaatttggagttcctgggaactataccaacaaagcagagtttgaggtagctaatcctctgtaaacaagttatctacagaagtttaggagaaccaaaagttttttatccagaggtagaatttctgagttagtgtgaaccgaggttgcaaaagttatcctgtccagcacaattatggttatatttgtgtcaagatttattacaaaaatacttgttgattcttgtactataaagaagaaaatgaactctgttgagttttggcgcaccatacttcaaacagggccggtgttatttaatggagaacattaaaaggaagtttctcccttaaaaattcttaatttaaaaaatcctaattagtgttccaaactgtcaatttgagcaagaaaatatttaaaccaaatttctaaattacagcatgggaaattgaccttatggaggaagaggatagaaacaacataggcagactaatgacaaagcattcagaaatgattccatttattgtttcactgattcataatgaatgtgacaggcctctactgccaaaaaccaatgaagtcctgatgaattcagctggaaacaacaaaatgcttaactataagaggactaaatgtgtgagggtttaattttctcacataataaaaattctgacatttgtttaggacctcaatgatttcataaagaaaccaaaaactttatgtctttccattctttagtgtttagagttaacttttatcatcagctggtcagaagaggactgctgaaattccagacatcatatccacattcaaggcaggaatatcaaagtcagggaagaactgcaatagccatatctgtttttcttttaggaaaagcaaaagccttcctagaggctctacacgtctcagtgtatctctctttaggtaaaaatgtgttacttggacatccctagtacaacaaaacactgaatatttaaccccacactcacaagtagctgcttctcacagttcatttaccaagatattggggagacatttagaagtgccagccataatctgtttgaacaacttatggcaaaaaaaatcagctaattatctgctccataatttcatacagaatttaaagaaacactacttatgaaatctctctcattctattgcttatgaaaataagaaaggtaccccagatgaattctctacatagaatcattacagtgccatattaaaaattactttattcatctgcacgttttcaaatacccagaaataagctatctcactctactgcaaacttcttgctggcagtcctatatcttactcctgttttcatacccagcacctgctgcagtcttggaacatggtgagcacctaacgaatactaggcaagtaaatagatgaaagattgtattgccagaacagtagatttgtaccttagaactttgtagacattgccaagaaataatgagctgttattttcatagtaactaaaagtatataaaaacagctcagggattcataaagaaagtgatcaaataataataagcataaaatctatccctacttttattctaatgtgctctacaagatcaatttaataacaagataaaaattaaaaccattatttttccatctacatacttaattgcacatacacacacacacacacacacacacacacacacacacacacacaaatgtttttggagccctttttgttaaaacacaaacaatggaaacaattcagtatttaccaagaggggaatggttaaataaagcatggtatacgcacagtatagaaagctgtataccatcaaaatgactgagggaggtctgcatgtgtgtcactagaacttcaaaagagaaaaacaatccagacaacttattttcaataatctcatttatgaaaaaatatttgaacaatatatagtatctgtatatttatatggatgctatgtaatctattacaaatctataaaaatctatctggaatatagattgtatctggcgagtggatatctggaaagaagactgagttggaaaagaaattttcctttttaccgcacatttttctgcatacagtagtacatgtatttccttcataattaaataagaatggggaaatttaaactattgagactagaagaacattgttgtgttgcattaccctgatctgattaattgggtaacttatggcaagttacataatatttttgagctttgatattgattgtccataaaatgaacaaaagatttcattcaaattttttctaacactaggaaaattcattaaaaaaattaacactaaacatggcacatactaaacatgcaatgtgtattgatccattgccattaattagcccctttacttgttatttctattgatgttgttaattctcttatttctgaagttaaaaaatgttcgttcagtggctaatgtcacaagcaagataaaagcacaacacttaatttggtattgttgatttcaaaacgatgaacaacctctcctgtaactctaacaaatacagattatggaaaaatttaaccatcatataaaactcaattattatgaattctgctctgatggaattcaatatttctaagataattaatactaggaacctgtttcaggttttgtctttctcactttaataaaaaacagattttagaattttattctcagaattaccctccctggttttattgctattcttttatgttaccatggaagcagcaattatttttatggttatttagttttgactgttttataagtagcccccaacccataaaaatcactcaagcttctctctcttgcttttacacaaaaatcataacaaatgttaaaatccttttttaacttagttacatttctaaaaaaaggtattttttttttgtttgtcaacaattataccttaaccatttctccttgcataggagttttgatagtttaggggttttttaaggccttggaaacatcaggaagaaacttacttttcagtagttgttagaaataattttcttaaacactcagatttcccagcaaaatctaaatggagttaatgaaagtttttgtagcaggaatactgcaaaagctaacaactggagaattattattcaattcaacatgaccattttgaagtgctctttttttaaagccttataaataaaaactgtcttactcaaagaataacaaaattcagcactccatttatatctattcttgcaatgatttattttcattgtcaagcaacttcatgataatcattaacactttgaaaagaataagaataatttgattaacttgaatataaacttttacaagtgaaagacagaagttacaatttactgaaataaagtatagcagttgtgagagtgtcttctctgtacttctgaaagatggcatggattcctggaagcacttccatgtcccgtacaatgttaatgactcagatttacatgtacagccccaacctctctcctgagctctagaatctatagccagttaattatcgttaatgtctgcagacatctcaaacccacctgtttccaaactgaactcatttcctttcctttcacagagtcatccaaaatggaaacctaacatagaaacatacttctgaagtccgattagtcaccaaatcccaacacttctatggaaaaatgtccctacatcttagtccttttataaccaggatctctgcctttgttctagcctatatctacttttacccatatggatttaaaacctcattattttcataactcataattcatgctacattagtttaacatctcattaaatattcagcagctttccactgcccaaagaataaaagccaaattctttcctatgatatacaaaacccctcataattgtatccccatctggttttccagcctgatctaccttgatgtcccatcggtctcctgtgctctagacatacgtctcatgatttctcattccttgaatgctttcagtgttttcctatcctagcagttcacttacactgttctctgaaattgagctgttggctacactctgctccactaaaaaacttaagacacactcactgttgaaaacccgataatttagcttctcatttgctagctattcattagcaactccttaacctaaacaggacacatttttaatggataaactataattgatttattcattgttttattgtttaacatacaatatttataaaagttcattgttataaaccaggcccatcaatttccttgtagctaaaatctggcaagcgccaatatttacttctttagaaatatctctagaagtacatttgctacaggacacatttttaatggataagctataatttatttattcttttattgtttaacatacaatatttgtaaatgttcagtattataaaccaagcctatcaatttccttgtagctaaaatctggtgatcactaatatttacttctttagaaatatgtctagaagtatgtttgctcaatcaaaggttatgcaaaattagaaggcttttaaggtatactaacaaattgttcttttttcttaagatttcagcaaataagactaatagctaaaataaaaaggactctgataaacatttaatacaaattaccctctttgagacttacaatgatctttgaagtagatagtgttattatcttattttacttacgaatgtaatggaaatcttgagtgattagtatcatgattgaaatggtaaagccagtgtgaacctaagtctgattccacaccaggtttatagtcactgtatttgcattgatttccaaccacactttccaggattataatcgcagtggccaaccctgtgtattatattttttttttgttttttatctttgccattttagtatgggagaaacattttatcttgtttcaaccatatttctagcattatcagtgcatttaatgattttaaaaactggcatttaaacatttcaaaaattgttattgcaaattttctagtgatattgttgcttatgtttccattgggggttgaaaggggtcttttttctcttgtcatttataagaatactttgttaaatattatcgccctggtcatgcattttgcaaacatttttctgactttttgtttacagttttttttatatacagacttttcaagtttatatattaaaaccaatgtttgccttaatactttctcttttttgtgtagaaatgccattcatttttaaagtgctttgaaaaaacatttatatcatcataaaggcataatatcaaaattggtactcagatcatagtcttattaggaatatgttatatctactcaaactgatattaatttttatttaaaatttacataaaatagctgggcatggtggcatgcatctgtagtaccatctattcagaaggctaaggcaggaagatctcttgcacataggagtttgagtccagcctgggaaatgtagcaaaaccccatctctagaaaaaaaaaaaactctaatacataaaatatattcataattaggtaaaaattaaattaacataacatttataacataaacattttactttgaaactaatcactgtaacaattttaaaaattcaatgctgtttccctctgaatagcagcacatctttaattaaaaatgaataaaaatagccccatacacattgtaccttttccttttaaaggcaaaaaaatgtaaagtaatggaaaaatattcacaaccctagtgaatgcatttataatgtttctttttctccctggagccactcatttgaagacagctagaaagcacgtggaaacattccatataatttattgcggtaaatgattcagagctatttttcaaggtagcaagcctttaaggaagcttatgctagccatttgttaaaatgctgttttctgccaagattaaagaagagatcattaggtatgatctacacttttatacaaatatctcctcctcgtctaacatctgattacttaaattgaatctaatcttatgacaggtgtattaaaaatttagagagtaaacaaatactttgtttcattacagatcctctcctagagaaagcttaattattttattaatatgttctaatgtactcacagattgtaatgaatacattcaacagatatatattcattttaaagtttgcatttttataagtactgtaattacttagaagccatttcaatactaatttggtccctttttagtagcttgcacagtggaattaaaacttaccagggatttcacagagtaaatttgcaagttaaatagaatggcctatgaggaaagaaggaaaatctaccattcattaaatgtttaaatgagttggatacatgcaagctagaagaaagcagggttaccacaacttctatagaaacaggaattattacaagagcctttcattatcattaatgcttgactgggagaacttctctggtctttgctgactttgtcctcctgtcaggagattatactatacttgggatggaatgctgtcttagtctatctgggttgctataataaacatacaataaactgggtggtttaaaaacaacagaaatttattgtacacagttctggaggctgagaagtccaagatcaagacaccagcagatttggtgtctgatgagggaaaagttcattgagccttcttcttgcatgctcacatggtgaaagagaagagctagatctctgggtttctttcatgaggacactaatctcattcctcggggcagagacttcatgacttgatcaccttctaagggcccagacttctaatgctatcaccctggggactggatttcaatgcatgaatttgggaggggggactcaaacgtttagactacaacaaatgataatttcagtcaatcattcatccaacaaaacctgattatcctagtcaataataaacactctaggtagtatatgactaaggggaaaatatccaaagaaaagaaacgtttcactttggctagctttttgggggatcatgagttatctctttaccctcaagttcttcaaacaatgaagtttgaagttttcttttaagtaaatccaataggccctgtgatcatttgatcagtcaggtgtcaacaaagtcttaggatacttttacatgtcagtgaatctcttattgccatgctactctgttcagtcttgattcttcacattttatttttctgcaaaattaatcccctcaagtttaaggaggcgtcaaagttgtaccatatcctgggcttgcagccattgtttcaaactcagtgtgtctataattaccttttgtcccaagccttttgtcctctaatctctttctttcatcttttacatttttctctctcatctttcatcaccccatgctcactacaaactggacctaagccctggggattcattctactagtctttttaaaatctatttcttcttttcttccattaataactcagctttctaaatttgagccttgattgcctcagacttgaattactacaataattttcagtgtagtttccccaaactccagcctgtccctatcttcattccaccttccttaaataattaagtgatgactccgtcgaaattatcgctcccagttggaaaaacaaacaagcaccaaaaaaaaaaaaaaaaaaaaacctgaaagagttcctagttattacaggataaaattggcattgtttacacaactttgacccctttctgctctactccatcaactttatggaccctgaccagacttgtaaaaaattgttattgttagttgttgtttttcttatagctttgccttttcttaaacccatttgccatgaccttgccatgcttttatttatttatttatttatttatttatttatttttttgaggcggagtcttgctctgttgcccaggctggagtgcagtgacacaattttggctcactgcaacctccacctcccgggttcaagtgattctcctacctcagcccccccgagtagctgggattacaggaacccgcaaccatacctggctaatttttgtatttttagtagagacagggtttcaccatgttggccaggatggtctcgaactcctgaactcaggtgatccacccgcctccacatcccaaagtgctgggattacaggtgtgagccaccgcgcccggccacttttagaactatgtaaattctatcaatctagtcgcacttcaaaacccaccatctctatatagtgctgtattttttctgcttttcaatatacatttatatttcctttgaacttagactgcagaattttttctcttgtttttaacttatatattatttctcaatattttattctttaatcattatgttgtcattcaattatgtatgtttcattatcctatctgcaaaaataaattgtagtcttttttggaagcaagaatttgttgtttttctttttaaaaaatccccttacaggaataaacgcttattaaaagaatgaacaagtaaacaattgttataaaaatgtttaaagttacacaagagcctgttatcataaaaatagcttcaaaattctgactacataaactaaaatcatcttcctggaggatgaaattgttcctctagaaatgtgtggatttggggctttggtaactgaaaaatgaatatcaaaagatacccatgttctaacccctggagcctgtgttttaccttatgtggcaaaaaatattttgtagacatgattttgttaaagatcttgagatatggagataatcttgtgttatctagatagccgcgctaccacatgtatccttataaaagggaagcagagggagaagaaaaggtgatgtgaccatagtggcagagcttggagtaaagcggccaataagccagggaatggttgtagtcacaagaacctggaagaagcaagggctagattttcccccagaccctctggagggaaagaggccctgctgatacctgattcccacccagtaaaactgattttggacttctggcctcctgaaatgtgagagaataaattcctgtttaagcttccaagtttgtgataatttgttttatcaacgacaggaaattaagggctcacaaagaaaattctagaaacagtatagctcagagttcataaatagccaacttctttggacaaaaatttctaagatactaaaccttcctcaaagttggaaacatacatgatttcatcctgatacttctaaacatgttgtgatagctagaaagagtggacctcagttatatagtactgattcttcagaaagttttaattgtagaatttttgtttttagagattctattttaactcaaatttttgtattctctaccatcatagtaattgtaaataacattgtcaattataaatcctatattaataaaaatataaaataactaaaatgaaatccttaaaatattaaatgataatggctccttctgttaataaatcctgcacaggagtgttaaaattattttatccaataattgagcaaaaaatcaacaagtaacattttcctaattcaagaaaattatatcagaggaacatctatgaaaacttggagttgataaaaacttgtaggaacttgtgatctgatcctgccgagtgttgcctggccacagtgttttctagcatagaaatgttaaatatgtcatgtttggcccttttctttccctgacaagagttactcaaagattgtaagtttttgttttctttcttaagatctcttaaaaattgaaaactagtattggctgttttttagatttatcttttaagtattgtagagtctcattttatgtttctacattttgattgttaacatctaccatgtaagacattttttcaaaagtgttagaaaaattgtcaattcaagtcaatctagaaaacaccttttccattttcataagatatttaaaattcatttcatgggatcctacattgatttaaataagtcacaactttggctctatgctttctagctatgagcacaaagttggttatatgattccttgtgtccataatattaaaaaacagcttcgtaaaagttcagatattcctggtgttaaaatcataaggatatctactgtgattatcgataagaaaagcagtacatggaaaagggactatggcaccaacaagggaaggacaccagaccaaattggagaagacagtgtctaagaaggcatcttagaaaatagcaaagtatgtcagtgcaaatagtaggacaaaatattattctgttgattaattggttaaagtatatcaccatcatcccatgcataactgagattaatattacatttctataaggcttaaacattaaaatgatattctgttttttaatgtacataaatgtgtatcagttttattaatgggattcccagaatatttggaaaaactccccttaaagtgaaatatcacagtaagtgtataaagcagaacgtttaatactaccctggtttaataaaaccccactacatacacacacacatacacgtagacacaaaggcgtacctcaaccatcaggacaacttttcttactgaaaatgggaatctgttacctgaaaaatttactaaaaggaaaatgtgttgctactaacagcatccactttgtacccattgcccaccaatttgtctcctctaaagctcctgttatatacagatggactgcaagctctctgctgactttaccaagatgaatttgtctccattaaactagatatttatttccagcagaacttattactcctgtgtactctttaatcttctgaccctcattcttttctccaccttgtcttcaaatagttttctcctgttttatgcctaattcgttttgacttgaggctataaccttactcattactgtgaaatgtatccttgttcaagtaaccttccggccaacattttatcatatttaatacttttttaattaaatgatttgaatgcatgagtctactatatgtgaagaatattaaggtctttcgaaatactcttctattccccatcacccttagactagctgtatgcctatttttcatcaaggacataattattttcaccataaccattttaagcactctataatagataatataactttatcttggcttaatccatgtagtaaaagtcagtttattattttctaggtaaggtaaataatgtctgtgatttctaaattaacagcgttgcctagcccacttttatattcttgagaagccaagcagaatccatacttatgattagttgctttgctgtacctgtgattgtcttcatcttactgcatttgcaattccatcctagttattaaattgttacagttttggaataaattaggcaaggatattcctagttttttttgctttttaaatatgaaaacttattttttcagaaatgaaaagatagcacaataaggccaagatgacataaaactatacaagaaattcatgttcaaatagttgactaggcaatactaatactttatcccgggaagagaaacattaagtttagaaaaagaagacatctgaaaaaatatgcaagtgaaatgaagatatttgatatattttatagcacaaaatacattttatattctgtataagattttttaaagattccttgcttaaaacttaccaatttttaaaaggagtcatcaaatataaaatattattgaaagtagcccagtgtaaggagactaatcaagtggaagctacacatcgatatggctaaaacacaatgttttagatatgtcatttaaagttaactatatatcccatatatattttgccttgctacaaatatagacgtagtagtcatactatgtcagcaaaatatcttctattataggttttacatgccctaattatatactcatgatgtcaaaaaggaattggatctgagatatcatgagattgtcatttttctgtataaatgatgaagaaaaattatttctaatttttttccaaatctattcttaacattaaaagctatctttatattgaaatatgtctaatacttttttctttgcacaagaaatacgttttctaggattttattgcattctacactaatttgaagcatgtgttagcagtatgaaatgggttttttcttttaattacatcatatataattatacatgcaagaaatatatatatatttgttatagatagatatcgctgtttaaatccactttgaaacaagatgtaatataaataggcacacaaaccatatactcaatctcatagggaatacaaaagaatcattaacaatacagcaagcattcataatgctctacaggaggcattcaggaaaagttctgataaggacaggaatgggtctaaaagactccacaaagcactcagcgtgcacagagagcagagggtgagtaaggacagcaaggacactgccacaaatggaattgaaagtctggagtgggacagtggaaaattaagttttacaagtagaagagctaagattacaatagaaggtaaatgtcaagcaagggaattttgacttgaggggacaaaagaagcaatgagctttcagactacaaaggttgtcaaaggatcgtgtgtaataagcatcatgaaaatacttggactgcacttttgttattaaaaatgacactgtgaattcagccaaatatgaaaagggcttcttattcatgttatttagtgttgaagtctaatttcacagcaagcaggggcagactgtagaaactttttcaattcatttcttttattctgctatcaaaggatttgatccaatacaaagcatgaagctacatgtggtgtatacagaaatgatacctttccattaaaggaaaaaaagcttcagtaggtaaccatggaaacagcctagtgtccattccaatttcgaatagaaaatcttagtcttctaatgaaaacctaccagatagacatacttctactccagctctctagttctaactctctaaaaaggtttggaatattcattttatttaagaaagtaaaatatgtgtttatgactgtaatatgcaaaatttgattttttcttttagacaaaaaattcaaagatgcattttaagaccgtaacaccaaggaatgatcaaagtggtcttgatagctcaccatagccagtgtccaattcatggtttacacattactgagagcaagtgccacttctgggtggcagaaattgtcatgttccaatccacctaacaaagagacctgattttttttcttcactcagtgagttaaccaagtgacccgtgaggtggacttattttttttattattattatactttaagttctagggtacatgtgcacaatgtgcaggtttattatataagtatgcatgtgctatgttggtttgctgcgcccattaattcatcatttacattaggtatttctcctaatgttatccctcacccctccccccaccccacaacaggccctggtgtgtgatgttccctgccctgtgtccaagtgttctcattgttcatttctcacctatgagtgagaacatgcggtgtttggttttctgtcttgtgatagtttgctgaaaatgatggtttccagcttcatccatgtccctgcaaaggacatgaactcatccttttttatggctgcatgctattccgtggtgtatatgtgccacattttcttaatccagtctatcattgatggacatttgggttggttccaagtctttgctattgtgaatagtgccacaataaacatacgtgtgcatgtgtctttatagtagcatgatttgtaatcctttgggtgtatacccagtaatgggattgctgggtcaaatggtatttctagttctagatccttgaggaatcaccacactgtcttctacaatgactgaactagtttacagtcccaccaacagtgtaaaagcattcctatttctccacatcctcttcgagctggacttattttttaaatgtatgaatcttaatgtggtgttacttataaatctaacataaatacatagcccccaatttcttactgaagctttaagagacaagttaaaattgttctctgggatcccttgtacagaagaatttcatataagttttgtagcttactccaggaggtataacataaccttcccccttccctggcatgtgtgctgtgttgactttcttccaaagattacaatgtggaagaggatagtggcaactttacaatggagaaatattggcaaatactaccttgagtatgtaatcaagattctataatgtgagtcatagtgataccgtgcacccttgaagtgatgggaatgacactgtacctttgaggtcttccacccccaaccctagacccctaatccagccatgagataaacattagaaaaattcaaactgagagatattctataaagtgcctgataagtatttctcaaaaccatcatcaaaaagataaaagtctgaacatctatcagagtaggctgagggcatatgatgactaaaaatatattgttggatgggatcttggaaaaaaggagcatggattggattcgtaggggaacatgatggaaaacctaatgaaatctgaataaactctagagtttgaaaagtatcaccaagaagtgaaatgctaattgtgtggaaagaacatgggacttggagcctgacagaccatagttcaaacactggctctcccacttgcaaacggagtgactttgtagaacttctttaacctttgcaaacctcataatcctaatttgcaaaaaaagaataatactgtatgtgctatatcatatttaatatacagtatattttaaatgaccactgtctttcgtaacacacaacagttgctcccaaaatgttgtttctccccttgcttccagcccaacatcaaaaggctagcacctctgaccctctgggggtcttttaaccaaaagaggctgctttgcccatcagtcacattaaattctgctccctggaagctcacctcaagcaaaagctgagggcagatgatgtataaatatctcagccctgtcactctttgagggactgactccgacgtgcttattctacactggttgccagggatccccaacagaattaagctctagttatccacagtgtaactaattagataatttaccatgtattagcctttttctcttccctaccaccatacttgtcttttctgagatcatattcctaacgaacgacttgcacttgaattactgtctcagtgtctgcctttgggggaacccaaactaaatagaccctgctcttagtttgcagcaatactgacagatgctataagtaaataagatttctttaaacttgaagccatctagaaaactttggtattatttgcacccaatgcaagcattgtggtaataattccaaggtaaattttgaatattgtgtccggtgaagagtactctccctttacagatagagagttgtaaacaatacataagtatatcattgtgccatttaggatattataatttggcttttcagaatctttatatatgtaacaattttatctaattacatgcctgaatatatctggtatagtatataccagagttttaggaagtgtctaaagatacaagtgaaaacttttaaaattgtatgaaatgttacaaaaacacctgtaaaagacattcagatgggatagcaaaaagtcttttatcattatttttcagctattgaaacaaacactaaaatacaatagtttatctaggtgtcatgtgaatgatatatttattgttgttatgtctgttttacatttacatgcttagatcagtaagaacctcaaagatcaggtatcttgctgcataatggtaccaactaatgagactggcataaagggaaactatgtatgcatgtatgttgcccattgctaaagaagaatatctcatttaggagtcagtgttcttgccttgaaatatatgttcaaaagccagttcttcacagaataaatacttaaggaatgatccagttgagaaaacataggcgaatataccatcaatagaaagataagttgccagaagaccattacaaaaagaagagagttcaaatgaggttggaatagtgggagaaattcttacagaaatgataacactcggttagatgtatgtgtattgaattcagcagttcatgaaggtgatgtgtaatttggataaacaagacagattaaacacacagaaaagtatgttgaataaatagatgattgaatagctgagaaatagaatgatagagatgggtcatgggagatgatgtctcacatggtgagaacaattctagtttttgcatgtttcctttttcctgatggtcccgtattagttttctattgtttcataacaaattactacaaatttagtggcttaaaacaacacaaaattattatttcacagtttgtaagaggaattcaggcacaatgtggctgggttctctgctcagggtctcacacagctgaaatataggtgttggccagagctgtgatctcaactcagcctcaggggattcctcttccaacctccctggttcctggcaaagttcagttccttgcagctgtaagactgacttcctatctttctttgttgtctggctctctgccagggttgcgctctgccagcagctagaggctgccctccgttatgtgccatgtagctctctccaaatcatggcagttttcatcttcaggccagcaggagagtccctctcttcagtgctaacccaaggttgtatctaatatctttgtaatataatgtaatgtgatcttgaaatgactgtcctgtcatggtcacagtctgtcttgcacttaagggaaggaggttatacagggcatgtataccaggggatagaaaccttcggtcatctgcaaattgtacatcagtcacataaaaagcaatatgtgtacattcaagcataactcgtgggatatattttggaagggattcccaactgagcttaaatttgcaatttatattcttcaatactgcaatagtaaaatataagcatctggagcatgtttataaattagatttcccaaattgtagacttcctttaaaacccttcagggcagagtcaagtattaaaattacataaaatttaacattggtaatgtttaaaatgggaagatttaacaatgaagtagaatagaaatgtcagtcacattttgttattatattactgcatgtggcttattgtattatcttgcactgttgctctgtttcccataaagactagggaatttcaaagacaaattattttcatttcaattcaattcataattgttggacactactctcctactagaacagtttccatagggattcaaaatatatccttagcattgttattgagtccacaagatttttttaaaagaatataaaaaccaataggaaaagatgagatagaatataatcaaatgtagattttatgcatgaatattgcacagataatcactaatatttagatattacttgaggcaaatgctttgtttagagcttacatgaatttggcttattcagtctgtaaaatagcctatgaaagaggagccatatatttatcctttttctcagatgaggaatccaacattttgacaaagactcccagtaaccctggtcctgagtgatacctctcaagcttaggtttgtgtaatcttctagagcccattgttgcagtattgtccaattccaaatatatacagatatgatacctacctgcggtacaatggcagataagctatctgggtaaaaatggtaagagagtgctaaatgaaaaaactgaagaatgtatgaagactttaaggagattagccttttgcttggcaaagcggagtgggaaggatagtcctagtgatgtgatcagcacatacgaggtcagggatggaagaataagctggcttgctgagtgcaaattaagcatcacattgttatatattgttatattgaggtgaaagcagaaagagtgaatgctttacagatgatgttgaggacaggatgagaatactgaacataagatgcatacccacatcctgtttttagttgtagaattttagagcattaaagctgtaaaaaataagtgatatcatgtagatgtgtaagagtaagttaagagtgtacagctagatgctacttactcctcctgaccctcctctgaacaaaccgctgagctaacagcctatagatgaaacctgaaatcaattcaggcataggaaaaggtactgtctgggaataaacttggcagctccactggtgacttcaataccatctatgaattctccatgctgacttcaggatggtgtgaatatggaggaagataatattttaaaaaataattcacattgctaaaggtataatttttgttgctaaacagttatctctttgatttcaatacaaattttcttgggttatttttacagatgagggagaaaatcattatgacaagtttattttcttacaagttttatttctggatttttgttgacacacttttcgaattgactgcgttccaaatacctaaagagatctcccagaggatgcaaaggtccacaatgactaaataatgggtgtgtaaagagaagtttaagcccgtggacaaatagtggcaaatagcagagcttcaggttcagagagacctccgtcactaagcagctcggacatattgggaatcctgtaacttctttggcttcagtttcacttagcgaagcagttggcaaaattcgatatatatcaaactgtgaacttttatagtaaatattgtcctgatgaactcgcacaagaaaagtattttataatttaaatgtagggaaatcaaaacctatatgatagagctgcaccaaatatacatgtagacattttgaattcaaatatatattcatttgtaaactataccttaataaaaataaaacaaaaatgaatacatgtatatgtatctaggcatacattgttttattactctttgctttattgtgcttcacggatattgcactttttaacaaattgaatgtttgtgacaaccctacatggagcatgtctattggcttcatttttccaacagcatgtgcccactttatgtctttgtgtcaaactttggtaattctcccaatatgttaaactttttcatcattattttatctgttgtgatgatctatgatcagtgattttttttttttttttttatttgagatggagtctcgctctgtcgcccaggctggagtgcagtggcgcgatctctgctcactgcaagctccgcctcccgggttcatgccattctcctgcctcagcctcccacgggcgcctgccaccactaactattgttaattgttttgtggtgctgcaaactgtacctatataacaacagtgaacttaactgatgaatgttgtgtgtattctgactgctccacagactggccattccctatctctcgctccacagactggccattccctatctctcgctccacagggcttcctgttcctgaaacacaacaatattgaagttaggccagttaataaccctacaatggcatctgtgtgttcaagtgaaaggaaagtcacatgtttctcactttaaatcaaaagctataaaagattaagcttagtgaggaaggtatgtcaagagccgacacaggccaaaaagtaggcatcttgcaccaaacagctggaaaaatagtgaagggaaaggaaaaattcttgaaggaaattgaaagtgttactctagtaaacacataaatgaaaagagagcaaacagccttattccgtatatagagacagttttagtggtttgaatagaagatcaaacaagctatgaaatgcctttacaccaaaacttcttccacagcagggccctaactctaattctatgatgggtgagaaagctgcagaagaaaatttgaagctagcagaagttgatttatgagttttaaggaaagaaagataacataaaagggcaaggtgaagtagcaagtgctgagggagaagctgcagcaagttatccagaagatccagctaagatcattgataaatgtgaatacagtaaacaacagattttcaatgtagataaaacagcacccaattggaagaagatgccatctgggacttccatagctagaaaagcgaagtcattgcctagcttcaaagcttcaaaagacaggctgattctcttgttaggaaaaatatagcgagtgactttaagtcaaaagcaatgttcatttatttaccattccccaaatcctagggcccttaacaattatgctgaatctactctgcctgtgctctgtaaatggaacaacaaggcctggattatagcacatctgtttgcaacatggtgtactaaatattttaagcccactgttgtgacctatttctgaggaaaaaaagattccttttaaaatattactcctcattgataatttactcagtcacccaagagctctgttggagatgtacaaggagattaatgttttcatgtctgctaacacaatattcattctgcagaccatagatcaaggagcaagttcaattttcaagtcttactatttaagaaatacgtcttctaaagttctcactgccatagtgattcctgtaatagatctgggcaaagtaaattgaaaactttatggaaagtattcacaattctagataccgtaaataacatttgtgattcatgggaggaggtcaaaatatcaacaatatcaggagtttgggaaaagttaatcccaaccctcttagatgactttgaggggttcaagacatcagtggaggaaataatttcagataaggtggaaatagcaggagaactagaattaggagtggagcccgaagacgtcattgaatttctgcactctcaagctaaaactttaatgaatgagcattgcttcttatcaatgatcaagaaaagtggtttcttgagatggtgtctactcctattgaagatgctgtgaacactgttgaaatgacaacaaagtatttagaatattacataaactcaagtcgataaagcagtgtcaggttttgagaggattaattcaaattttgaaagaagttctaccatgagtaaaatgctatcaaacatcacatgctacagaaaaatctttagtgaaaggaaaagttgattgatgtgataaacttcattgttgtcttattttttaaaattactacatccacctaactttcatcagtcaccactctggtcagtctgcagccatcagcattgaggcaagaccctccatcagcagaaatattaccactcaccgaaggctaggataattgttagcatttttaacgataaaatatttttaattaaggaatatacattgttttttgagacacaatgctactgcacgcttaatatggctacagtatggtgtaaacataactcctatgcacaggggaacaaaaaaattcatgtgccttgctttaaatgcgatacttgttttattatagtgatctgaaactgaacccacagtatctctgaagtttgcctgtgtatatgcatgtacatacatacacactcacacccctcttcatctatggattaaaaaaaggaaagaaagaaaccctgtggcaagataaagcaagtaaagggcatttaattcctgagatctttgcagaaagagacaagattcaggtcccaataatacagcaatgcctttgctttcttactttgtaacgtgtactgctggaacaaggtttcattagcacaggctcatgctagagatttgagaaaacgtttgtttgtagtttttctaaagggtcatgaaaaaagagtattttaaaagaagtaactatacatatattaggattttaaacataatacaactgggaaaaaaaatgtggacacctagtctttcattatataaaattaatttaacagaatattttagatccttctcacagaagtccttgaaattatttagatgttttaggtatttgaagaattgtaaaatgtctttggacattctccctaaaaagaaaaatccagaacaaaccatacatgtacgtgaaaaagaaagaatgcttaccatctgatatgatttggctgtgtctccaccaaaatctcatcttgaattgtagctcccataatccccacgtgtcatgagagggacctggtgggagataattgaatcatgggggcaggtttttcccatgttgttctcatgatagtgaataagtctcacgagagctgatggttttataaagggcagtttccctgcacacgctctcttgcctgccaccatgtgggatgtgcctttgctcctccttcaccttccaccacaattgtgagcctccccagctatgtggaactgtgagtccattaaacctctttcctttataaattacccagtcttaggtatgtccttatagcagtgtgagaacggactaaaacatcatctatgaaaagaaaaatacagagattaaaaggaattgagatttgaattggctttatatgtagtatcatccattatagatagtactcatttgattacaatataaattcagaagcagaaatcattacgacttcaataaagtatacataaaatcaggaaatcacctagtcacattataaaacacctttatgaagatacagctataatataaaagtattttgaaaatggttgattttatactattggaaagtataactggatgttaaaatttcagcccagataccaagatacaataaatgtgaaatgtaaaatcagatttccctatgcaaaatttgcaatgacaatctaaaatcagattttcctgtgcaaaatttgcaaagacactttggaaatctgatttcgtgactttagacacttcaaccagcatgaggaggaaaaggaggtatgttggtttgctggagctgttgtatcaaattactgcaaactaggttgcttaatagaaacctagtaaattgcttaatagaaatttattgtcttatagttctggaggctagaagtctgaaatcaaggtgtcagaagtgccatactccctctgaaacctaagggagaatcatctttttcctcttctagcttccggtgtttgccaacaatccttggtgtcccatggcttgtagatgcatcattccagtctctacttccatcatcacatggctgtcttttctctgtctctattctcttataaggacgccagtccttttagattaagggcccatcttactccagtatgacttcatcatgaggactatctccataagtgtgcacattttttggtactggtggttagtacttcaatatatcatctggggagccacagttcaacccataatggaaagtatcagaatatgaagaagattacaagattttgcctggagagattagttgccctccctctagaggagatgggctgggattctagcttccagtaagaggaggattcaaggccaggaagttcttgagcttgcaacccatgcaatcacacagatccctacaatcttggaattcttggtaattttataaaaataagttctgcattttcattttgcactgggacctgcaaattatgcaggatgccagttggagagcttggtatatgcttctggtacttgagaatatggcaggctgtggcctgactcacacatgataaggctggcttgtgacaactgaatacagggagctgactgcactgcctaaggttagcctgcctcccagagttttcacaaaaagtggctcacttataaaatatgcattgtcctctctctttgcacttcagttaagaggtgctcagagatgggaatctctaagaaaatccaaatggtctcaggacagggagctttaaatctctggcaggccagagaacaggaaggagttatacaaaccagttcaagtaagacctctcttacagctttgccactctggaagaataaaaaaataaaaaataaaaaataaattgattagcagactgggtgaatttaggagtgggtaggaacagtgaggaataaaaaaaaagcttaagtcgtaaaacagaaaaagcctttgcctctgcaggctgccaacataaattaggcccaatgtgaagaagggggaattatttgatattacattacatttagagttttgattagtactactaaacagtatattctaatttctgaattgaatcccaaggtgatctaaacaggttagccaaaaaaaaaaaaaaattcatgtacaccatgtttttcatttaggaataaggaaagatatgttatctactccaatacattgtaaagggttagtggtgttgtggcctgaattgtgctcttctagaaattcatatgttgaagtcttaacccccagttccttagaatgtaaccatattagagatgagtctttaaagaattttggcatcattagggtgccctaatctaatgtaactggtgtttttataaaaagaggagattaggacacatgcaaacagagaaggaagaccgtgtgaagacacatggagaagatccctcttacaagccaaagagagtggcctcagcagaaaccaactctactaagatcttgatcttggacttccagcctccaaacctgtcaggaaataaatttctgttgcttaggccacccagtccatagtactttgttatgacagccctagtgaactaatacaacagtaaacaataaaaactgagttattacagtgattagtttgttggtttgtttgttttttttagaggagtctcgctctgtagcccaggctggagtgcagtggtgtgatctccgctcactgcaaattccgcctcccgggctcacgccattctcctgcctcagcctccagagtagctggaactacaggcgcccaccaccacaccctgctaattttttgtatttttagtagagacggggtttcaccgtgttagccaggatggtctcaatctcctgacctcgtgatccatgcgcctgggcctcccaaactgctgggattaaggcataataatcaacaaggtccataaaatggagcatagacatcatcacctgtatcattatcaccgtcttataagatagctgagattaaaagagttgactcaaaaatggccattttagtggttgtttgtagacctagcttgactgaaggactacatgagaatatatgtgatactagatagctcataattttacagttgagacaacatgaacattaagtgtgaaacagaattttaaaaacactataaattactaaatccataggattcatacaaagagctctacatgttacattttgcagtactgtaagttggtatacattcatagaaatataaatgtaattgcacaatagaagaatagagcaaatttatttaatgtaatatatacgaagcatagaacacattttttaaaaaaggtagtgttcaattaatgttaactttctccctgtttcctcttttataatggaaggaaaggcacagaaattgattgtttttccctgcttctagtcagcttaatcaaagtgattagactttgaaccaattaattgtcattaaagtcaggctgccactggaacaaatggaaacatatgctaaatctatggttcatgtaacacagttctgctttactaactattggtaaccgatgataaagcaatttgagagataattagaaaaggaagaagaatagtttccattattttaagagaatgtacaatgagattttattaatgaatgaatcaatcttgtatcgtgtagttatcagtatatgtgatagtttaaggtaaagtgcttcattggtgtgcaggttagaaatattttaactcacatagtcaggcataaaggtttcaaccacagcaaggacaggctgggccttacacatactaactgagagtgtctgtggagtagtgagatggaaaaacaagcaacagctatagggaatagctgcttcctaggaaatacagcatgagatttggagattgtccccaaagtcataaaggaactcataagtagttaatctagagggtcataatacaatgctgaaattatcagaaacatctgtcatcaggtattataaactctctctcgggacttgtgtagtggccaagggtcagcacagacaggcaagagcaaacattgctggacccttatactaaaatttcttggcagtattgggaagaaatcctcaatttgggattaactccaagactgggaataataactctaaatatcagctactgaattttgtctgtgtgctagaatctctgcaaagtatttcacatataatgttttcagtatacccaaagtgaattccatgaacctttcacagtagtaaacatgaaaaaaattttaataatgacaattatgggttaaaaagctaatggatataaatgataaataattgagatcaaacctaataatttccagataaaatcaagaaggatatgtatatactgacatgcactgacttttttattattatgaagagtaaaagacatcctagaaacaagcatacaaacgagattatttcccaggtacacaaagcaaattaatcctgattttacattaatccaagaaaaataaggaagcattatctacagattgtttttaacattgcttgtgagccaaatattttaacatctgttaattttttttcaagtacaaaggccaaaaaaaatttagcagacatataatttatatacacatataagtgcagaaactgttctacagatatatctttcttaaatgtacgttacttataactgtaacaaccacaaatgaatctaaattagaaattgaggatcaagggatatatggtagactgctctctgaaaggttcaacaggtactgtttccaaactatcttaagacactggagaagaatacactgtataaaaacggcctgagccattagaaaattaaggctgaaatggatgttatgatgtttccttttacactggcatttgtacactttaaaaggaagcaattctaatgtcgaagactatccttcagtattgaaataatcctataatgaacaaaagaaatttctctagaaattttcttctctcagcttaagattctcacttgtgtaattaaataagtttgtaattgtgtttaagataatacggtttggggaggatatgaatatttctgtttgatgggtttttattttattcttcttaggtgaccatatgttcttcataaaaaacatatgaacatgaaaaagtaaagaacctagaaaatttatttgtgaattgaatatatgaagtctgtgttatattttacataattcaattaaatgtacttcacatttctcaaatttgtatattattgagaaaatgtataacctttgtgaagaattttctgggttttgttgttgttgttgttgttgttttgagactgggtcttgctctgtcacccagactgagtgcagtggtgtgatcatggctcaagcaatctgccaacctcagcctctcccactcagcctcccaagtagtggggacaacaggcgtgtaccaccatgcttggataattttctttttattatcgtttgtagagctgacatctctgtatgtttccctggctggtctcaaactcctgggctcaagcaatcctctcgccttagcctcccaaagtgttgggattacaggcgtgagccaccgaaccaccgacccagccccccataatttccttttaagcggttggcagaagagggtatttgtgttctgtcattgattttgccgcttcctctcaccacttcttgtggttttcatagaagttctgagtagcaatgctgcagaggcaactcttccaagactaactcgttcagcttacggagctccagagtttatgttatttgtaaagctgacttcctcagatttcatcagatatctttgagaaacaaaaagaccctgacatgacctttctcattatgtattctgttgacattgcaaggagaaagaaaaacccacagaatactgaacaatgcttatcgtagttaaaagaagaaaacacattctataattatgtgcttaataaccctcatgaggctgggcatggcggctcacacctgtaatcccagcactttgggaggccgaggcaggtggatcatgaggtcgggagattgagaccatcctggccaacatagtgaaaccccgtctctactaaaatacaaaacattaggccggcatggtggcgcatgcctgtagtcccagccactcgggaggctgaggcaggagaatcgcttgaatccgggaggcggaggttgcagtaagcccagattacgccagtgcactccagcctgacgacagagcaagactccatctaaaaaaaaaaaaaaaaaaaccctcatgaaaccttaataatcaatgttgtaaataaattattcacaccaggaacaaaataataaagattattatagttcaattgaattatctaacaaagagtccataatccaccgtgacatttcttggatattttcagaagaattgatgtagttaagcttaggcaaaccatattagagagataagtgtagagcctacctttaataagatctctagagaagatacttctacaaccttcagaagctcactgacagtatttaataaaacttacacgatgtacttatgttatcagaagaaagatttaaacttctatatgaaaaaatgacattgtagaattggagaactggtcatacaatagtaggaacagggactgccttcactgagctccatgcagtttgtaaactttattttacttaacctattgagagctttataatgcaagtatcatgaaagaactacagtgccagcaaataatgggtatttaaaggtttgttttgttaaactgaggcctcaccaaaacatcataaaacagatgactttgtccctattttgcagttgaggaaaaagactcaaagagatgaattagctttctcaagataacataccagcaatcgtttgaaaacacaagtttatctgatacgaaagcttccctggatagatctgctctattgtgacattttaaaacatacattttttttattagctgaatttatattttcaggtattttcttacactgctgacaaagaaatccgaaccgatgacttgtgcttggatgtttctagactcaatggacctgtaatcatgttaaaatgccaccatatgagaggaaatcagttatgggaatatgatgctgaggtatagtattttcttaatttacttattatttgatgcttaagctcagttatatatttcaacattcaacatttaaatcttaagctggtttttatctacattggcagaattagattttcaagcatgcaggctcatatccggtaatattaggatggcatatcatataaacaggtttcaccaaattggtccattaatataaaatatgaatgaggacaataaaatcagttttgtgtatgacaacttgttatctccatgtacatgccaaacataaattaggcaagaggtaagctaagcctatctgagaggtttgtatgaagatgtgcatacaggataatattgacaatatgtccatattttcaaattttaaattttacaatactaatcactgacatttatgttcctcaactggaaggaacaatatctgacaagattaacaagatttctttactgtttacagttgtaaatattttgcagaattcagtaaactaattagtcacataaaaagttgagtagcctcttctcaatatagcacacctttctgacagagaagagggagagaaaaccacaaaattactgttggaaatttatctccaggcagtgtgtaaaaaccagatcagccatcagatggagctaataaaaaagaaatattttcctttgcataacgaagcttactcttgaaaacagcttcatttctttcagttttcttttttgattaacaaaatgaattggttgtctgtgttacatttcccacattattaagtggtaggtgatttatttaaaaggaaaactaaacttcgttctgcttaaaagataaatactactatagaggtaaatgagtctcacagatgcagtattccatgcaagcctaaaattttctacaagaataacattttaaaaaccaatctacagagtttttggtattgttgatattttagcaagaccttttaaaaacctttttgaatgtcgttttaatatttgcatgagtctgtagtttcttaagttgaatactagaaaaatttactgaattctcataggatttgaaactggttgtgcagggttaattttgggcctaacactcatacagtgttaccaggatcttaggacacaaaatcatcttctgggccataattgagggcaaacactgagaattcttcctatgttgtaccagtgtgattaagatgctactgccttcgctatatcttactcaccttgtctgaccaccaatttttttctcttcaactattatttattggtaccatccttgatattaagcctacagaaaacagtgcctttgcaaaatacatgtaggtaaatccttcatcagtactctcttctatgaggaaaagtgcagtaaaatgtacagatatagtagaaatcctgtaagtgatatttgtttttaaataaaacttgttcttcttgttgttactgttccgtttctaccaggaacctggggctctactgagcttatgctaaaaataagaaaatctagaatatatttattaagaaaggggaatgatcgtgtacatttttataaaagcaagcagtgtggaattttagaataccacttttaatctttaaacttttccataactcttgagtgaacaatgtcataactcaaattctttcatttctcaaataactactgttagcaatttggtgtatattttggtttacattttctgtcagctagtagcaatgctattgaatactaaggaattttaagtaaaaagtgaaaaaaaaaataggtagcttcacataggtagataaataaatgatttctataaatttactcttttggatgactagtagttatctgttgcagtatttcagagcactataatattttgtgtcatgtttactttgactttggaacacacgcacaaaaagcttataaaatgtcataaatattgagaaatttttattttaaataatttgatcatctgaattatatagcttaattaaattctcttatatgtttatgttttcaaaattaactagtgatgtttacattgtctaatgacagcactttgccaaattaaaaaatgcataggtcataatctaataaatgacatgagaatagagcaattgtaggaataatacattgcctttctggaaatttcagctttgatgtgcgattatatttttgagaaggtcgttaaaaaggattttttttaaacaaaattgaaatataacatttattactatgcttttcagttttacatttagggtttctttagttcacagaatggttccaccccttgctacccacagggtgattccaggagtagtagcatcacctgggaacttgttagaaatgcaggatccgaacccatgctaaacacactgaatccaagtttgtattttaacaaaatctccgatcattcatatacatatttacatttgaaaaggacagggtcaaatatctatgtatcttccatagtctttttatacactggttaaagaatgttacaaatttaggaaaaggcatgaatacaatttggaaaatggcaaggcctccagaggggagcagagagagggaaagggagcaaaaggataagaggtgttgagatgagaaagaggaataattgctcagtggttctattcttctcatattccaacctgtggaaagtaaatgcgcactgcttactactttaactcaattctttatcttttgctggcaaggacaaaattattctttgaaaaatctctgaggtggtgcaggttcaaggcagaataaaaattgttggagttcatagaattacagaactgaaatgtaccttaaagttctctcctttaagcctttatcaggaggaactaaagcataaagattacaccgctagcagcagagctaggattcaggtcctaataaagtattccaagcaagctagctatcagtacaattgtgaatctcaccatgtgaacagcacaaatattccatcaccttatctcccatagtcctttcaatcttagaaaagaaagtcataaatagaagcaagattgttggaatatccagagaaaaatggaaacagtgtcatgaagcctcaaaagatggaatctatccagctactttggttttgtttacttcttaggtgagtgggggaaaagagaaggaatacagttcaacacgtatttatctgttttctcatgcaattcttacaatagtcttataagacagttattctatttttcacattagtaaaatgaagcatagggtaaatgcctcgtttaagtttgcacagccagattctggcagtaaatccagcaatttttctactacactacattgcctcttgatgttgtcgaaaaactggaaataattagattctctttcagtggttaagatataataagctaaatatacagtatttcaaatggaatagctaaatgctatcagttatttgttatgccaaattttgaactaaaatttctcatttttttaatagggggaaaggtgttctacaataaatatggtccatttagctaaataagcagtcataaaactactttgtcattttgctctaattgcttacaaacttcagctatacatattcataatataatatctaattgcttatccttgtaattgaatgaaactaagcacatgttagtaataaatgcacttctttggtcaactttgatttcaagtgtagtttctcacacccctaactaaatagtccttaaataaccacgaattcaattcactgtcatcttatatgtggcctaacctgtttgaattgagggcatcctgggcatcattagcaaaattgtggggtacctacgtggtctggaagcttaaataaattgcacaaacccttctgtgccatgaaatgcctattgccaggattaaatgaagagaaaaaaattcatctcactgagacattttaaaaattatttttataaagttctgtcatccattaattctattgttttcaggtgttcttatattctgtttgaacattataattatgttccaatcaatttagaatatttccctatgatatgtgcacataattacatttctttttgaataactaggcagctacatacagtgtgagaatctaattttagatcagaacacttatgttcaacaaacactatgcaacaaagaaaaaaagggagaaaaatatgatactaaaaataacttatttttcatgtgactgagcaagttgacttagaaaatacttgttgtgaattctatatacatctgtatcaaataatttccagagtcacaatataaggaatttttttccataggtgaaatgtgttagattaatatttagactttacttacactaccatcttttatttacctttattagagagcaggtaaatgggattataatttcaaggtaagtgatctttaagtgcatcccagccattcccctgtgtagcattcctaagaaaaacaatggctcaatttaccttttgaaggttgtgtgcattacacagttattacctttccatattcctattgacccatagctgtgatttcttattagaagtagtgagtaggaatttcaatagattagcgtcatatttgtagttcctatatgttaaatgattacacttcatattttataatatttctgttcgactgaatgcgtagattaccttgtctggagatcataattaatgttttgagtaacaactttgttatattaatttttaattgttattctatgcttgattaacagaagaactcctattatctttgctattaaattaaatatagtacaaatttatacttattttgtatatgattatatgtaataacataattgattgggttttattttaatcttttactataccaacttttaaactgagacctgtgcgattggctcttaaatcaactatgcagtcagttcattaaaatatctatttttttaaattagtatgttttaataccaaggtatggcctaattttacaatattaatggctcttattttgtcaccaaaattgtttagcctgattccagttggctttaagtaggaattatatatttggaagggtaaagttagagatactccacgctacattttatgttagtcaaacttgcaaatatatttaaaggcatgaatcgttaatatttttcttatgtatttttacatgttacgattaaaatattctacattgcaggcaataccaaggctttgcattctagaggagaacaataaagtaatactatattataaacaaaactcaatactatcttagggtttagatgatcctatttttagtcaatattttaaataaagctataggaaaatatatttggcagtaagttgcatgtcagcctggatgtcacattgtcttcaaagttgagttaatatagctggatgtagtggcatgggcctgtagtaccagctacttggcaagctgagatgggaggattgctagagcccaagagttcaaggccagcctgggcaatatagtgagaccctttctctaaaacaaaacaaaagtagactaattaggcatttgcaacaaaaacagatataactaagggttgatatacctaataaagagcatatcaacccttaattactatactttttgaaagggaaatagtataccacatatagaaatgtgcaaggacttgaataaacagcatagtagaaatgtagccaaagaaaatgaaaaaaagtttttaaaaaacataaataaaaatcattttatgtgtgttactgtattcatttcttgcttatcctttcaatacagcaagaaatgtttttagcagcaacatgtaatattggtgaagatgcagtgagactgacacccataaagtatcctggcagatagcaagcacaagaagtgttagctgctgctgctattattacaaaattactgttatagatatattttaaaggactttgctgatatgtgttaaagtgttcatgtatttgaccttgcaatttcacttctaagaatcatttccaaagaaataatgacagatgtagacattgatgttcagagatatttgccatgtgttattaataatgacaaatatctctgaatatcaatatattgatcaaatatctctgaaatacaatatatttttgttatttgcaatagctccaaattggaaagatattccctgcaaataaaaaagttaaatggattttggaaattcattttagagaaatagtttatttcttaatagtatgtttgtagattattttagtgatagaaaaaatgcccacaacatgaataaaagaatattttattatatgacctcaattgtataaatacataaaattattagaacatacatacaatattaataattgttatcttttcaaacagtatactgagaaaaaaatgaactatgctttgttttcaagcaaatgaagacactaaataattttgtgtgtttttaaatgaaaaataatttttgtctcaataaggacaagatttgtaatttttcttctgggctatggctttttagaagtacctggaatgaaacttctttgactattttttcatggccattcatttgataaacacctttgggacatatgttacagtcatttttttaatgaaaattctatattgtatttatgccctggggtcatgtttccagaggataagcaaaatcattttgtttttgttttatgtcataaaaataatttttcttctatattacaaacataattaacatcatttacactaatatctttgttgttaaagtggcattttccaagaaaagttcacttcaaggagaaatatcactgagagtagaggatgatctagcctagcagttttgaacagtatgggtggaaaattcatgtttggtttaaaaacaaaaatataaactagtcttcttaaaaaatcaagctatatagttaacaatattatttatagttacagttttaatattaactacatagttaatattatgaatacaatgttattttttctttctttacaaattatgtactattttactgtggaagataaatccttgaaaacataaatccaataatttgtgttcattaagctgcctgagagaagtagcttaattttaacaggatttattgtctgcactggtctttcactaagtgtttgaatcaacagacttacttagtgtctcccaagggcaggcacggagcttcaagatgtaggtggccatagtctgtggctttcctggagcttatgttcctatggaggaaatagatggagagcaagaaacagacagataaattaattaattaaaattgtttggagaattagattaagagttaatctttttctttttcctcccttcattatctacctttctaattgacatctaacaaaggtggcaatgtacatgtggaacacaacccaggttagccttgtaaaaacataagtgggagcaatttgagtaccatactgttcaaagtaaagccttaaagctaaattatcctctgaatttgtccctgatatttatttaattttagggtgaaagaatgaggaggccaagggccatagctggactaatcaactattttgaatatccactcgcaaataactcatctggtactaaaaagcattgtattactaggatgaaggctgagaatataatcttttatatctaaaataaccttttgccaaaaatatttcattattttatcgtaagcccctctccatattctcagtcttatcttcatttactccttccttatagggttgatattaaagccatctaaaaaaatgtggctcacagctccatggatacaattattgtgacatgtgccttccatctttatccagtagaaattgcatgttgcctaggatgattgatttattactgtctttgtacttgattttgtcattattcgttattttctttgtcaaacagacccacactcttcttcatataatcacccagtcttgtctctcagtgaacaaagtagctgatggctcccagcatcctactgtggaaacctgtaatgatagcactttgcaaaaatggctactaagaaactatacaagaatggaaatttttagaaatatttttgggaattctactgattacattctctaatgatttttggaggtttgtgttgcagattttattaaatttattttagcatttttgttatgttcagttattgaaatctggaaactcctttaaaatgtggttaagaaaaatttgtatgaccttttctccatggagttaactctctgtcttttacttcctagctactcattaatttggggactgcatatattaagttgtgtttagtctatccttaatgagtaggggtttttttgttttttttctttattttaaacatatatatgcataaatatacttgatgaacgatattatgaaatattaactctctttgaggcaaactatagccatgtctatatgacaacaggttctgcgtcatcagatctgaaaaaaatcgattaaaaaactaacagggccaaagaaagtattgtttctaagacactggaatcatttatttttgtttctttttattcagatactttggttaaatgcaaatatggcatatcctttctaaagtatcttattattttaattaaaacactaagcaaacacattattaaagactaagatgtgatttttaatacctttataaagaaaattatttctaagcatttctttgtggttgcctaagtgaaacaatatttttttaagttgtatcttttatctctcacttttacgatttgtgactatcttttcagcaagcaataaaatgaatcattacacaggtcaagtcaacaaactgatatggaattcttgtaaagagtgcaaataagaacatgtcctagcttttagttttaaagagtgtattatccaataattaaaggattttactttgtcccagaccttacaatgagaacacaaggaagattggggcatttttctggttcagatgaaccacttaaagattgttagtggaggaaacaattgagcttagaagtcttggaacaaggctagaaatgaaattatggatgaggggacaacatatggggtactattttacttagaactatattcaagccaaagacattccaaatgtaagagttggtaaagctggaaaagtctaggtcttttgcacaaagagaacttatgtacagagcaatttatgtgtattatcttagtttgctttcagagcaaccaatcctgatacgtgcagtgccaaaaaaggaagcttaggcttaactaaatatttattctcacaagtctactgtagagtgctagagcagagaccacagagtgcttctctccataggagaaattggagcagttcccttagcagttcttacagccttctttacaggtaacagtctgttgcaaggagatgagatccacatcaggcagatgtcaaaaccatcctggcttattagccttatcctcacagaagatgatgtttccttgtaacaactccataggcctagcttccaggaaccaaataaaacatttagaattacaagtctgcatttagaaaagcccgaagtttgcttttctgttagtatatatatgcaatttatcagttgcagatgcagtttatcaatcagagttcacttttaccataaacaatgtagcctagaaacatagttaacatttttaccctttcaaggttgccaggggattacagttagatagttgactgaaggtcaaattttttaaacaaaagggaaaaactgtatttgtaagcatgtttaagtctaagtattttctgacaaagaacatgattcctcagaataatttgaaacatgcctgagtgttcacagccagtaagtaaaggacaggaatttacctgagtctaaaaggtctggttttccactgcactacattataaaggagaagtatttagttgtttgtctctgcagcagtgggttttgactattagtgaattccttcaaataaatcatatattgtttagaaagaacaataataactagtgtttttaaaattattatttgtgcagttgacaacatctattcaacatgttccttaaagaaaaatctccctaagtctgtgctatattttgaactaaggtaactgataattgatcaaagcattcaactactatgatatgtgatcaattgcaataagacactgggagtgctttccggggtagcttaatgggcaatgacatatttgatatatgaaaaatcatactttttttaaaaagggatctaatagaagtatgcaatggtaagtgatatttttgaaagagaatatatacataaaagaccacaggtacgtaacaaaaatgaaacaattttgttgatttttaactagaactgtctagaaaaaatacatattgtttttgttatgcatctttattttttcaagctggctactggttgaatttctggcataataagcataaatcagccatcttcttgcctatctttggccatttattcctttctttgttttttagtgtaaatagcttgattccatgttttgaaagagcaacaacaaaggtctcaatcttgaaatctcctttgtatctaattgccttgctcttttaatttcctgcttgctgcctcttaggcctcttccgccacaaacctattctccattccatcatttcttacaacagtgcagtccacgatgttttcagtcctaatctaagcaaactacaatcgtctggctgctgttcctctaccatttttatggcccaccccttacatttactttcatcccattttcaatgtagtatcatgagccaaaaaaaaaaaaaaaaaaaaaaaaatttctttgcctttaattttggtaatttgcaaaaaaaaaagtatctagagtgctattttcaagatatatttgcaaatcatctctcatacattcaaatacttcgcttctggttggagaggttttcatataatatgatcctaggtattgcccatgaaatagcagaaatatatataattagtatgtataaatcatgttgatttaaaatgtatatctgaaaagtccaaaaatgtgatttccaatgtacgtaaaaatgccaaagagaagatatataatgactggttaacatacaattattggaatttatgaagaaactaaaatataaatataatgtttaaaaatatgtgatcatcatgcccctgtttttatgttatatttttaagattcttaaaaatacagaccaaactattgtaaggattttatcaagtaagacagattattttttgctctgataatcactttctacaatgagtgtcttacagtcacagatactatagcttgtttagtattttgaaatgggaacatctctagcagttttgttcatttgggtcacagctgtgccatctatttgcatgtttaccaaatggttactgaataacacatgcctaagaaaactaagcttttgcaaaagcttgttaatatttgcagtcctcaactgaactcggagctcacaaatgggctttttgcaaaggagcctgaattcttggcaatgcttgataaatgtcagtcagtttctttagccatctgcaaataaaggtatattagacaatgatgacttcataacagtcaaagatgtataataattaatccagggacacctgtgcacagttccttttacaaagctatcacagtgtattatactataaaaatcataaaggattttttaaagaacagattttatctgatgtgctagcaaagctaaagacgaaataagctgcactgattattggttatcttttacagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatgtttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctcctagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttaaatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttccaaaaactttgtcttcaaattttaattttcttcctaatattcttcacattaaactatggactctaattttctggataaaatatcctgccttatggaaatgaaatatgaaattttattaaaatgctgctatatta

SEQ ID NO: 2441 - DNA, 270739 bp, Homo sapiens
gaggaggggggtgctcgcgccgccgggagaggcgagcgcgaggcagagagcgcgattcggctccaaactccggcgctgcagccgatcggactctgggccgcggtgggcaccgcgcgcagctagggagccgagaaccgcggcgagccccgaggacgcccagagcgcgagggtcgctgcgcctcgcagagccggagccgagtcgagccgggcgcccgggctgcctggccgcggcggcatgggggcgcccccgcggctctccgcgctgcccgccaccgcctcggccagtggccggaggcaggagcgcgtctgagcccatggcgaggggacccgccgccaccgcctccacccccgccgccccgccaccgccgccagctcccgggcaccatgcgaaccgccccgagcctccgccgctgcgtctgcctgctgctcgccgcgatcctggacctggcgcgcggtgagtgcgcgggcgcctggcgggagccgagcggtgaacgtgcgcggggacggggtgccgggggagggcgctggccggggtcgctccgagaggctcgggctacgagcaccggtcctgcccggggtctgtggagctggttggctcgatgagggagggaggacgcctcttggagagcgctcatggatttgtgccagggtgtgtgtgtgtgtgtaaattgtgtgtctttgttgtgtgtctgggtgagggtgtccgggaaggagctgtgtgggcagaaggtgcgggagtgtatttagagatgcaagtgtgtgtgtgcgtgtgtgtgtgatggtgtggggtctgcgtgtgagtgagcgagggtctggatgggtgttagagtgtctgtgtcagttacatggagaaggtgtgtgtgtgagagtgtgagcgaatgttggggggagggtgtgaacatgtgccaccttccctgtgagggtgtgaagtgtgtgagcttgtgtcactgtgggtgtgaggtgttagggggtgggtatgtgaggtttggcgtttcacgtgtgtcccgagtgtgcaggtctctaggggtgtacgacagcggattactatttctgtgtgcacaggagatgggactgtgacactggacaagagtctgcttatgtgggatgggtgggggtgcaggtgcctgggagtcgtgggcttcatggggctgggagtgtgtgtatgcgtgccatggagcgtgtggttatcgtgtgcagggaggtatggacgcttccggggctggggagttgtgagcagctcagtgtgtgtgtgtgtgtgtgtgtgtgtgtgtcccgccgtgtggacttgctcccgggttaggctaagacagctagaaggaggttgaagccgagcgggttctccggagccagtgagaggtggctccgcagccccagggtccgcggccggcctcccacccagtgccgccgcgtagtgggtcttaaatggagctgaaccctttcgcgcagtgagcagagagccaacgtgaggctaaaagccaggagggagggaggcgggaccagcgaagagccgcaggcaccgagactacaggctccgcgtccgggatcctcctcggagcctggtgccaacctcagcctggctggagtcagagcctggctccgcctcggaggggagcgggacgcgaggtgccaaaaagtcgtctttatgatcaataaggtctcgaccccgagccccactggatgatagaggtgggcatcacctctgtcctatgccatagccttgtcccagcaggaggtgcctacctaggctctgagagtgcctgccaggaaggggtgcccccttaaaaataaccccaactccttctaccccgaagtccttggggagtgctgggtctgctgatgggagaagctgcagaatttgagcccggaaggtggtcctgacagcgaggggggaggggttggtgtaacccagaaggaatgcaaaccctgtactttgttcccctacccttggaacaagagactttcctaagtggatcaaaatgtcccccctcaactttgggaggagggctctagagggaaaggttacatgggggaggtcctcgttccagcgccgccgagagggcactggggtttgttgaaaggcactggagccctcacctggacattgcagggggcgggggttggaggctggggacctaaggtaagcacccctttccctgggaatgcgcagaacagagagacgcggcagggtgaaggagaggactgatgagaagggcttgttgggaaaccctggctccgtcaggaccccaccctgcgagctctccctggaacccgggagcagggttcttctggctgcccggctgcagagagctgacccggcatcctgacgcctcaaatccctttgcccgcctctgcgggctgcgggaggcgggggttggcgtgcctgagggtgagcgcatctgggccggtgcagccagcgcggcctcggagctccgctgctcaggatgaaggaagagcgcagacgcggatcgcgaatgggaaactttccgcgtctggggcgcagagggagatccgaggcagccgggagccctctcttctccgcagaggagagcacacgagggtggggtccctccttcctccttccaagtctgtgcccagaatggggggcggggtgcgagaagagtccgtgagagacgcaagaggcgggctgtgccggaggagggcgcccttcctggaggtggccgagagaggtgcacctggcagcggctttgcagggccacctgcctccgagggcgcagagaggagcaacccgcgccggccttcacgaacgtactggcggtcactgctcggggaggggcacggccagaacgccctcgccggttctgcccctttgggtggcagagcaagggtgcccgacgctagagagtcgggtctggcaggaggaaggaggccgctgcccctcgcactggctgggccggaagtccttgccctggctccccacttcccagaatcagaccctccaaaggagaaacccacatttctcgggactcctgggcgtgtcctggggcgttttcaactcctccagcccccgtgaaccgtgcctgggcacttctgggaagtcctgcactggagcctgtgcagtggcgccgggctggggatggaggagtggtccttagccgctgttcagccctgggaaacgttccgctgagagcagggtgggggcagccccagttaggggtagcccacggccccagccgggggtctccgggattgcgcgggcggaggtgggcggccctgcgggttctcgggttctcgggttctctgtctccgcagccgcgtgtcagcaggtggatgggatggaggggctgtctccgctaggccgccgcaaccgcaacgccgagactgcgggggctgtgcgcgcgcgagcgggtgtgacgactttatatatttatcctcccttcacacgcccccttcccactgggcggggcctctggcgcggcagggtttcttctccagccccaactgggggagttaagggccctaatcccttgcaggctgcctcgcccatgcccctccagcgtggccccgcccctagccataaactccacccctcttccaccccataaccgctctgcaaatgggagtttttcattttcgtgttttaagtgcagagaatattcgagctggagcgacctcggagatcactcacttcggtggttttgaaacttgtgtgtttttctttttcttttaagtaggaaaacccttttagaggaaacattatcaccctcctaaaatcccaataccttgagcaagatgatagatcttaaagtaaagctgccctggtggatgctggggatgaggcccacatcgagcgctccttccacacaagtctttcacaacctcaagactgctcccttcctccgcagctagtattgtagctggggttttgtttttccaatagccccgattatatggatcagctgcgatgtgtcaagcaggatgctggctgctgcttcgcagtcctcattcatgctgcaagatagatttaagaccttcttttcacagattaggaaactgaggttctgaggtttaagacttgttaatgacagaagtacaggctccttccgctccctcctagttctgccccaggctcctctttccgctgaatcttcctttcctctctctggccgcaaagaatcccttgggcagggcatgtgagtagagaaggacccaggtcatctgagtgatgcctcagatctgcctgctactctgatatttcagaacgtcagtcacagacacacttgaacttcactacactctggcaagatgggcagaggacggagtaggggaaggaggtggaggagcttaggggacttgcttagttaggtgcctggtttatagtggtgtgtgacttcaaaggcagagaccgacaaaatagaggctgtttagttctattaactgggtttcctgggatctgtagaggtatttaacctaggcagttgacagcctggcttaccaccttgcccgcctccgctatagccccaggccaccaggaattcatttattcatgcatccaacaaatgcttattgtacactatgtgccagacacggtgctgagcattgggaaaacggccctgagcttggtagaggagtcccctgcctctatggtgtttaaggctcagtgggaaattgatgcttcatttagagggaggaaggggctattatctctctctggccctaactgagctaggtgtcacgccatgtgctttatctttcttgtcttacagaatccttacaagcaccctgagaagtaaaatgaagtccattttgtagatgaggaaactgaggctcagagaggctaggtgactttgccaaggctgcagagtcattgaatggcaagcaggaattcagatacagggccctctgactccctggcctgtgcttcctccctccatgctctgctgtctcctggtgatcatttcctgagccccagccacatggatgtgtccagtctcctgtctggatgcctgactccttcccaaacccacactgaaatagaatcatccagggtgttcatctgcacagatgggagagggagtgtccctgaaagctattgccatcaccaagagaatgaataggcatctgctgtgggcagggcacatgtgaaaagagcaaggcctatgagtgtgatcctcatcccagggcagcgagagactgggcatgtttccgaaaagatgaacgacaatctattttgtccatcctccctctccacctcctttcctcccccatccactcctgttcccttcctctcttttttctttttgccttcttttttctttttaaataaaaggaggttcaggatcttttgtaagtggaggaactgggagtttcaaaaccaggtctgaagcaatccagagacagctgctttttcatcactggaaagggagtacagcagcccttactacttgtaggaggctgcaaagctgttcatttcaaatgataaatgtcagtggtggtaaaacacatgagatcacttcctaggaggtgtccttctttaggatgaaattccagggaagattggggtggtgagatcctggaacccacctttatgctacagtgagctccaggagtggagggggctcatgttcactaagacccccggctaagattccatggatggagcaataaaggtagtgtgtatggggctggagatgcaggccctgttcagtcacctctgcagcccaaaagagcaggagagacaggtcgtgggcagggtgtggcttgggggtggggtttttctgagacccagactttagtcccctcccaggaaaggaatctggtgtttggtttttccaccagcctttgttacatcttctggccacatactaaatttgctttgggaaatcacaccaaccccgcaccccacccccaccccacccaacacataaattgcatgacatcttggtgggtgaaactactgggtaaggcatccccaagatgggccctggaatctgaatattgagcggagtgtcacaaagactgagagacactagaatgtcccccttgcccctgggacccccaggaaaccgtcctttgttggtttcctgagactgataatgatgggacctatctcccagtgtactgagagggtggaatcaggcattacaagcagagctcttagctcagtcccgtgggctctgatgcttgttactagtgttaaccatggtaacgatgagtacccgctgaagcagccccagtccttgcgttactcgactttttcgtagtgttctcattggttacattttttggcttgagagtctagtgtcaatttctgctgcttgcaaggaaaggatcccatgtgataacctctctaggtgtgatgaccagtgccagccttggagttgccagtcagtgcactcttggtaatgcacagaggatggttcatggccctctggctgggggtgaccaatcccaccgcctgccctctgtctttccctggagtcttgaggcccattgagtgcagtgtgagactcaagttgttccccgctagtaaaatgtacagatggaggccaatcttatagtgaacttccaatcccctgacccactagaccctgctccacccaggcagggaccccatctggttctgttcactgttgagtcctccacaaaacacatagcaggtgctcagtcaggttgtttgtttgggtgattaggctacctctggccttgcgacatgtgcaacctggttttgaaaaagactgagcatgtggctttctatttctatggaaaattgtgtgaaaaggcttatagcatgtggaattgaggctggacttgcaggtggacttcctggcagcaaagatgttctgatcctggaactacattctttctttctgcagtttctcagataaagtagcagaggccctgactagatatcttaactctctacctgctggcagtacttgaaaatgcacaaaacacttccacgcccattattccatttagacctcacatcacacagggagacagctagtcttgtacctgttgaacagatgagggaaaatgaggcccaggaagatgaaaggatggcagtaggcagtggctggactggaacccagattctgtggttgcgagctcagccttcctcccatcctcaacccattgctggacttcatttagccacaggggtctggcatgagacaggtcagtttcccatgtgcttacaggccagtaagctttgacctcaagtgtgcactgtgagctgtgtgctgctgtagccactttgctgctgtgacttcctctatcctccactgctgtccaggtgggtgttatatccccagtccacaggtgaggacactgacatgcccagggtcacacagcttgagacaagagctcactgtctcccctgtctccacagtcttgtcctgctcagagatttctggccttagcttctccatcctccacctcctcccccacttccgccctttcttggctcagagagcagacatctgccctcagctagcacagtccctggctccccataaggctttctccaagtttctgctcacccacatcctccctccacagccccccaccacacacacacagactcaggtgtgccctaagcatgttggcagcagtacttttggcaacactttgaaagcagccctccttggggctggagatcgttggggatagtctccctcctgaacagagctattgagggtgagcatctctgcaccctcggccctggcaccaggcctggctctgagcacatagatcctgaagatgtgtttgttgaatgaatgaatgatgtctcccctgagcctgaggtttggttcaaacaccagacccaggcttgtttcctggccctgctcagttgcctctggaagtcctttctggtgtgagaatgtgtccattgtccttctccattccatggaccacagtggcatcacagctggcatctggaggaagggccaacactgcaaggtgatgggaagaccaaggggacttcgtgtcccctctatgttctccttggagaggggactgtcctagatgggtgatggggatttgggaaggtaaagaaagaaggaaggagggaggaaaggaaggaaaaaggttgagaagggagggaggaagacaggaaggaaggaaggaaggaaggaagaaagaaagaaagaaagaaagaaagaaagaaagaaagaaagaaagaaagaaagaaagaaggagagggagggagggagggagggaggagcaagcattcaccgagcagctactatgtgccaaaccctgtgccagacatgttcacacataacatcatactcaactatcccagaaatgcctgtttgggagataatattctccccctttacagatgagtaaagaggcttggagagattgtgtgacttgcctgagtgaggggcagagccagattcacacccaggcattgatttgcacatctcttcccaaatctgagtttctcccattggtagcttgaaatagaccattactggagtattcacacaatggaaatcggcaaactatacattggggcctccctcacccgagaattggttgttacacacttgccagcacatccctgggtatgcccatccttcctaatccctccctgtctctgtggggcagccacctgcggttaatgtgctttggtttccatctgcaatgggctcctgttgtccaccacttcctaacaaagtatccttgggcaagacactcgctgtctgagtcatagtttccctgtcttttaaaaatggagggtgagtgagatacagcaataacacatgagagcttttggcatgtaactggcctctcccttcctcctgatggggccagcaggccatggagactctgaggagagtggggtcactgtttcttctccctctgctggagctgctttgggcgagaagtccacgatccagtcacttccattaattaagcagctgccccaggcctgattctggactgacagagacctctcggggagtttcaggttgtgggcaatcccacattcattgagaacaattaaaaatcacatgtaatcaaatggccaatacagggcttgaaccaagcttatgtctttggggattaaagggagtggcccaggaaggctctgaaggattgaaacaatcttgccaggtcaggagtggtttccaggcaggagaaacagcacatgcaaagggctggggaagagaggggaatgccatctgggcaagtgagggttggagctatgaggctcctggccttgcttaagtgcaggtcctggttgagaagctggggaggaggatggaggagttggcagagacctgcctgctaggaaagcggtctggatttgagcccatgggctgaggggaatggtttaaaagagtggagtggcattcccagagcagggctctaggaagattaatttggcttttctgggccacctgaagctggaagctcttttgaacctccactgggttataaatggttgctctgggttgcccaaagaaacgatggactccagaaagaaatgccatcgtttggagatggcccacttctcccagcacatcctgacccagtgaggagggaaagccaggcccttgcccaggccctaccaagattgcacagccttgaatgagactgccccagcctgagtgtgtaccttgggcttgacccaagagtgaagggaggaggagcgcggtcctggggagaagcttctagatctccaatgggcatgggctttgtagtctaaccagctttcagattccacctccaccacttgtccaatttgtggactcaagtaacctcttcattattttacccttggtttcttcaaccgcacttgtcactcttcatggtggcctcgtctggtgggggctgctgggaagcgtgaatggataataccaggaggccatatgcacagtggctagcatacagcaggtgtttgaaaagtggttgctcccttgatgatgtttggctccccaccatgtggtaggagcaccctccaggtttgaagggaaagaagtgtttataacccttgattcccaggaggagaggatgcatggcaggtttccccatgtggatcactggaagaacctttgggtttggaattacagagcatctgagccagaagggagctgggaaattatctgcactgtctcctctctccccattttacagacaagaaaactgagcccagagagaggaatgagtccttctttgttgcatgcactgagcatgatgtggggggcaggtcttctccttcaatgtcagggacctgtcccagggcttggccaggtggacccaccacctgaagagcctggcatggggaagcctctgggtcccctgaaattgggtggggaccttggcagcacttcagtagggagcaacccccagcctcctacatcacaggacagcttgggagtcgccacggagagaagcagctgagcctttggggtttttttttgttcctttgccaagctgttccctttgcccttttgtttctctttctacagaggcgctcagcgctcctctgatgggcttgtttgtcaccagtcgttggtgcttcctttatctccccagcaccatctcttcctccttttttccctaacgccgccccaaaggaaggcgttcatcacaggctgccctggcatcattctgggctgggctgggctgggggaggggcagcacaagcgtccgatacactggcagaggctggggcagctggagggtgggtagctgtggcatcttgagctggtgctcaccgcccgagtgctctggttttgtcgagtgggtattcagaccatacaacagccaagagctgaaggaaggccaggtgtctggttctacagaagcaggtgatgagttgctaattgttacccagcacctaatgtcccaggcaggggcggaaggagtgaggtggggggcggcaaaggcagtcaccccacaaagacttctttgtttccgtctgcagcagagaagtgggtctgatctcagcttggaagggaagaggcatcagaaggccaattcctagggcctgttgcctggctggggagcttttgggaaggtggggggaagaaggacaagttaccccatggagagcatgggggttacctcatggggaagagttagtcattcccaggccagtctggcttgcagaaagcaacttcttgtttcaggaagcaatatagtctcttcctccctccctcccttctttctttccttccctccctccctccctcccttcctttcttccttctttccttctttccttgtctgattgaggaactgaattttgttgaaatcagctaaatagaagctaagacaccttacttagttttcatttaaacatcagtagtcacacatggctatgtattgattggaacagtgcagctctagactgtaagccctaggagggcaagaacttacctattcccttctttccttcctcccttcctcccttcttcccttccctccttccttccttctctggctcttgttcatttatgcagcagatatttattggatgtttcctgggggtcaggcactgtgttgggttctagaaatccagaggagggcaaataggcaagttcttgccccactggggcttacagtctagggctacgctgtttcaataagtggccatgtgtgactactgacatttaaattaaaactaagcaagttttctcagcttccatttagctgaattctacacattcagttcctcaatcacctgagtcacattttaagtgctcaacagtgattggcggctagtgatgacggtattggacagtgcacttccaaaagctctactggacagcactggtctaggacaatgttcctctttgggtgtggcatgcccactgacaggaagaaagtaacaaggaatcatagcaagggggtggctttctcttttcctttctcagattgtccttctggctgtgccaaggagaaggtctcaggctgatgccctcaagctttaatgcccctctatcacatgctgatttctttccaacataaagataataggtctggggcaacaagcctccagcgagccagagggggcaaggcttttaataacggtgtttttttttttttcattgtaattatttttcagtcactctctgtttaaggcaactggtaccaatttgccatttggggcagtgatttaaattctccctcttttaaaaaaatggctttatttaagtaaaaaatgagtcaagttaaaaatgttaagtacatagtggagcaggtggcatgcagatatggccaatctgtgaaggtggtggatgtgaatgtctgcagttagaaacctcggttcagatggaaccacatgggcttctggaggcaccaccatttctatgttctgtgatccggggaacaagttacttcagtccttatcaatcaggttctggcaggaaacggcaggctcagcctggagcgtctgaggaggacttgttcaagggactatttgcataggatttctggaaaaccgcaggggatggtgcagccccttggagctagaagagtggggcactttctacctatagcttggaggagtagatgtaaccagaaagcaggctgggctgtgccaagaggactgccagacagccaggcggccctgtgtagaggactgcagccaactcttgggggcctggcaggaagctggagggagaaataccccaactttaccctcttcctgcctttgggtcccttgatggtgccacccattgatcaaaccctattgaaagcccatacagatcagcctccaaagtgcagagctggtagaaagggaagagaacgagctggggtccaagtagcagagatccagcacaattctgctaagcctcagtttctccatttatgaaatgctctacgatgctcattgtacctgacagggttgtggcgatggtgcaatgagacaacatatgtatagctaatgattggtagctatttatatttataacaacagcagcaaaacggtgcctactctgcagtcccaggctccatggtagatttttcctgagctaggaagtagcatatgagaatggggttttagggtacaaggtggaactggcttttcggcagcatgtgaatttgaaggggcagacaacattggaggcaaattgcagcttgcaaagcggaagcactagcgctctccacaggctggtattgacctttgcagtgtgtccttcctactctggtctcttcgacatctccacatctcccctgtgccctagtccatctcactgattgattacttcaccccagggcttacctattcgtcattccccagtctattttccaccctatttcacacggagacgttctttctccttagatccatttaggtcatctttccaccatccccactggctcctatcatgtgcagcctggtccacatcagttatgaagaggctcaaagctgtctccttccaaatggaaggcaggtactctccaagcctcagctactcctgccagaggctactttcacccttgcagatgggggaagggaagatactcttgagtaacttagcactttggaccactggatctttatccttcatctgaaagctggaagtgccattgccacttttagagggacctaaaggagtagctggagctcagggagtagctggcttctacgtggagataaatattcctcaggaaaacttccaccggcagtcctcttagctcccagctactaagttggctgaggtggcttttctcacgatcctctatttccctttgtccagccccttttctcatctacctgactgttgaaattgactttgatgaggactaattttgtccgttgaaattcatgagacgcttacccatttggtgctttgctgaaattgccgtgacaaataccagtggcaatttcttccctggctcattctctaaagtactctgggcaagacagagtgcacctgccctcgccgacatgccatctgtcggatctgccatcctccaccagccctgctgttggccctgccccgatgcaggtccatctcagccattcctacgtgctcagtggtgtgtgaccctttaggaggagatgggttgcctaagggggacaaatatgccttagggggaaaaatttcacccacacccccattggctctcaatgtccaagttggctgaggtgatattcctttacccagcccctgttccatgtacccgactgtccaaattgcctttgatgaggactcattttccagttgaataaggggacacgttctgtaggccagtcctccatcacaggcaggtgcaccacttctgtctccttgagccaggtcctgggtcaccaggatggctttggtcacccatgagtctcatttgcctgggcggtaggggtactgccttatggcttgtgagctccgaatccctccctggtctgagcctggacacactgcagagattgccaaagaaacctcagtcaccctcttcacgacttttgtcatgtctatgtctcatctgtgcttttttcttttcttttttctttctttctttcttttttttttttttttttttttttgagatagagtctcattctgttgcccaggctggaatgcagtggtgcaatctcggctcactgcaacctccgcccccagggttctcatgcctcagcctcacgagtagctgggattacaggtgcatgccaccatacccggctaatttttgtatttttcatagagacagggttttgccatgttggccaggctggtttcaaactcctgacctcaagtgatcttcctgcctcggcctcccaaagtgctgggattataggcgtgagccaccacgccaagccaccccaactgtactattttttacaccatcattttcttaaaatcaaatttcaataatggacttcttcttttttggcttgtctggttccagggaataatgtatgggtttgttgtattgactgtcgattttttttctttttttttttttttgagatggagtctcgctctgtcacccaggctggagtgcagtggcacggtctcggctcactacaacctctgcctcctgggtttaagcaattctcctgcttcagcctcccgagtagctggcactacaggtgcatgccaccacgccccagctaattttttttctgtatttttagtagaaatggggtttcaccatgttgcctaggctggttttgaactcctgagctcaggcaatctgcccgccttggcctcccaaagtgctaggattacaggcatgagccaccgcacccagccagattttttattaattcatattaagataaatatgtgagtatttgaaatttttgagaagcttctctcataccatcttagcatcagcctgtcagctgctttggaaaataccagtttggtaggaagggcaccagcctagcagttttggaccctaggatctgattttaacttctccattaatttgctgtgtgactatcccactctcccgggtccgtaaaatgaaagggtgagtccggatgatcccattctaagattattcgatgggcaataggatttagaaggaacaccccacctatgctcaaaatattttttaaagactaatttgatgccttcccagcttcctgcctctaggatgaagcatctgcctctagagaaccctggcaaagaatagctgtgccagtgacaagggatgctccatttcctgggagcataggacagagccttattccagctccagtcagcagccctgcaccaagcatctgctctggctcgggccttctactagggctggggctccagagacaaataagacccagtgcctgtcctcaaggaattcatagtctcttggggctgataggcaggcaaacaaataaatcatggcataatattggaaattctaaggttgacataggtaccaagtcctagggagagtgcagaaaagggaatgcttaatctgcttgaggtgtggaggagagtcacagatcactagaaggggtgatgcatgactgggtcttgaaggatgcataggagtttgccaagtaaagaagggagtggagggatctgagcaggatacaacagcaaggataaaggcctataggctggaaagggcctggggcacgtgggagagtcgggaggcaggggtgaaggatgtgtattgcaggtaagaagtgaggctggaggggacacaggggacagatgaagtgcatttgctggaggtaagccagtcctgcaattagacaaattccctagctgtaggccccctggcccactggcattcacggaggcctggactctgctggccccaccctgggaagcatgaagcccccctttcccactgaaaatgccactggtgctgtttgccccatgcagacaggaagagcactccagagggacagggcttcagagcaagaagcagaggttggtcttttgacaaggtgctgcctccttctaacccaggccctgcagctgcgacagccacactagttataaagcagcccctctcggctatatggatccagagaaacattgaagccaaaataggggtgtggccaggtccaggctctcttcttcctggacctcctcgtcctcacctgcaaagtgataacagtagcaaatgcttattgaacacttgctgtaccccaagcactgtgacaagctcctgcttgtattacctcactcctaaaatctttgcaaccgctcaggaggtgcatgccactagtatcctcattttacaggagaaagaactagtgcagagaggttaagccaccggctaaggggttgcgcagcttgtaagtggccatgctgagttttgaacccatttggcctgcttcctgtactctctgccttcttgcttctctgcagaaatcccttccaacttgaccttctgtgattctgaggctgcttggacttcccatcctgaccttatgtggctcttcgtgtctcaggggctccagctacagctggaggtggccccggaccccgtggctgggctgctgtggaaggtcacagggctgcccttccctgcctcggcagtcactggatggcagcttggctctgctgtgttgtctctggcctcgttattattattacttctttccagcatgctgctaaaagcttcccgcagacaacacacaatccagctctttaaaatttaaagggctttacttaaacaatgttatttccctcggaaaggagacagaagaggcatatgcgatagttatatttagtgcggcgtgtgggtctgagcagatgagtgtggtgtttggtgggtgtgcaagtgaccagggagatgtcatccatggtgatggggccagggcaaaggcactcgaggggaagatgtgccgccagcatcccctccctctccttccccagaaagtgtggcctcagagagaaactactgtgcaacgttctgggaagaagaggaggatggttgccatctgagggactcactggagagacataaaactggacaggaggccctgtccccctgccacacaggctctcagcactgaagacacagcactcccagctgccccagggcctttgcacatgtggttcgaactctgcgggaacccaccttcttctttggactatatcttcttcatgattcaggtctcatctgggacatcacttcattcattcaacatgtattttctgtgtacctactatgttcacaacaccatggggcacaaagaccagttgtgactcctcttcatgtcccctgagtctggcacaggtcctggtgcagggcaggtatcagtacatgtttaggaaattaccaaggcctgtgtggatgctctggggtctggaggacagatacggctacctcgttggaaatttacagcagagacatcaagaactctgaatgaactgattaaagctggcagagccatacctgctcagggaaggaagggagagttcacttcctttctcctttagtgcatctattgattcattcatttattcattcaactcatgtttattggacccctgctatgttccagatagtgtgctgggcactggcgatacagtggtgaataggccaaagataaaaccttccctctgggagcttaccttctagagtgtgtgaccagccagctaacacatacgtgaacagataacgtaaggaagtagtaactgctatgaagaagactaagacccagaagagtaatggtgaagtgtgggggttcaggattgggcaggggccctattgatggaatatctatgttccagaccctgcgcaggccttggggctgccaagaagtcaagaaaggtaatcaacaactacaggaaatgttcaggaaaaaggaggaagccaggataacccagttagtagtgaccaggggaggcttgctatcagggaggacttcggtgaggttctgagagctgagtggggccttgaaggatgggaggccataggcaggacttagcagccggcctttggttttcaaactgtgctcctttgaaccccaacttcccatagaggtgccccaggggaccactttgggaggcgagaatgtggctcaagatgatggttgagggggttctcgtgccccaatcaagctgagagctcgctcgctttggctctttcacagatggggcttcagttccagcttcactttgaatgaaaataaaatagccaagaaaaggaatttgaaaatgagtgggctggatgatggggaggaagtgcaggccatctgggctgggggaggttctggagattttctgcttggttccaccctcctttcctccacatgtggggaaactgaggattagagaggcctttgggttgtcccaggtcatcagcaggagggggccagatctgggataaatgcctctgacttctgcctctttccaagctgggagggaggcctgtgagaaagcccaccttgactctgaccctggacccgaggctcacagctgctgttggggatcctgactgcggcagtgcccccctacttgtggctcctccaccccaagcccagctgcaggacaccccttctgaacctctcctctgccagcccaactggcctgccccaccctcatgggagccctgaattaaacgaaatattttatgatcccatgcttcgttatgttttattaaaagagctggtgctggcttccgctggcacagctgctgggcccagtcctgaggcttcctccccccacaccccctccagagccgacagctgccacccatcctccacccctaccaccaggaacagccagggtgtcaggtgctgatgagatgaagggaaatcctgcaggtggggacagattggggaatttggaatgataatcctgcctggtgttcacacatcccattagatgcccctcaccctgcatttctgaccctccccacgtaccccatgcaaatacaagcccaggctgttgtcccttcccaggctgctcatgttccatctaccagtgaccacatggaactccttgctctcagctaagtcactggctagatgggtcatcttgaacagagcacatgaccacactgagcctcagtttcttatctgcaaaatgggagttggccaggtcaggcaagggctttggcctcatgggctgacattctggtggatgagagaggaatgaacatacagatacataacctacctctggctgtggagctatgtgaggggagtacagcagggctgtgggatagtgagggactcgggagcagagcagcttctctagattgggtggtcaaggaaggcttcttggaggaggtgccctatgacctgtcagtttcaatatggaagtcatgaggaaagagtcctggcatctagatatttctggtggagaagcagtcctcctccggacagtgctgtgtggtatcagggccacgtggagaacttagggtggggcctacttaggtctgaatgagagctgagccacctgctagatgggtcatcttggacagggcacgtgaccgctttaagtctcagtttttcatctgcaaaatgggggttggctgggcactgtggctcttgcccataatcccagcactttgggaggccaaggtgggcagattgcttgaacccaggagttcaagaccagcctgggaaacatggtgaaacctcatctctaccaaacaaataaagaataaaattagccgggcatggtggcacactcctgtagtcccagctactcgggaggctgaagtgggaggatcacttgaacccgggaagtcgaggttatagtgagccataattatgccactgcactccagcctgggtgacgtagcaagacactgtcttctaaaaacaaatgggggtgaagctgaacatctttgcccaaagcatctgacatccataactatttaattcacggtgggctccctcactaaaggagagagggcatttaatcaggtcttcattcaagggaagagattagtgatactcttggatattattattattgttgttagctaatactaatggataacttactactcgtttatccaatatttattggtctcctactgtgtgcctgggaggtggttctgaacaggaggcaagagctttggctgcatgggctgacattctggtggatgagacaagaataaacatatggataaataacctacttctggctgtgaacctctgtgaggggagtaaagcagggctgtgggattgtgagggactcaggagcagagcagcttctctagattgggtggtcaaggaaggcttctgggaggaggtgccttatgagatgagtagggaagaaaatagcaggaaaagtctggctcagccctggtgttggcgtctcctggccagggcgtatgtttgtagctgattccttccctggatggggccttctctggactctgaccccattgctgggaatctgtcactggtaattccctcccaccagtgatgcaagctcagctggcccatgacagtgtcccctttggccctggggagacccgaggaaagagcattccaggccccagggaagcaattctagacctgttcttatttaattcttgcagaactccacgtggtgggccctactgtattctccatttgcagatgaggagactgagactcagagatgaaactcccctagtgggtttgtggaggagctgggatttgactccatcactactgagttagccactgtctcttgctcattcgctgtgtgtgtgtgtgtgtgtgtgtgtatgtctctgtgtcacatgggaggatgatggagggaaaaagcccacccctcacctccttttatttcaccttgaaccccaggatacctctggacagggttggagcctccagcgcttgggtgagtgggctgagtggcctggagcccacagagtattgatggctctcaaagctggcaggcattgggaggcagaaaggtattaattagcagttattccccagcagtggggagatggatagagattaaggtggcggtccgtgcatccgttttgtagcagctgaggagcaacagtaagtcagtgctatgaatcgatactgtaagagggagatacgttttaatcttattagcagtatagcgttatggggagagaggcaggagaattcctcactcaaggtgcctgggtcaggaaaaggggagagagagtaaccggggcttggaccatctgggagggcaccaggatggcaaattttactcaggttgggaaaaggcaacgggcagggaaatgagaggtgggagaggaggtgagaggcaggaaaggagtgctgggtcagcagagggggacccttccagtcttcccaagggtgtctgtcatggatgcagttctctcatgtgccccctctagctcctccccatgaataagggctctgagttggacattggttcaaccacgccacctcgatgagcctctgactctggcactggcccttctgaggttattggcctggccatgccacccacgggcaagactcagaggctgagaaggggtcagtgggtggaggcatacaggccagcactgtggggctggtgaggagggagccatcatggaaagcagcctcagcaggtgcagtctcgtatcgacccagcaacccctcatggtaggcatcttgtccccatgcacagaggatatgttgtgatttgaatgtctgtctcctccaaaactcatgttgaaatttaattgccattgtagcagtattaaaaggtgggactgttaagaggtgattaggtcacgcgggctccacactcatgggtcggattggtgctgttatcaatgggtgagtctggcccctcttgcccttccgcgcgccttccaacatgggatgacacagcaagaggggcctcgtcagatgccagcctctccatctttccagcctccagaaccatgggccaatacctttctgttcattataaattacccatgttgtgatattttgttaaagcagcacaaaacaggctaagacagaggggcagaggtgcaggaggtaaacagacttgctgagtatgggcggcaccaggacttggtcctacctctgagtgacaaaagcccagtgtccttctgctctaagcactggacaccaccccccaaccccatcccacaaaagccgtgggaaaccctgtgaccctgtgaggtctggcctttgagtgtgacaaggggcttagaagtgagacaccctcttcttctctttctcccttgctttagttcaactcttcacaccaggatgagaagttcctgtgggaagaagactgggaggaagagaaaagacagaaacggagcagtcaggatgaaccatgagcacctaccattctgttccacccagggcaaggggctggctctctctgggcctcgttttccttaccagacctctgagggctcttctagctagaacattctctgattctgtgtctctctcttcttaaaccatcagttgtccactgtatcatgtaatcctctcagtagcccctgtgacataaacatcattagccccattttcaggataggtaaactgaggaactcagaaagggttagtaactcacccaaggttacacagctagtgagtgtcagagcccggattcaaatccagatcagctggctctcaggagctcagaactcttcattacacagcacacctccttgtctgaatatcaggacatttgtggagaaaaaaaatgttacctgagaaaaaagatgactccagaccgcttgtggagagcagcagccctcctacaggtgtgcaatggaccctcctgccactcagccacctcagaatctgtccatgtccggctgtccctgttggcccccctgctctgatggctgagccagccctggagaatacagctctcacagcctgtatgggggacctgagtgcccctcagctctgacagcctcgggccggctgatggagatgtctttgaggtccgcctaggcggctgaggacagagccaggcccgagggagctgcatgtcttgacctcctcatttcctctatccagggaggagagaatggagctccccgtggattgagaaaaacccctccagaaagatggccactgctagaggaaaggggtccagctgaggcttcctgtccctgcttggggaggggcatacctgaggcagatttttgtttttttcttcacgtgtctcagaagcagaaaccacactggtagctcagacataaactcccaaccctagcttctgaacccagaggttgatgaagacatcgcttttccatcccagactgattttctcatctatacctccagctaggagcacactgtcatataaagtgaacggatgaaggatgtgggaggcagtttcaaatcctggcccaccgcctacaagctgtgtgatgctgggcaagttacttcacatctctgatgttatgacaattaattgctacatgtaattgttaagaatcaaatgacatgattttatctctttgttcacttacagaaaggtgtgttataaaatttaattatattagccatggtaacacttgttgctataacaaacccccaaatttcactggcacaagctcgatagaagtttatttttagctcacatcacagttcactgaaggtatctctgtaggcgggtggttttcctccatgtgctgactcagggatccaggcctccttctgtcttgtggctctgccatcttctggggcacatagtcctttccaggcagtggaagaggaaaggtagaggactgtcttctacttcttataagcctggaagtggcacatgccttctccttatggttcatatacaaaggtcactggccacacttgcatacaggagagactgggaaatgtatcaaggtggtaggggtgggggttgaggggtggtttgccttccagagacaactctgtataatgctgaggaggagagatatgaatttttggtagccagctgctatctctactttaataaatacctcatttacttgcctgctttaccccttctgtgaaatccatgaagacagtgtttctgtttgtcttattgatcctggcttattaatttctgtaaccctagcacctaacactgtgctggacacagaatatgtttatccaatatctggatgaatggatggatggatggatggatggatggatggatggaatgatagtaaaccaaaccacactgacctatgacctatgacctatgacctatgacaaacacactgacctatgacaaggtcatatctatgacccatagatttgacccatagatttcccctggatttatggtcagccctgtgggcatagggccctgcctgactcattgactgtcagattcccatcactgagcatggtgcatggcaaaaggcagcttttcagtgtttgttgaatggaagccttagagaagacctttggaaaggtcagtattagaatctgggctcagcctcagcagccccagcctgtaggcagagggatggccaagatggctgagatatgagctaattcccacactgcaaaatgaccgcagagatttaccccatgattgcgttctgggtcctggccacctcttgggctgtcaggcaaggagggagggaagccccttttcttctccctggcaaagactgagagttgaaacctcacttccaggggccccacccaatccatcctgtgctcatgggtcccttggtgggcaagggggtgggggaccgctgctgggtttaacagggtctgcaaacttccccatgatgcccttaaaaggtgtcctgccatcccttaagcatctggcaagcctcctagcatctccctgttttcttgtactgggcggggtctggcctgtggggcagaaacagaggctctgagcaggtggagggagtgggggagggaggggacggagacagggttgagtgtcttcctttcttcttgccagaccagtgagaatttggctttaaatttttaacctaaatagagttatattcattctctctccctctagatgcaaagcacttttttggagcaattaaggaaaagcataaatcagtccggttttaaaagctcaggctgactttgtggattgctaaaattagcgtctccataaaggaagagggagggggaagggaaagctggatttggcttcaagatacccatgcactgaggctgggggtgaagccaggcctctggccccagccccaaccttcctgaggcccccagagcatgtgagccagggctccggttccatctcgcctctgctgagcagcggagcctttctggtctaacccccatgtcacggcttccctgattccaatttggcggaagacagtgggtttgcagagtggctgggtctgcactcggcttcactacacagccgctgtgtggccctggacaagtcgcttcacctctctgggcgcccccgcttctccatctgacaaatgcggctgtaatttacccttcatggcattgtccagtgggatcatctgagcaaatgtgctttgtaaatggacaggtgctccatgctgccgctttcaggtaatctacagcctcctccacctgactgcactgccagcccccttgcaccaccatctccttcagatcttcccctaccaacagtctgccccatggcacggagctcagaatacaaagtaaccactttcctcccgtgacccctgcctcggtttataatgacacgtcctcaggccaaatccttcactattggacaactgccgatccccgttatggggctggaagcctccggtggggggctttgttggcttggtcactgcaggcacgttgtaggggctcgtgaatatttacttgtggatgaataaattcatgatgaccacacgggtcagtgacttcactcctcagctttctaagcataaaatgagaataataagaatatttactttgcaggggagaataaaatgagctaaatcccttatttaagagatctttatcaagttttgataatgtgccaggctttggagacagcagtgagcagcatggggaggttctataccttcaggtagctacaaactagaggaaggtaatgtgtgttttagcacctaggagagtggcttaccagttactcttagtagaaccatgagtgagtgagtgagtgaataaatgaatgaataaaaggaaaaccatcttctgtggccccccttaaccctcctctgtggccttcccattacctggggagctggcatttttgctgtttagaggtctgattctgctgtcaccctctctgaattttccccttctgtaaggggggcagagaggctgtcatctcaaaccccatttgagctgccagagatgttctgattccttgtggacatggcctcagaagcttctgaggcagaaatcctataaccagccctttcctcctctggttcttctctgtgaccagctttgatgccagctcatctccctgggggagggttaattactcgcaggcactatccgctcatctcccaggcctcttatctgagacataagcatttaggcaaacacattaggccagagcagggcagagcctttggacaaacatctctgggcttttcctgggctgtggatgcacatgggcattggcctggcctcctcagtgcccacccccctcttccccaccacagcacccaccacaaagacctgtccagcccacaccttcagggtggacctcacaggtactgaaaaaccccagcacccaagcccaggtcctctgccccagggtccatgggcagtgagagtccactgtggctggctcctccccgactcaacctgctcagaccggggcctcagtcagttacagtgagacagagaaatcctacatagggttccacagccatgcctgggagattagaggattctctgtgatttagattgagcaacagatttttctggaggaaaagggctgctactgagcatatgctcactccaggccctgggctttgagcttccacgcacatcagcccacgccatcctcctgtcagcttagtgagctggggtattgagctcctgttacagatgaggaccccaaaccccaaacgtgaaatggcttccttcaggaagctggggagagaaaatcacattgactgggtgtttcctggggcaggctctgcccaagatgcctcactgacctgttgtattagacagttcttacattgctataaagaaacacctgagactgggtaatttatttatttatgtacttgttttatttatttatttatttttattattatactttaagttttagggtacatgtgcacaacatgcaggttagttacatatgtatacaggggccatgctggtgcgctgcacccactaacttgtcatttagcattaggtatatctcctaatgctatccctcccccctcccccaaccccacaacagtccccagtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggatgtgaactcatcattttttatggctgcatagtattccatggtgtatatgtgccacattttcttaatccagtctatcattgttggacatttgggttggttccaagtctttgctattgtgaatagtgccgcaataaatatacgtgtgcatatgtctttatagcagcatgatttataatcctttgggtatatacccagtaatgggatggctgggtcaaatggcatttctagttctagatccctgaggaatcaccacaccgacttccacaatggttgaacttgtttacagtcccaccagcagtgtaaaagtgttcctatttctccacatcctctccagcacctgttgtttcctgactttttaatgatggccattctgactggtgtgagatggtatctcattgtggttttgatttgcatttctctgatggccagtgatgatgagcattttttcatgtgttttttggctgcataaatgtcttcttttgaggaatgtctgttcatatccttcacccactttttgatggggttgtttttttcttgtaaatttgtttgagctcattgtagattctggacattagccctttgtcagatgagtaggttgcaaaaattttctcccattctgtagattgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctgacatgtaagtctttaatccatcttgaattaattgttgtataaagtgtaaggaagggatccagtttcagctttcaacatatggctagccagttttcccagcaccatttattaaatagggaatcctttccccatttcttctttttgtcaggtttgtcaaagatcagatagttgtagatatgcagcattatttctgagggctctgttctgttccattggtctatatctcttttggtaccagtaccatgctgttttggtaactgtagccttgtagtatagtttgaagtcaggtagtgtgatgcctccagctttgttcttttggcttaggattgacttggcgatgcgggctcttttttggttccatatgaactttaaagtagtattttccaattctgtgaagaaagtcattggtagcttgatggggatggcattgaatctataaattacctcgggcagtatggccattttcacgatattgatttttcctacccatgagcatggaatgttcttccatttgtttgtatcctctttaatttcactgagcagtggtttgtagttctccttgaagaggtccttcacatcccttgtaagttggattcctaggtattttattctctttgaagcaattgagactgggtaatttataagaaaagaggtttaattggctcgtggttctgcgggctgtacaggaagcatagcactggcatctgtttctagggaggcctctagaagcttccaatcatggtggaaagtgaagggggagcaggtgcattgcatggccagagcaggagcaagagagcaaggtggggaggtggtgcacacttttcaatgaccagatcacacaagaactcactcactatgcaaaaatagtaccaacttgggatggtgttaaatcattcatgagaaatctgtcccatgatccaatcaccttccaccagaccccacctccaacactggggattgcatttcaataggagatttaggtggggacacacatccacctgatccccctgatccccctatatcacctgtcttccttaatgctcaccccaccctaagagattggagccactgttattcttgtttcacagatggggaaactgaggctctgagacatgcagtcacttgcccaagatcccgtggctggtgagaggcagcaccatatttcatagctgggcgtgggaaactccaaagtccctcctttgtacagtgcaggacaaagcccactgaggaaagccactttggggggatggagacatagagaaagttcataactctaatatatttgcatggatttctaccacatatgaaggattttcatgtgtttatcatctggtgatcctaccacaaccctttgtggtaagcaagataggtatttatttaacaaatatttatgtagtgcttactgtgcgctgagaagtcttctaagcgcttataaatattaatgtgtgtaatctgcattaaaaactccatgagttagattctattattttctccattttataaatggagaaaactgaggcacagagaggttatgtagctgactcaaggccacacagcaagggagtagcagagctgggattctgtttccagcagatctgacctggcgatagaagccagggccatcttctttctctccctgtctttggcccaccgtgtccccagcaacaggacacatgatccatgctggggacacatgcagctgccccagggttgggctgaagataatgggttcgtaagtgacaggtgggctgagctgggattaacagagccagagacagtttgctctggagccccaagcatgggctacagaaccagtgagctttaagatccttatctcatcgaggaaatataataatccctcgcaggacatgtggcctcactttcttcatttccacagctttgtccagctgtttatctcaatccatccttacgatggcctgagaagtaagcagggaccagtggggtgttgcttgatcacttgcttctttggggtctagcacgggggaccgtattcctactactgctactgttattgcttgcttttggggttcccttcaaagcagagccagagagaaggatttggatgcaggggtttattttgggaatgaccccaggaggtagcagcaggagggatgtgggctgggaaaagaaaagcaactgatgcggttttcacttttgctctctcagtgagggaaccgctgacaggcagtgtgggacatactctgaatcacctggcaaggggcgaggaagctggggtactgatcctctaacccccacctctcagtgacctgccccacacatgggccaagtgctctcacagcagacttcttttaggtaaagaagtgcaagatgccagcttggcatctgctccctcgccaccaccattaactgagcacttactatgagccaggatgcccgctaaggcccttccctgaattagctaaatgtcttgtcaatggacattattgtcctctttttacagatgaggaaactgaggcccagagagagccacaaagagagtctgggagagttgggattcagacctgtcattttgtcttcaagcacttagtaagcacctgctgagtgccagccagtgtgcttggtcgtggctttgccgttaaaacccacatccttacccactgaattcaatgctgctggtgcaggagcgctcttccctcttgggtgcagagtccatattttctggattctctaggatggtcccaatggcaacactttttattcttttcaataaagataatttgtggtatatataaccaaatgcactctaatgtttaaatcttggtaacactttttgcatgaataaattcactcttcccttcccactgggagtgctgtgtctaatgagaaattctcatttgggctgggaaaatgcggtcgctgaaccagagggatgggagccggggcatctgactcaaagctcagggttccgggagctgtctacgtcacacgatgatggggccagttgggttcctgagcacctccccctgctggaagatcgtgcaggctccctgggcgatccatctcacccaccctcttcccagtgtcttcggcctcccagagcttcttgctcccattccagagcccagggccttcccctctgtcttcatttttcaccaccctctgcagtgctgtcgtcaggtcaggaatggaccactgtcaggcagtgtggctcagtggttatggtcaaaggctctgggacaggtctctgggtttgaaggccagccccacaacgtgttgggtgtgtgacctaggcctcattatctggatgccctaggcttcaatttcctcatctgtgagatggggttaatattgtagcagatgctgtcagtgcctggctgtactctctgtatttctctccacccgccaaagtctgcttactgtgaatgaaactcattgcctgaggcagcatccctggccagtgcacagggcaggccagaagtgcagagagctagggctcctggaagcagctctcaaccaaggacagacagggagttcgagaatgaatatcccaacttccttttttttaaaaaaaataaaaaattttatttagacagggtctcgctctgtcgctcaggctgaagtgcagtggtgcgatcacggctcactgcagcctcaacctccccagctcaaacaatccttgcctcagcctcctgagtagctgagcctacaggtgtgcaccaccgtgcctggctgatttttaaatattttttgtagagacagaggtcccattatgttgcccaagctggtctcaaacttgtagactcaagcgattctctccactcggcatcccagagtgctggaatcacgcagcttccttgctgttggtgttgatacttggaggtgtatcttctaccctgtctcgcctagttccccagcagggtggagttctagttgcctgcaggaaagctggcttaatgcacccagtatcctgccctgccttcctgctccctcactgatgtttcctgggtcacttcccgaataagctacctgcatctgaattattttctcacagtctgcatctcggggagcccaaaccaagcctcaatgtgcctagagtgggggcagctgtggggatcacatgggtgaggatctggaaagcactggaggcggccgcatatgcatgctccatggaagcgggcactcccacatcgtggctccagttccccagccagaccatgcttcacagtcgcgtgtctgctcctgctgtgccctctgcctggttgccttcccattcctcttcacctggctcatgccaagacatccttctggactcagctcagtggtcacctcttcttggaagtcttccctgactacgccctgtgcttggcttggcaggggggatccctcttcagcatccacataggctccttccactgtcatggcatttacacccaggattaccatcctctgcgggctgccccttctccccacttattctttgaggcctgagaccacatttctttgctgcccagctctctgggggaggaggtagcccaggtgtgaatcttgtacaccccttagccctctgctccctgtggcctttgacctgtgtctgcacacaggaacccagcaaacgtggcacaatgagggcttagcatccatctgaggagagcacgaccagagtgaagcaccccagtctccatgccttcacaaccttttctctttcctcaccacctcgggggtcacccagcaggacaggatgctgggacaagtggaactgaaggctgggcatccaggctgatgggaattggctttgagaaggaaggatcttaagctcaaggtctcatctagtcgggaggaagacagggaggaggagagagagagtttaaagctctgagaccttgctttgtcttgtttctatttattataatgactactgtcattattatgtaatgaggtgaatggtgggccaaagttttgcccacctgccaatgatgaaaaagagataggttgactttaaagcaagagaagctgcagtcagacaaaagaaggaacttcccactttctggttgagcagggttggctgtcatcaagttctcagcaggcagagaacttgctggaacacagggatgtagggcagggggttgggggagaggctgacacacagaggacagggaggatgctgtggatcaccagtagccactggggcaggaagaagcatatgactgagagtgagggacctggagagctaattctctgctctactctcaacttgctggatgactttaggcaagtcgctttacctctctgggcctccatttccttatttgtaaagacggggacaataatacattcctggacaacatctccagctgtttcacaagttattagatggacatacactttatacaatttaaagcacagttcatggctgggcacagtggctcatacctgtaatcccagcacttcggcaggccaaggcgagccgattgcttgaggccaagactttgagaccagcctgggcaccatagcaagacccccatttctacaaaaaatacaaaaatcagccgggcatggtggtgcatgcctgtggtcccagctacttgggaagctgaggtgggaggattacttgagccccggaggcctaaactgcagtgagccaagattgtgccactgcattccagcctgggcaacagagtgatactgtcgcaaaataatttttatatgtatatgtatatataaaataaagcacagtttggatgaaaaataaacaaaaccaaaaccaacagggtgaggagagaaggtgagaaacaagcacgtgcttctctttctctagcaatccgtatcaggacaaggggactccatttaatgaacaactactctatgactagcacctataaaggccttaatcctcacaacagcctatgtaggaggctcgtctccattttacagatgagaagactgaggcccagagtggtcaattaactggtccaaccgggattagaactcaggcctctctgactcaacgccctggcttgttccgcctttgccacattattggagctgtgatggtcagatgttctacccttacttgatcacctgatggttcttctccccctgcccaaaatgaagattaggatacaagacccaggaagtcttccctggccctcgggccctccctgccccttcccagatggccttggctcaatctgggacttcatcatccacccaaccaggcctcagctgagaaggagccgggctctgagcccaacagataaaatcccaagccccacagccaatcctcgtggcctggccaggcattaggcaatgctaattgcactgtccacagtggagccttgtttgcatatatgcaaattggggggctgattagcgcttcccccagatgggtcagttcaggcctctgcctgacccctgtactgcctggtttaaagcactagcgagtgggacaaatgcccatccagatgggagatgcagcaagcaggggcggcctgtggcctgggcagcccccagtggccattgcctggcagctgaagggtccaatcatgacctgagtgtttggatggggaaccagaggctgtggtcacatgttccccaagtccctacccaaagggtctggcctctccaatttgggggaccccaggatgcccagagccttccctgggccttctctcagggacaggactcatgagcctgaccccacacaggcctagtaacagcagatgtctgcggttcagcttccaaggctcccgcagatgagtgggcatctgtagaggaggaccctgggcctgcgtccttgagctcagccaggcagctgcttggagtgcagccgtgatttaatctcattgggcccttctgtcgggcctgggctcaggatgcggagcttcaggacttctgtgtgctatcccccaccccctcggctgtcccctttcaggccgggaccctcatctctaggctggatgacacaacagcctggaccctgatctcctgcctccgctcttcctctagacagtcccgctgagcttctcaaatcacaaatctgagcactctccctcctgcttagaactctccatggctccccagtgcccagtcataaagtgcaaactcccgtcccagcccatgcccatggcatgggtttctaatcctcgctttccttgtcagtgtccagctccccacaccacagacgccttgtgggggtggatgaagtcttgctggagaatctgttcccatggcctggcagagcctggctggactttcagaggctggaggaatcaccttcccagggaggcttcctgaatgctgtctgtgcgacccctggatttcgtgtctttcagaaagtcctctgcacacaggtgacctggtaggcccgtgccttcccttctatgtctctgttaaagggttctaaagtcccttctctgggcgaggtcttgtctttctgtttaggtgggagctcttaggtggtaggggggtgagtggtgcccatcagacttggattctctccccaaggcaggagctgtgactccccgatcagactgggacctcaccggggctggagctatgactctttcatcagatttgggacctccccagggctggggctgtgtctcccctatcagattaaggcttcgtgatggcagaagactgtctccctgcatcagagtgggagccccctgaggtctgtgtccctagaccttgtcacatttccaccttaggggaatgtcagtgtctactctgttccgttttctgttccttgatgtttccacgtggtcctctcggggaggaggcatgcagaggaaggaggacaggccagcaggagcctctgctcctcccatcttctccttccccaggcctggcccacagccccttcccaggacagagcagcaccttggtaagcctcagtcgagttggaaggattgagtccacaggcggctcacagacctccatgccccgctgccccaggctaggagccaagggccccatgcccccttggactcagttccccaggtcccacccagaggtagggctacccctagtcacctccctgcccaagctgcctgtgcctgaagcagctgttgggctctgcccctgaccctgaagagatctggcccacctttccttccatttattcctctgcccaattctgacctagcttagcctgggtccggaaccctctggaagcacctaggtccagtcctccagtcccctgaagataccactaggtagtactaggtgacttggtctaaccagagaagcctccagtaaatagagccccttagaccaccaagaaaagctgcccaggacccttcaaagccagagcacgttgctgatctgagaacggtcagccagaacctcccccttgtgtcagcagggccactcggacagagagggttgagagccagaccagaaggacagagtgagattcctgctggggcccttgttcttcgtgaccttgagtaagatgtttaacttctccgtgcctctatttccccatttgccacaacttgacgattgtggtgagaataaaatgagatagcagaagaggagcttccctgatgagtgattatgatgggtgagtcccgggtgcctcaaaaagccttcctccctgctgttttgaattatctgactccaaaagataactttttttattattattccaaaagtaatacccgaaagctggagataatttgaagcgtttagaaaggcacaaaaaagaaaatagcatgactcagagatgactgctgctcgtggcatggtgctgaccctgtcagccttttctgtgcgtggggacagggaaccgtggagggaaacagagaggaatttatggaatattttttaaaaagttatcctcggagtcatttttgtggctagatggctcctccccacctttgttccctgacccttgtgtgggtatctgaaagctgcccattaccctgttcttgccaccaatttcctcaattcacactccctataaaccaccatggggagctttataggcccacaaaggcattcaaagttaatggcaaaaccaaccatgtgaaaactccgctgtaaaatccacctcactctctccccagtgcccgagagcccccagcccctcctggttcccatgaggcagcctgatacctgccgccccaactggcactgggccctgggacagagggatgggcaggcagagagtccagggggtgaccttctttccaccgaggacacgaagcacacacatcctcttgccacaacaacacagatgcaataaatacgaggactgtaatttatgtagatgttttgaagtccaaacagaagggtggggagggactaataaaatgccatccctcatgtcggcttctcagggcggcaaatgtggcaggttcataaggaatgcgcagggcacctgccggctgagcgtggaggttagggaagtccaaatgatgcccttgggctcccctgccaaggtcgacgctctgccaggggatggagcccagaaccaggaggaactttggttgctcctttattcctccttccaagaagtgtttccaggctctggctcaaaccctcctgggcagaaagggacaggagcctagcttggtcttttaggggagaaaagtgtggcttctgctgggacagtgaatgaagagtgggcttggcactgaccctggctctgctgtgtgacctttgggcaaatacctcaccctctctgatcctgtttacatatccatctaaaggagagaaaaaggagggtattatgaggattaagtgccatactgtaaggaaacaggcagagagggaatatgtaatcaatgccagtttctccccactctccattagtttccgaatttcttgcaaactgcaaaggacagatctcttgctatatttgtgccagaacaccgagtccaaagcactgggcctagcagggagtgagcgtccatcagtttgaggatggtcccttcctctgctttgtaccaagagggggatgggtggggtgcagtatggaggtggggcaacgtgagtctattctgggccatgtcgttggctcagcgggcgaccttgactgagtcatttcactctcaggagaggctggagctgagccagtgcaccttctcctgggccctcctgggatcactgctccaacgcagggagggattgggacagtgaagagtcaggcttctccccacaccagcccaaccacatgctgcccacacctccactcccttaggggagaagtgcctccttttggtcaaggtagtaggagaggaactgagcgttcagccttgtttgatatgtgagcaaactggaattggtttctggccaaggttgtggagccaccgagggtcccgggtgagaccagaatcagttctgacgtgcccctctccccagcctttcttccacatttctctcttcatgacgctctcccatctctgtcttcatgttctatcttaattgatcctcatagcacccctgatatgtagatgaggaaagtaagactcagaggggttaagtgacatattcaaggtcacacagctggttaatggtagggtaagaaataaaacacatgccttgtagcaaacaccaaaagtaaaaacatggtcaccctgattccttgtctgcccttgctctctacgcctggtccaggaacgagttctggaggctcttcccccaatacatcctgcatctggatgacgcttccctctgacgccactgccaccccagcccaggccaccacgtgtccacgcctgccatagcctccctgctggtcttgcggctgccaccctcatcatccagctctccaggtgtccagagagatattattaaaatgtaaatcagatccagtcgcttccgggcttgaacccctccaaggtctgccatcgtgcttgacatcaaatcccatgccttactctccttcctctggtggtgcctgctctcccacctcaccctgtttgattctctcctgtgctcatgccactcccaccactctggcccgcttgctttctcccaagcgtgcttgtccagcctatgggcctttgaactcagagcttcctccgcttggatcacccttgctgggatgatcctaagactacaaccttcctgtcctgcagggctgaatttaaataaaaagcaccgagaaataccttccctgacaccaccccattgaaatgtcacctccttcccctattttccctttatatgaatacatctgagccatctgtcaggacactgcttgctagcattaataattttgttggtttttttgctcatcatctgtttccccactagaatataatttttgttgtgactatgatgatgaaacattgtgtacctcctacataccaggatggttctaggtttgcatatacataacttactgagatttgcaacaactttgtgaaaggtactattattatctccatttttactgaggacacttgatatggtttggctgtgtccccacccaaatctcatctttaattgtagctcccataattcccatgtgtcgtgggagggacttggtgggaggtaattgaatcgtgggggtgggtctttcctgtgctgttctcttgataatgagtaagtctcatgagatctgatggctttataagggggtgttttcctgcagaagttttctcttgcctgccgccatgtaagacatctctttgctcttccttcatctttcgccatgattgtgaggcctccccagccctgtggaactgtgagtccattaaaccattttcctttataaattactcagtcacaagtatgtcctttttttttttttttttttgagatggagtcttgctctgtcgcccaggctggagtgcagtggcgcgatctcatctcactgcaagctccgcctcctgggttcacgccgttgtcctgcctcagcctccagagtagctgggactacaggcgcccaccaccatgcccagctaattttttttgtatttttagtagagatggggtttcaccatgttagccaggatggtctcgatctcctgacctcatgatccgcccgcctcggcctcccaaagtgctgggattactggcgtgagccaccatgcccggcctcaagtatgtctttattagcagcatgaaaacggactaatacaacactgaagcccggagaagctaagtcacttgcccaaggccacacagctggctagtggtaaagctgggatttgaactcaggcagtccagcttcagcgtctagactctggaccacaacactaggctgtaaattgcatcaaggcagcagccaggtctcttttgtttcctgctgcatccccagtgcctagtgcaaggcctggcaccaggaaggtgcacagtagatgtttgtggagtgagaggatgtgtgccacggtgagtaagcatagaccctgccctcagagatatcatatcatcgcttatttcattgctcagaagacacagggaaataaaaataagaagtggaaaaaacaagcctgtataattcaaagcataaacatgttatccttgaatgagtgagattgtttgtagtcaagtacagagtagccctcctgcccctgcacacacaagttagtgtcttatactcattaaaaaagccggagcataaacccagtgcttgagctaagtgtgcacgagttcttacggtgtcagcaagacgtgctcaccagagtgtgtctggcggcatcccggagactctgccaggctaagtgcatggagcagggttcagaggtctgcatgctccgtagtactcctgcggcccaccttgcctggacaacagctgggacaggcgtgtcactgacatgtgtgcctgagcccctctgtccagcctggcacagcccctgctggccaatgctgggacatgggccagcagcctgcagagggtgtgtgtggccatggtgggtaatgacacgtggagagacagaggagcgctcggtgtgcaggggagaccatgggagcagggacagtctccgaggcttcggggcaagggactgatttaagtgaaccatgcacagcggggatgacacacacagagggagggggtggccatcccggcacggttcagaggctcagactcatggctgtgctaatcattagtgtcaataccgtgaatgctggcgaatcacagagctaatgttgctaataataaggggtgatatatcctgactcctcagtcctggctgggtgcccggccagcaagacctgcctccccagtaccgctcagctaaatggctgagccactcgtgcatgagctctctcggtggcaggccagcctgacagcttggcccaataggtcttcgtaacatgggcagattgtggaaatcctgggtgtttttctgaggcttccttcggggcaggatcagcctggcttcactgatccatctctagactctggctccataatttttcggctttgtgaccttggggagtcatttcccctcccccattgtttctgcatctgtaaaatgagaatcattcatgtctactataaaaggtagatctggggagcctctgggatgatgtggaactctgagcagaatgccaagcgcaagtttcaccatacgctaattattattataataattacattttcatttattcagtagcaagaatgtaggctttggggccggggagtggtggcttatgcctataatcccagcactttgggaggccgaggcaggaggattgcttgagcctaggagtttgaggccatcctgggtaacagagggaggctctgtctctgcaaaacaaaaaattagccgggtgcagtggctcatatgcctgtaatcccagctactcagaaggctgaggtgggaggattgcttcagcccaggagctcaaggctgcagtgagctatgatcatgccactgcactccagtctgggtgacagagtgaaagagaatttaggttttggaaccaggttgagctggggtggaatcctctgctgccacgtgctctaaggcctgggcctctctggaaaatggggatagcaccttccttacggaggctgggaggattggagacagttcacttgtaacaaggaggatggtgcttggcatggcggggggggtctcaggatacttaaggtagtttataggttttaactgagttcctgccgtgtgcagtcactgtgccctgccctggagatacctgtccccgattctgtgttagctgtaggtgtttgagtcagtgtggtcagagacaggaatgctggcctccttggagatgggcttaaggggctaggcgagaccggtaacttcatacctacttcagggccaggaagtccacatacatttgacccctttctcctccttgaattccagaggggactcaatccatctcagcacctcccagggagctgagagccctgaagtcagtgcagtgtcctccgtcaccaatgccatcaagataccccatcagggactccagcactttcactggggcagttgcccccctcaccaaggtctctctgagtgggatcacaaatgccattacactctggatcattctgctggtggggcaagagtggcccctgagctgatggggcggccctagccccaaatccctgtcatgtccattaccacatcagcctcccagcttagtgccatcgggaaaaaaagcaggggtggtgcctgtcccagttggcaccagagaaaacaaaggctcaggcagggtatgtgacctgagcaaggtctccggatggctgtggctcagccctgatgaatcacagaatacctgagcgtcccagggcctctacccaggctgtatcctctgtgtggagggacctttcatcacttcatttaggtctctgttcaaatcttcccttgtcagagagtccttcatgagccacttgtcacagtcagggtaattaacactagctgctgtaacaaacaattccaacctcttcttgacacagcacagtaaaagtgtattttttgttcatgcaaaatcaaatgcatttattcctggtcagaggctcccctgagcactcacatccaggcaatggttctgggggcccagcctctttcattttgtgcctctgtcatccctgggaggttccccgctggatcctctgtattcagtctgctgaagagtgaagagaaagatcacatggaggctctgacctagagtttcaagggccaggtccagagtggcatataccatcgacatccacattctagtggccagagcaggtcacatggccaaatccaacactgatggggagggacagtgcatgccacatataacaggcgggggagaggagtgaataattcacaccatggtagaggatttcacaggatgtctggggccaggcctgggcgacacttattccctgcttccatggaccacaactgactcacacatcctccttaactgcagggggctgtggggggcgggtcttggaaatacggagaagctcatggatattggtgaaaactgacagtttctgccccacaacctagtaattaaagagatcctagtagtgcttctcatcatgtgggtgaccgtataattcatcttccaaatgggaccattttaaggtgaaaggggtcactaatgattatcctctgaacactgggtttcaagcaggttgctccagggatttggggcacgtggtcaccctactcatcactctgcatcctctcagcctgctttattgttctttttcacacttaatcactgcctaggagtggactccgtgaggacagggacctttctccctctgttgctatatcctcagtgcctagaactgggcctggcacattagaggtgcccattatatgcctggtagatgaacgaatgaattaactcaactgtctcacagattccttttgaggaccgactgcacattcatccacagtgctcctgccctcctggagctaagcagatgtcaaatgagaaagggtgatgtccaaggactccagaaggtcatgcctgagtctggaggtggcttcaaggttttaactgcgttccactgcatgcagtcatcgtgccctgccctggagacacctgtcccaggattctatgttagctacaggtgtgaggtcagagcagatcccttgagaaggtgatatttgagccacagatctttagaaaacacagaccatagactcagttccaaacagtcttgagctcacaatttggtttggccttttgggtgctgtgtaagcctaggtgagtcacttgacctctctgaaccttagctcgctcatctgcaaagtgagaccaggcatccgaacctttgcagggtggttgggacctagtaactggtgttgattatcataatcatgatttctcttatttagattttagacttgaagctccatcactatggagcttggtctctggccatggagggaccatgaagttttgcccttctcatcatgcattgttataaagccaactaaggacagctccccagttcctagtgcccagagccctaaataacaagatgccgcttcttcacgtagggttccatgatctggccttagctctgccagttagtagctgtgtaagtctgaacagcttagcctctctgaacctctgtttccttggaataggaatatccaaggctatcttatagggtacaggtgaggatagaagagataatgcagttaacaagcctcctacagcttctgcccatagctatgatggaaaagcacgagggttgatgttgattgcttgcagtgtgccggccaacaatggtgacagccccaggtttgggggctcagtgttcgagcccccaagggcactcagattctgcccagcagcagccaccacagggtcctgaaaggagaaggtttgctcccagccgctctgctggcttagaacaggcagtgggtggtagggaggccaagagagtgatggaggcattcccgggcgttgcttcagcttcactgtcaaccatggaacagttatagatggttttgtcctcttggagatgtccatcccattagcatccacacacggccctaatgggcttcagaaggccaatgccaacagtcttgtcttcactccgcagaggaggccccagccagatggatggagcggggctcagagctgctcagacatctgcaatgtagccccagggaactcaaaaggccccaggcctagggctggaccctaagcgcagccaaacccagtgacttggctcaataacaggcaggaagaacaaggcacagtcactgctcataaaacagcagcagccacggggtggatgactgactgggaaccaggtgccgaaggtgaattttctcctttcatcctcaccatcctatggacttggtgtgatgatctctacttcgcaaatgaggcaactgagggtcaggagagtgaagtgatcatctgtggtggtccagctagggatggcagaggtggtggggtggggggctggggacacgaagggaccaggacttgagttccgttggtctgagccccagatgcatgctgtccccgattccccacgcagcgtctgcgaatccatccccactgaaccaggactgtccagctgcatctcatttcatcagctgctgtggactggaacccctcatgcagccctgagcccatgtgttcctttaaaaggtggagacactgaagcccggagcagggaagagtcttgcccgcatcacacagtgatttaattgtaggagccgatccgttcctaggtctcaccaccttatctgcatccgtgggatccacagaccactgactggcatcccaggagccacggtgagcccactgtctgtgtgttttagttaattttctcacctttaggtagaacatgcattcctcgcttcaccccagtccccacccttccctatcgccttcacctgggctgatgcgctcatttgcttcgctggcctgatactgtctgcatttgcctctctgcctgggctctccttacaggggacttggatgggatttgatttgagtgcttttctctctttcttttgtcatctctttcaaggccgcgagtcccatctcccattttacatcttttttttcagccctctttcctatatcaaaacttccccattcaaagcttcacctcctcaggtcttcagactcagtaaaggaaaggagatatcagtgggcagccactcagtcttcttggctcacggaggctgggatcacccctgtcacccctgaccctgtgctgggctctgccctgagagaagctcacatgtccccagctgcaatggatctgatgctgagaatgattctcatcccaggcaaggaggcccagggcagggctgggtgaggaggccctgccctgggagagcagtggcttctgggttagaactcacttgaaggatgtggggaggggtgggggtggggtggattccaggcagagaacacaagagctaaactatttaggctcagagaaaatggagttgctttgtgtaaccaaattcgtcctctcctttcccctccctttccctctttccctcccttcctttctcttcctcccttcattttcctttcacttccctttcacttccctagaggaggggttccttggagacccttgcaactggctggaatctggaaaaatcctggaggactgtctggaggaagtgtgaatccagggagggcagactgtgaagtgcaggaggggagcaggggctaggcaaatggggggctcacttatgcctcctgcaggtcccagctgaggctgatatagtcaagaggccagcgctactagattcacacttcctccaggcagccttccaggatttttgtagattctagccagtcacaagggtctccagggagcctctgcttcctgggccccatggcactgtgcatgcacttggattttgtcacttgcctttgtcatttgcacccgcctccccagctgtgaccccttgaaggcaaggctgtcctgttacacctggcacccagcacgggatgggacatagagagagcctcgcccctgcatggaagctgtcccatgagtcctctgagttttggccctggctctgctggtgccatgtgacttccttgctgagcctctgctcctgcatctgtaaaatggggataaggatacctactttgtagggttgctataggaataaccatccagcccttgtgtaccatgagcttggcacctctgaggcagtcaaccaactggcttgagagcagtcagaaaaaggggtcccacccaggctggctctccagccccctccaggggcaattctgctgagctcacgaaggggaagaatgcacagcatgcagggccccgggtgcccaaaaagctggggtgcctaacagagggactcagcccctcaaccaagtcataggacatagagaccatcttggcaagcctgaaatcaagaaagacagccaggcttggggaactggtgatgaactgctggtgcagtgttgaggggagccgggaagggctggaagagggcaagccagcaccccactctgttgaaggccagacaaaggctgggccttccaggaggcctgggcgctgacctggggtgcgccatgctcccatccctgcgggatcaagaacgggaagctaagaagtgtggtcggtcaggaggctgagagcctaattgattaaagttgtacatgttttgatgggcccggatgcggtgctggcgaaaggtgaagtattaatacatataatatataattatgatgtgccaccggcctggcagcctgtgtaaatagttacccagctggtagctaatcccggtaagtgggccagggcacctctcacacgcgacaggctggcttctatcctgcggggagggcctgggcttcacctggacttgtgtagccctagaggaacattctgatagagtgggtgggcatccagggctggggctggcacttccaggggttggagtgtctgggctggcatggaattctccactattaaggaggtggtcatcagggaaggaaggaaaccaggctggaccgggcactcctcactggctaagccctgtgcccactgggcactcctcgctggccaagctccgtgcccacaacctcacacttcatgcccactctgcgtctcctcctcttctctctgcagatggagaaaatcagagaggcttaaggaagcacagcaagtaggcgacagggctgggattcaaatgcagtcccctggctctaagcccgagtgctgtttcttccagaaagcaacaacaaagccactgtccccgtccccagccccaaccaagttcactcttgctgagcccccaaaaggattcccattgatcccctgtactgaggatacggagagaggtctgtggcattctgggtctctcctcttaatttagctcaaatgttgagaaaccagagaaagttaagggaagattccaaacaagttgagctgccactaacagccagctctgaggcttttgtctctgagtgtttacagcccaggaagtctggcatccactgcaggtgaccgggcagggtgcaggtgtgaggctggaagtgagagcggacagtgggactgaaatccggactcagcagttcccgtcaaaaagacattcagactctcccagcactttgaggggcggaggtaggtggatcacctgagttcaggagttccaggccagcttggccaatgtggtgaaacctgtctctactaaaaatgcaaacattagccaggcatggtggtaggcacctgtaatcccagctacttgggaggctgaggcaggagaattgcttgaacccggaaggcggagtttgcagagagccgagattgcaccactgcatgcactccagcctgggtgacagagggagactccacctcaaaaaagaaagaaaaaaaaaagagacattcagactcaaaataactttctacaaccctcactgctgctgtgttgctcagtccagggccccagactccctggtgcctcgtggaatttcagaggggcagtggggcttctagctctttctttggagggctaactctgcctcgctgtctgtcccctggccatggtggctcacctgcctggtgggtaccccaggacctcaccctgtgagccactctgggggcagctccaggagctcaggtttactgctccccgccaatcccctcaaggtctcggtcatagccacaccatggccctgtgcgtgtgtctgtctataagtgagtagttttctcccctgcctccacgctgcagcccacaagctggggactcccaaggcagggggttcattcatctctgtggtcaccatcgtcctgttctcaacgtgtccgctctgactttctgcctcccagcccggtctggtacacacgttaagcaagactgcaacctgcaagtccagcccgtcttcctcccagctgcagccactaatgggatgctaagtgcctattttgcagatgaggaaattgcaattaagagaggttaaataactttcccagggtcacatatttggttcgccactccaacaccatgatgtttccactccatcagattgcctctttgctggatgagtcttggaggggaggggtgtttcctccatctgactcagggctcccatagggtctcctccatcagagtaagcatttgctcagagcaggaactctgtctctcccactagactgcgagcttcctgagggcagaagctgtacacctcccgtcagccagaccctcgaaaggtagaacgtgcatctcctccattacactaggaatatcctagtatagggtccctggggacactatgaaggtcatatctcccccatcaaactgggatctttccctaagggcaagctcagtggcgcccccatcagactgggagctccctgagggcagggactgagtctgaagtccttcaggatctcacacacctgccctgtcattccatcccccgccttaggaccccctgccatggcacccctgatggtgttcacatcctgcacaggactcaccctcagccggagcagaagctgccaacaggccactaaaccacagtgcaccctcggcattaattagtgttgctgctgttaagtgtttcttcccatttatgcaaatcagcgaggtaagaggcatataatgaagtgtttgtggtttaatactgtgcggtaggaacgaagaggaattttaattactgactcctaattggatggacggcttgttaatatcctcctgacaggacatctgagtcacttctgcccacccacccaggcccgggtgtctgctgcccactcctgaccagggcagcgtcggggaacagtgcctccagaagccatccttgctgcccttgcccaggggtcattcctggcatccctctgcccttgactttggagctcctgtgtctttcaatctcttttcttctctctcaatctctctgccttcagaaggccctgggcttgtgttcaaatccccattctgccacttactgtgtgaccctggacaagtcacttcccatctctgagccatgttcttcaggctaagtactggatatgggtgataggcattgagaaatcagggaggttatgtagttagaaggttatgcaccctttcagagaagggtgggaaggtcctgcccaggcatagaatctggaggagaaaagaatgtagggtgtgtgggagagtctggagatgggcgttacccccagaggtaggaggtgctgagggcgattccctcccactcatccttcggggctctgctagggtggcacctcctcccagaccctcccaggttccctggtgcctgtgttgagagtctctgccttgggtttggtcgcctctctgcccatcccctgaccatcacatcgtgctgtcactgtacccattagactatgagttcctccagctgttctgttctattgacccactagcctggtgtccagcacagctccggaacctgagaaaaatgtgctcaatgaaagatgatcagtaggctggacttgtctgctgaagatgctccaagtcagggtgcagtttggattctagagaaagcaggcaatagggagccatggaggactccgaacagggggccgaagaaatgttagaatcaatgggcccttcacagctccctctgccttctctcggattcacctgctgatatagtttggctgtgtccccacccaaatctcatcttgaattgtagctcccataattcccatgtgttgtggaagggactggtggttcccccatactgttctcgtggtagtgagtaagtctcacgagatctgatggttttataaggagaaaactcttttgcttggttcttgttctctctcttgcctgctgccatgtaagatgtgcctcttgccatgattgtgaggcctccccagccgtgtggaactgtaaacccattaaacctctttttctttataaatcacccagtctcgggtatgtctttttttttttttttgagagagagtctcgctctgtcacccaggctggagtgcagtggtgtgatctcggctcactgcaacctccacctcccaggttcaagccattctctgcctcagcctcctgagtagctgggattacaggtgcccagcaccacgcccggctaattttttgaatttttggtagagattggatttcatcacattgggcaggctggtcttgaactcctgaccttgtgatccatccaccttggcctcccaaagtgctgggattacaggcgtgagccaccttgcctggccctgggtatgtctttattagcaacgtgagaacagactagtacagcttcccaatgaacatccaaatcttgacgtggtccaggtcctcagaggacaaattcagaagcatttctggatcccctaggatgggcagagtggtgatctttgggcagggccaggctagggggagagaaggaaggaaaaacagtcacttctcaccgaactagtttaagaagagttataaccagatagaaaagcctcactggtctcactctgctggagttagagcctagctctgggacttaaccagctttggggtccttctgagccttcctatacttatccataaaacgggctaaacctactttatcagatgtgttcagagaatacatgacataaagcacttcaagcgctcacagcattatgccctcatgcagtaggtgttcaacaaaaggcagatgttattatagttagatttcctataatggcaggcggtgagctctcctgggtgtggcttcctggtgacaagcccaggtgtctgacttaaggcacacttggctctgcactttctagctgggcgaacttgtgtgttttctggtttaagtcataatttcttttctggtaacatgaggatcgtacagtacttcctcacagggtctggggaaggaccgggcactcagagcgtgctcattcggtgtgacgatggctgctcctgtcatagtcattataacccactgatggggggaactaaaccagcagcttccccattctgaacttcagcttccttgttctatctgggaatcacagtccctgcacccgcagccacccagaatcactgcagtcagcagatcctattgctgacaagccttcctaaactgtagagtgctggaccaatgtgggctctgacggttaggaccacagagggtatggagggtggtggtggccgttcctggaggctgacttggcctgctcgagatgggaggtgactgtgatccatgtaccccctgcatcctggaagacactgggaagtcattatgggtgcaggggaccaactgtagagctttaggcctctgttcctgctggggcctggccagggaatctcttgggccagagtttggcctccttggcctgcacttgagatcagcaaactcctgaatctcaggggtccaggtaaggaaagaaaaccccgtgactcggccctctcccgttttagcacggccagcctcagcctcctttctccacagagtccctacggggccctcccagcctccactggcatgaacgagaagggaaagccagcattcacacaatgcctgctgtatagagcaggtgcttctctaggcactattaccatccccatgccgcagaggagcaagcagaggtggcttgcggggatggtgctgtgaatgacccttggagataggtcaccagcccaggcctgcctgattccaacatcgtgccctgtattctgagcctgcaaatgccagcttgagtcccagaactctacccaggccaccaaaagccttatttaccttccccccagcccactttcctgggcttatcaggcagaggccgaagcagctgctcacattgcaagcgcccattccaagtatcccaccggtgacaggagaacaaacaagcctgaaccctcagcaatcccctggctgagaggcctgccagagttttcaaaggcgaggaaaactatgaaacggggttaaacaaacacatgtttgaaaggaaaacagatgccagacagatgtgctcccaacttacactgatacagtctcgcgtggcggtgggaggaggccaaatatttatgaagcatttactgcaaaaggcaaagcggtggagcaaaggcacagaggcttgaaatcaagcagatgaagcagacctgggttggaattccagatccccttggagggctgtgtgaccttgggcagggcacttaacgtctctgagcctctgttttctcatctgcaaaaggggatcatcatacccttcctatagagcaaacttcttaatatacaggtggtccctaacttacaatgattcgatttcctgtttttctttctttctttttccttttccttttctttttttgagacagggtgtcactctatcacctaggctggagtgcagtggcatgatcacaactcacaactcactgcagcctcaacttcccaggctagggcgatcctctcacctcaacctcctgagtagctgggactacaggcacgtgccaccacatgtgcctgtatttttgtatttttttgtagagacaaggtcttgccatgtttcccaggctggtctgaagctcctgagctccagcaatctgcctgcctctgcctccccaagtctgggattacaggtgtgagccaccgcacctggcccaatttgccatttttctactttacgttaatggtgtgaaagcaatagccatttggtagaaaccatcctttgaattttgaattttgatgcagtgggaaactccctagcagtgccagacagcattagggagctgcagctcccagtcacccatgccatcaggacagtgatacactgataccctgcagcttactgtggtgcaaagtggttttgcccaatatatgccgttgtaagtgttctgagcacgtttcaggtcagctaggctaagctttgatgctctgtaggttaggtgtactaaatacatttttgacttaggatattttcaacttaagattggttaattgggatgtaactccactgtaagttgaggagcgtctgcatattagggacatagcgtggggcctgacatatgataggtgctcagtaaatgttagtttcattccctttattagagggtttagcaagctgagatatgagaccgtattcaccctctaaaccaggccaaaaggaaggagccgctctcctggggacaatgatggtaagtgaggtccagaaggcagaagggttgaaacccagaggagtctttggacttgggggaccaggatcatgttctgtgaacagtgatggtgtcacattgggggtggtagacggagggtgagttggagttggccatgcaggatttggacatggggaggttaaattaatccccagtcattctagggtgattcttctgaatgaaagatgtttccatggggcttgggggcacagtggcagaggccgggtatcgtattctggggttaagaccttggacaaatctgcttcacttctgtgagcccgtttcctaaactataaagggagaatcatgatatttaccttctggaattgttgggcaaaaaagaaaaaaaaaaggcaatgtggcaggccggtggtgactactcagaatagtggttgttattggtggtggtgttaatgtcgcaggaggaggtatggcagatggggtggtggacagaggatgagttgcagaagggataaaagagaaagaggtgagagggtggagggaggagttagtgcaggatgggaggatggatgtatctgcctctaaatcccaatttccttggcacttgccgggaggcggtttcttttgcaaaccatgacacatttgcacagggttagagcagatccccaaggctctggacaaggctgcacagctacatttcaggtacatcggtctcggtttccccagcaggagacaaggctcctgagataagcctatgctgtccttttcatccactctatttgtgctagagacctgcatttttccaacttccctgcaaccccattggtgcagccagcattggtgggtgggaaaaggccccccaagctcctgcccagcgcctctttggggtgggagaagggaaggaacagaagtgcccaccaatgtcttctctgacttcactgtgtcttcacagcctaggggcactgatggatttagctaagtgctcataacttccaaaccaaaagtcagagctcaggatctaacaataacgggtgttttccaattcctgaaaaatgatttatatgaaaagggaaataccgtgatagccatcatttatatgaaatgcaatttagttactgatttggtgaattactggaccacaatgaacgtgaaaagaagtagagaatccaccaatgggagactgcccagtggctgacacatggaggataatgatgatgacaataatgatagaacagcatactagctccatctgtatagcattctacatggcatgtattatgactgctcccttgtacagatgaggaaactgaggcataggcaaggtaagtaacttactcaagggtttaggactaataagtagcagagttgagatttcagcctgggtttgactgactccagggcacaagtttttcccttccttgctccttccctctcccctttccttctttcttccctccctctcttccttccttctgacccccttctttccttcctttcattcttctccttacctcctttgctgtccttccctttcctgtctttccctccctccatccatctttcctttttatccttttctctcctttctttcaatcggatattgataaattgccctctacagaggttgtacaatttacgctccccccagcaatgttggagagcctcaccctgttctcccacaggcttgccaaacacggtgtcagcaaacacacaccttaggaaatgttgcccgtctgatcagtgcaattttaactgatcgtgaaggaggttgagcatcttttcatatattgatgggcaatttgtatttctttcttcgcgattatctttcatactttttgcccatatttgttcctttgttggtattttttcttttatatatatatatatttattatactttaagttctagggtacatgtgcacaatgtgcaggtttgttacatatgtatacatgtaccatgttggtttgctgcacccattaactcgtcatttacattaggtatatttcctaatgctatccctcccccctccccccaccccacaacaggccctagtgtgtgatgttccccttcctgtgtccaagtgttctcattgttcaattcccacctgtgagtgagaacatgcggtgtttggttttttgtccttgcaatagtttgctgagaatgatggtttccagctgcatccatgtccctacgaaggatatgaactcatcattttttgtggctgcgtggtatttcatggtgtatatgtgccacattttcttcacaatttctaggaacttttcatatgttgaggataacattcataataggagtctgtatttcttggctagggctgccatagcaaaataccacaaactgggtggtttaaacaacagaaatggtttttcccacagttctggatgctggaagtccaagatcaaggtgctggcagcgttggtttcttgtgtggcctctctcctggacttgcggatggtcacctttttgcggagtcctcacatggtctttcctctgtgcatggcaatttctggtgtctcttgtgcctccaaattatttcttcttataaggacactagtcagagcagattagggtccaccctaacagcctcattttaggccaattacttctctaaaggccctacatccaaacacagtcacattctgaggtcccggggattagggcttcaaataagaattttgagggaacacttctcagcctgtaaagagtaaagtagaggttcttcttcaaagactttcctccccatctaattaagaataaatagtaacttctcttagaggcaaaatttgttcaaagacctgtgctaacatccttaaatatctgctagccgtaataaagaaatcaattgcactttatgttcttagctcccacaatttagcctaaatatttgccctggcatgtttataccagtccaagcaagcattaagtcatagcctgttcctcttccttatttaaaagtgtttttatctttctcagcattccacaagttacttcctccttcctttgttctcttctgcttttgcctcttttaaaaagttctaagttgctagccaatcaggacaaatacaaaatgtgaggtcccattccagccagtagaaaccagacacagcagtaaggtagatgtgtcaggttataaacgaccctgtctcctttgttcagtgtactctcgtggtaaaactgctagcaagtgtaccctttctgcagaaagtaaaaatggccttgctgaagaaattaaatttatgttcaagtgctatttctttacagaaccagggaacaagcattcctaacaagccactaacagagtcccacatatctttttttctgagcttgcttttaaaaaaaattttaccttgtatattttctccctaccctatgcagtatagcctcctcaagtctccaaatttgaatatctgaaatcagctttgctccagaaaactgagtgtttatctttgcctggtttcccctaatttgtcttcagagacagcttgatccagaggaaagggtgtgatgggctttggagtcactttgacctccctggcctgaagtcctggcaattcgcacagccgcagggtgaccttgggcaagtcactctatctgagacgctgagtctcttttctataaacgacgctaataatagctagctggcagagctgctgtgaggacgaaatgagatgatatctctagaacgcgtagctccgtgtctggcccgtcaccagggttcagtatgctgcaaccattgcgattttctttatgaataacagctcgtatttatcaagcatccatggcaccgagggcctgaggggaagggggatgcagagtggggtctgtccaggcatctgctctcagggactcatggtcaggaccatgacctggaatgcatgggccaggccctgctgtccttcaaagcccaaatggggaagggagactcatatctgagccttgtaagtggaagaggattttcacaggtaggaaggaggggtgtgggagagggcattgcagtgggaaggcccaggatgtcccagagcagggaggcaggaaaggagagatcaccttcattggatcacaaggcatctctgtctactcgagagtttctggtttgaaagtgggaggcagcgtggagactctgttgtggaaacaggaaccgtctttacctgaaacaggcagaacacacaagtgtttgatggagtttgactgtgaggccacaagtgcttgcagagggaaggggcacggggtgagcagatgatgttcacgctacacatcgctggctgagcctgagctttcagggagcaagggctctgctggcacggatcgcagagggcttgagaagggtgtatctgaagcaagagtgctggatgatcagagacatccccaagaagtggggattggtccaagggcccatgctggatagaggtggctcagtgcctggccctttacctcatctaatgctaactgcaaacctgcaaggtagatatgaccggccttattgtacagaggaggaaaccaagacttgaaaaggtgaaattgtttacccaaagtccaactaggaactaggtggaggagctgagcttagaacctggggagcctaaattctctgcatgcacccccatgctggttagaaaagggtcttgggtggtggtgaccccagtgaaagtgatccctgtggaaaggcttagtgccctccaccacccacctgccttgccaagttccctcctttcccaccgtgagtggattaggctgagaaggcgtggggtttatggtgagcccactctagagaaaagggccccgtccaccctttccttctgctgctggaacctcattgcatacctccaccctcgtgatctgctggggtgggggagcctatttgggacctcacctccatccccactcctgctgtacaggggagagaagggtccccactgaacactctctgttccccacagcaagtgcagttgtgtggccagggcactctcaggttcccggcgccctgggtgccactccgaagtgtctggctcctctccacagatcccagggccagctcctcctgcacgttcctcattcttctccctgctccacgtgcgccacaaacaccttgatcacctctaccgcaggaacacctgctctccttttaatgaccacattcatggaaggagaacaaccagcttagcatcatggtccaaaatgtcccccaggggctggacaggaccttgggagtccagcaggaccaccctgctgcctttggggtgggggtggggtgaagacacgttaaaccctctgaactgcaaggagggtctctgttgctgccagagccccctcctcgtcactctgctcaccaaggaagagcatctggccgttaacttatatataataacccttaaacgctgccattaagtcacctctcattcttttaaactacccaggaagggagttcagggtgatatacggaggcttttatggctggtactgggcagcttaaggacttagcagcacactgaacacacacattgttgcataaataagaaccactgtaatatcaaagcatcactcagctccatgcctgagtttctcagcagcacagaaccaacatcctgcaccctgggtcatcgtcacttagacaaggggacctgaggacagggtcattgcctcagagctggaccactgaatcccatgatgttaccactgctagatgcaccaggagaccctgtcactttatcgcctgtccctctctccttctttcactcagccttctccttaattacgccttatgttgcaaggggcaggggatggaagaagaaaggaatcgctccctatccgaattaacctgctgcatgccaggcactttacacatattatctcatgaaatgctcgattgtacacagtagtaaaggtgttattgctcatttatagctggagagactcagtaacttgtccaaggtcacccagcttgtaagtgacaaagctgggatttgaaccctgcctatggcccttgcatatatgtcatttgcagtaaacacggggttctggggccggaggggagcaggtgctggtgcaggtggacagccccgaggggccccgaagagccctgtgtgtggaggctttgaaatcaggagtagggggctcagagtgtctgtctgggtttgcagacaagggcacagcactaacctgtggctgctcgcctgcgtggctatgctcacctaggagcacccacttggcaaatggacagtgttaatatttaatgagtgatgatgactttgggggaattgctgtttactccctcagagaaaggctcagaattcacattgggccccaatggcccaggcagagactccccagatcagatccccaccagctggatccgccatggaggcccatctgcgaagtagctttggcgagcgggatccagtgtcaggtcctgagggtggaggaagagcagggaactgggaagtggggcccctgtgcttggggaattccactcatgcctgggagtggttgaagacgaagcccaggcgtatttctttcttccaccattcctctaacccccgtcttgcccacgctaactgggatgccaaccgtggtgctggggtcctctgctctttccaattcacaagggtggcccaagcattccagggctaattccacttcctcataagaccccaaggaaatcacataccctggctgcttccgccccatgtgaggatggcggcacaggtggccgagttagcgagtgtctttgctgatggctgaagccccctgcccccagcccagggtagggagttctcactggcagtcagatgcgcctgattaacagaaatgaaagatgggctaattgctgctgaatatgagccgcttgtttggtagggagagcagggttttcaaatcatggagtcctgggggtgcggggaaggactgtccttggggctcctggtccacagtgtggtacttggcccacagagatgagctgcctgttgatgggggaggcagacaggctggaaaatgcgtggaccataagacaggagtggagcagggttttttggcgggggaggggatctcttactctgcaggagatggaaccgggagaagttcaacagagcagcggtgccaacaaggtatggcaggtggccatgaaggccacagatcttaggaccaagtgcatctgtgttcaagcccaggatctgtcacaagccccagcccacagcaggcgcccaggaagtggtagctgtgagtgccctcattgtggagaaggtaaggagggcattccagttatagggagccacatgggcaaaggcatcactggaccttgatgctgcatttgggggatcctgtgccaggattaaaggatgccagtggcaggggcaggggaggaagtgaggtcagaaagagagattcttgggaaccagacagctagctaaggaatggggtcttatgaagccagtgaccatttctgagtagggattctagaatccagatttgtataagacaaatcggtggctcccaaatggccaactttgaacccctgctggctggctataggccccaaagacctcatttggataatacattaatatacagagtgccaggtcccacttccagagagtctgattcaataggtaagaatgcctaatatgtattaaatgtcttctgcttgctgattttatcctatatattttacttttttgtttaactaatgtaatcctcacaagaatcctatgggaataggtactgttattgtccccatcttacagatggaggaagtaaagcacagagaggttaagcaacttgctcaagttggcacagcagcaattgtcagagctgggatttgaacgtacactgcctgactctggagtccatgctttaaagcacactgctatcccggttctgatgaaggctgaggaaatctcacttggctgggcacacgccctcctgtccatgattcttccaggctgcagatttgagactcatgatcattgtcaaccagtggtcttacattcagagaagacagtggtcagggtaggttgcaccttcaggaagggcttcatggagcaggtggacttaagagggtcaggttatggtggatgcagggaatcagagaggaggacaatctgggtgagaggcatagcatgaacaaaagcaaggaaacagcagacatgcaggcccgtcggggaggctgcctgtggaaggacctgggagtgagactaggtgtgtggaatgagcttggaagacactgtctggagcaagtgtctcggtgtcttgtagcatgctggcctcactctcatgccagtaattgtaagccctcaagatgccttcatttccagagccaccctaggctcagtgagaattgagccatgattaaaaggtcagtccagagaggaggcattcacagattcacaatcctcccaaatgaagactcatccttagggcctgatgggatccctggggtcagagggctggggtcagagggctgcagggcagaacgaaggccagggcacccatagcaacctggaggggaaatcgctcccctctctgctctggaacaggaagtgcctgaaggtccacgattcctggcaagggctaagtaataataggtaaggaaatagtcatgctgaggaaggggtgtagcagagcagctaggaactcagtccccagcgtcagaaagttttcgttctggctctgctgctcactagccacgagtgacttttcctctccaagcctcagtttcctctgctgtaaatcaagaattaatcatgctagagttgtcatgcagaaccattgagataatgcacaatgcttatcacaagcacttaataaacaaaagccttcattcttatttctggcacaaactcccttggccacctacttagcaaccattctcttctagcaaaactttaattttgttgagtaattccccttcccccatgtggatatggacttcacgggggtggcaccaactccagagccaagaagtgagtgatgattggtctaaggctaagccaatcctggttgacctgttccctctaatagtgattggttcaaccatgggcagctgatacagttctgttcaattagtggaaatctataaaggagcttctgggaaaggttgaagaggtacctgggaagaaatagttccttttcttgtcccctggacaggattgtgtctgcagttgagggctggaaccacagcagccaccttgcagccatgcttacaggctgaggagggcaggaaagaaagatagacttgggactttgatgagggcctgggctgattaattcatcagccctagaatccccctagctcaagacttcttatgtgagagaataattttcaacattgtttaaaccaaattgagtttcctgttgatgtttcctgttacctgagatggaagcatctacctaatactctattaattaaagtttggtaagagtctgttttcctggagcaaggcacttatgtacatattacttcttgttacgctcacactagtagagcagaattaatatccctatttgtcttagtctgctgtggctgccataacacatatcatagactgtgtggcttaaacaacagaatttgatttcctcacagttctggaggctggaagtctgagatcaggctgccagcagggtcgggttctggggagggctctcctcctgacttgtagatggccgccttctcactgggacttcacatggcctttccttgttgcatgtgcagagagagagagagaatgaatcttatcctcttcttacaaatcctccaatcctatcagattagtaccccacccttaggacctcatttaaccttaattactttctaaaacccctacctgcaaatgcagtcacattgggggttagggcttcaacatatgaacttgggaagacacaattcagtccatatcacaactgcacacccaagaaaaattaaactcacagatgtgaagtgacttgcccaaatcacatcacttgcaaggggcagagctaggctttgaacagaagtctgcactttaaagtgtgtgctctctgtgctagtcaagcatcccctctggtgtgtgtgtgtgactcaatccataagtcatcttactatcctactctgggaaagataattaatataaaatttttcacattttaaaaaaacagctttaggccaggtgcggtggctcacgcctgtaatcctagcactttgggaggccgaagcaggtgggtcactaggtcaggagatcaagaccattctggctaacatggtgaaaccccatctctactaaaaatacaaaaaattagccaggcgtggtggcgggtgcctgtagtctcagctacttgggaggctgaggcaggagaatggcgtgaacccgggaggcggagcttgcagtgagctgagatcacaccactgcactccagcctcagcgacaggcaagactccgtctcaaaaacacaaaacaacaacgacaaaaaatcagctttaattgaggtataatttaccaacaaaaaagtccaattagaactgtcagattagctgcattttgacaaatgtatgcagttgtgtaaacaccaccacagtcaggatatagaataagccagtcactcccaaaagtcccatcacggaccttttggaatctcctgcatcctgcccttaggcccaggcaaccacccacctgcttcctgtccctgcagtttggtcttttctagaatttcctaccagtggaagcatacagtttgtgtcttttgggtctggctttgttcacttggcatgatgctttggagatttagccatgtggttacacggaccactcgttcatccctttttattgctgtgtagtattctgttatgaggaaatagcagatgtggatttgagttttattttgttttgttttattttatgtatttatgtacgtatgtatttatttatttggagacggagtctcactctatcgcccaggctggggtgcagtggtgcaatctcagctcattgcaacctcggtctcccaggttcaagcgattctcctgcctcagccacctgagtagctgggactacaggcgagtgccaccacgcccagctaatttttgtatttttagtagagaaagagtttcaccacgttggccaggctggtcttgaactcctgacctcgggtgatttgccctcctcggcctcccaaagtgctgggatcacaggcatgagccaccgcgcctggcctctttgaattttaaaatcatactttccatacatgaatgttccgggaagctcaacctcatgtgttctgtggcttgcggggaatcacaccgcaaagacagaaacacccagatggctgggcctgctgagcctgtactgctttccaacagccatcctgggatctttcatctaaatagctctagttccctcatatctccagagagcttgcaccccacccccgaggcgttgcaggaaggaattccatgtgttccccgaatccgagcagcccgtgtctaagcgtcttcacagatgggcagttcttcttttatctagtctcaagctttcatgcttcattactattcttcccgctgctgatgaaatgaagctttgaagtgagggaactgcatggatctgaaggctcgaggaagaggatgacgggaaggcccaggagtctctcccatgtccctggttagacaaaaagctgcctgctccaggagctgatgttgtcacgacccacccacatcccctcgctcgctcttgtcacttcaagcgtgccacccgacttccccctgccagctctctgatttctttgcttagggttctctttgcctggcagggcagttttgcccacccgattcccatcgccttctccccccagggaaggataactctgaggctcacgtctgttcgacactggctcccagcgtttccccagggcttgagccccgttgcccactggggtagctgccgacgacacactctgcctggcttctcctgtgccctgacagtggttcttgacatagtctgcaaataactacctgcaccagaatccttgcctcaggtctgcttctgggaagcccattctgagccaaatggtagcagtgagcactggaggtctctggggccctgggctggctgctttatgcactgctttcatcagtacagtcccctgaggtgggaccgttcactgccatcttgcagatgatgggtaacttgcctgaagtcgagcacttagtgggtggccaagccaggtttcagactcccagcctctcccctacccacctccaccctgaaacaaacatattcaaatgcccgtgtgacccttatctggagtttgagtaaaactcttgggcttgggcgtccaaaactcagaattctgtctctgcctctgtcacagatgtgctgtgtggccttggacaagtcacttcccctatctgggctctatttcccctttataatctggagggactggattgtgtgatgtaaacaggcccctctagctctgacatttggtagaagctaaggttgaaggaggtgattttaggacaaatactaggcctccctatcttatctagcggggagtgaactgcagagttagcacccgcagacagccgggaggaaacgagaaagagccatttgaaggattcagaggaagatgccatggaataacaagggcagctccttgagggatgctgcggggagaggggtgcagacatccaaggttaaaggcaggaggggtcagtctggaacctccttgtcccttgctcctggtgggaagtgacccgggaagaacctggggtagcgggggctcccttcctctgtccagtcccttataaggggtcccttgggcagaggctgttctgaaccttccttcccacgaggactctctcaccaggaggtcacctcccctagcacaggggtggcaggacagggtggagggagagctaatgagccagagccatgttccctccgcctccaaaagcccagagcaaggcagagggaagagccgggtgaattatgcatgtgcctgttaatcacgcactgattaaaataattgtactaatattaattcttccagccctcttggaggagagggcagtgcctgttccctgctcctggcagtagatcatgcccagcagacctgtggatttgtaggatgctggctctctgccagtccctgggcatgccgctggatgtgagctcattgtaccctctgccttgtgaaggagggaaggcccggtgcctggcctggatgtctgaaactgcagaatgaggttcagagatgtcaagggccttaattacagacacacagcaatgagcctggttgggaatcaggcttcctgctccgcgggctgtcggctctgcctgcagggtgaaaacaagaaggattttcaaggcagtgtcacatggttgagctgcttttaggcagataactgcaggaggggacacagagaggcatcctagcttaaagatatctgacttgcaaatgacgagacacctggcttcatttttcagacacctgaaggcattgtggcaaagttaaggaacgatcacaggctctggggccaaacagacttgaattccagtctggtctcccccaggctctagccaagtgatcttgagagcaagacttttcctccttgaaccttaggggtcccatctgcaaaaggagtcagtcaagcccagaactgttgtcgagattaaaggatacaatctaataagtagggcatctcttggcacatagcagataatcctcgggagcagttttccaaggagtaagccttttcacactgatgtgccgttttcactaactggtatttaagagtatctgcgcccctgaccctgtgaccttcttcccaccatggaagactttcctcctcttccttggtgaggtgggaggagttccggggtctccacagagaatttagaatacagagcaattccccaaggaaacaatgttacaagtcattggtaaccacaaatgtaaataaaacgttgtcagctcccttggggattagggggctttgggggctaccctggggctttaaggacaacaggccagctgtgactttagcagtgctattagtagccttgcccactgcttattgagctcctatttgctgggcacttgacatacagcgcttcctataatttttctggatgtatttgaggttggtgagtatttttatttccccctttaacagatgaggacacagagtggtttaattccaggctaaagtttgccatcctcccagtctgtgcttttaaccatgactttattgtatccactgacactgtttatctgggaagatatattgcttgatccaagaagctgacttagaagtgaactttacagacagatccttccataagctaaagattgcatagactctggtggcctagagaatccagagtcagtaataatccaataatgggcactttctgaaggactcagacaacagggcaggtggtccagggtccaaggtttttcctttgccccgaaaagtccatgcagagccctgagcatgtacccagagatggctgagaaggactgtggtcgtgtgtggggatggggtcagtgaggtgtgtgtgtgtgtgtgtgtgtgtgtgtgtgtgtgtgtgtgtgtacatggttcttggtacatatgcataaacctatctatattcatgtgcacataaaacataaacacaggccattatccagtctcaggttctctctgatgatttttttttctgcagttgattattgccttgtcctgtctcttcatctcttatttcttattcacaaacacacttactgatgtggtgtgcatttccttaatttgcatgggtttgcatagtgcctggggaatgatcaaatgtctcatcccctctctccacttgaacaaggaattccccatttagagcaacgaccctgtggaagggggagtgggtgtgtttgggtgattggatcgaggaggtggcacatatatgttaaaaagtcatattcggtatgcccgttgtcttcaaaatatatcctatggcaaacaagcttctcagtgagtggagaagatgatgaatttggatctcctagggggtggatgaagaggcgctgagattggtgagtttatctgaaggggcaggggtgggatgcaaaggtgggcacgatggggcgagtttcttactttttttctagctctcattggccagtgcttaagccatcacatagatttcaatcagctgtaacagatataaccttgaagtgtgaggttgtcaggaaaaagaagaaaggaaggcggggaagtggggagagagagagagaaagagggagcaggctggaaaagagagaaagggagtgtcagacactgtgacaacagcgtcattccctccatcgtgtcctgttgacctgccgcaggccagccccaaaatgcatacagccaggtcttgcccaatcagatattctcgttatccccttaattattctttacaattaagctgtatgttctccatttacagaagaggaagtgaaaccataaagaggtcccttggccaccgaaagggagactcgggtttcagccgaatgtctttcttcctgagttgaaatccctgatccacctcttaccataataaccatgtgatattgaacgagttatctaacttcatgttgcctcagtttctgcatctgtgaagtggggataatactgcagaactattagggttgtataagccttaaatgagttaatgtacataaaatgcatagaacagtgccaggtgcatattaaatcctgtataagtgttagctattattctattgttattattctacgagcatagattgttcagttaaaaatcttgtccctccctctttctcccagtgccccttcctgccagcttctccttccttttaagagttaagccctggggtcggcttctccggccagcaagtgatgtcatccccccttccccttccccctaccccaccccagggtctggcctcccagaggacgggtctgtgcctgttttccagacccccaggcaggcagcagttcggggagcgagcgcagggatgcttattctccgcccttcctctctttgagaatctaagggcataagttagataaccgtgacacctgttttaaattagccttcagaagcctccgacagctgagaaattatttaacagggaaagaattgagttcatgaataaatattaatattaaatcaccacttccctagatttaagaggaagggtgggggactcaccaatagatggaggcagcaggtgtcctggagatgccactgtgcagggctcagagaagccagctgtggggtgggactacggagccaccgaccattggtcacctcgttcctgtccaagccgagaggggactctgtccatcagggaggctggcaggtggcagaggcaacatccaagcagctcacggcaactcaacaggtgctcgtttgagctccaaccttcccaggctgcggtcttagagggagagagactccacctgagagctgcccaaagcatggagcagactcccacccccatccctcagagaggggccactgtcccagcccagcctggccccattgtgactttcatgggtccagcactgttacctccgtgggcccctgcctccatgtaaaaatggtaaaatgtttattttatgaccacattggaataaagatgtattccaaagatgtaatccaggctggatttgtaattctatattcattattattttattcatttttttccctgattttaaaaggaatcaaaatgaaaacatattttgggccctgggcacggtccctactgggcctgatggaggcggcaactctctggctggggtcggggtgacggatgcttgagccagggaagcaggaactggtgaggaggggtcggcttgggggtgagggtctccaggggatggcagagccacccaagggatgtgaggatctggaaactcagatcccatcctttaggtccagatcacagattgaaattaagtaagaatcatcaatttctatgaataacaaaagtaataataatgagtatgaatgaatagcacactctgctttgactgtcctgacccccttggcattcttcaaaagcctccaagcaaaaggaaaagaaactgccaagcacattccaggctcagggccttcgccttagctctcctggcctggcatcctctttcctggtatttgagtgactcgctctcccttcttcttgggtcaccatcctagtgaggttcttcctggcttttggatcgaaatagcccctctactccctttatccactgttcttttcccctccttaattttctccatagcacttcctgcttccttatattccactgcgtgacacatggaaacatagggtataatagaatatacgctgcatgtggcgaggtgtagatgtttaccaggttgtagggactttgtttcattcttctttgtgcacttagcatctagaatagtgcctgccatgcagggtgctcaaaaaaccctgaatgaatgaatgaatgaaacatgtctggcacatacatggcagttacaaccatctttgtgcctagcgctttgggttgctgagccctcagccttcagtgaggaggtattggccttcttccaccattgcagagactgaggcctggacatacaaacaagcatgccccacagtcatacagttaaggtagatcaatagcttccctggataaaacaaagtgtagacaggtccaaggtttgagcaaaaaagtggtttggaaggcgcagttatggaaggatgagggaataagggggctgatgatttcccttcctactccaggttcagcatttcagtttctgtctgcaccagagccttctaggctctttgttggaaactgtggatgtcacactatagctcatacttacttatacagaatttaatatgcacctggcactgttctatgcattttacatatattaactcatttaaggcttatacaaccttgatgagttctgcagtattatccccacttcacagatgcagaaactgaggcaacatgaagttagataactcgtttgatatcacatggtattgtggtaagaggcggatcagggatttgaaatcaagaagaaagacattggagttggggacactggtttaagtgcctgccctgcagaacctaagcagatctgttttcccctgggcctcagtctccccctctgtaaaggagggaactgggccacagtctgtgatccctgcatcgggcagggctgagtgctcccttcttctgcatccaggcttcccaccagggaagggaatgagccctcctccttgctgcctcccctcctcctagtccccggctcagggcctgatgcctgcaggtggtggtggatcctcggtcgtgcggcggatgtgttctggcatcatttaacacctgcctcatatctccgaagccccatcctacacgtagctgtgagcacatagctctgccgaactccaaatagacataagccactgccctgctcggcttcttgtctaattatggctgcgacattgatgtgacagggtgcgtttaattacaggaccatgcacactgacccaaacgctgttttggcccagaattttccagcttgagcagcccaaacgctgtgtgtgatgataataataaggacctttagattgtgctggggattaaatgagataatacatgcttctggcagggagcagggcaccagccagtgacctgtggtcaggtcccagctcctccttccccttcctgctcctgacatggatgcccactctgcctagccatgccctggaaagacacccatcctatcttggctaggcagaatgtcagctctgtcttttttgaatttgtcctccaaggatttgcagaagatgggaacaggggaggccttctgaatatagtgactcttctcccagctcccagaagcacatctggcttggcagcatctttgggccacccaaagccagggtcccttggcccaggcagcatttgggtcagtgtgagggccttcagtaagcacacgttcccatcttgacaccactgccatcactagataagacactgagagggacggcgggctgtgttcattttgtgtctgatgagctctgctataaaatgaggaaagcagttcagagaaattaagcaacttgcccagagttgtccagctaggaatttccagagctgtactcagattcagaactctgggtgactgccctatgccaggcacccccatttgttagcctttaaatgggatctgaaacctttatttatcgggacaagtcctgagtgtccagcagaccaagctttccttcctttccttccaccacaaagtggaaagtcttgccaccacttctgaaaggtgtcttttttttttttttttttttttagacaaggtctcactctgttgcacaggctggagtgcagtggcgtgatctcggctcactacaacctccacttcctaggttcaagtgatgcttccacctcagcctccccagtagctgggattacaggtgcatgccaccacatccggctaatttttttgtatttttagtagagacagggttttgccatgttggtcagactggtcttgaactcctaacctcaggtgatccgctcacctcggcctcccaaagtgctaggattacaggcattagccactgcacccgacccccagaaagtgtcttttgagggtaacttgtttcttcttttcctgaacctgtggcatatgtcacaactcttagcagctgtcccagcactggttcttttccctcctggcagtgaccagagctgtcattaagtgactcattgtgagagcagagactgtctctgtcaccactgttgaatgaatgaatgcatgcatggatgaatgaatgaatgaaacatgaaactctttcctgagttctgtcctttcattgctctagcatgctgccctctgagcacttcccacccctcgaggggggtcatccgtataggggtgggaacagagccaaggtgcctaatggggtccgaagcctctccacctggtgaaattgcctgtagattccatgtctgtgtctgtccacttgacccatgctccaggccccgctgccctcatctctcgttcccctgatgaatcacacgaggcctggtgacacagcatcatcactctccttatccagcagacgcgacatcaccctccttcacccgctgcaaactggctgcccaggcattacaggaagccaccctgccccctcctgggcctggctgccctcgcctctgtaatatcctttttctaatagagtgacctgaaccctatgtgctgttctaaaagcagcctcagaagcccctgagacaggcagccaggtaattcccctggcggaggcacgatcttaccttgccctgcatgtctgaacctgctggctggctgaagaatgtccgttttatagaatataataaaataaaacaggttcattccacaaattttgaggcaccatctagctctgaggtttgggggctcttcctttccattaagttgtaaactgcatgagaactggaccatgtctgtgaatgggtgaattttattttatgtaaattaaacctcaaggtagctggtaacaatgaatgcaagtagataggatatatggcagctgaaataatattccaggaacaatgataaccttgtgcatctggtacccatgaggaggaggtcagaggtgagcctggaaagctggcacaagcccaggtcatggatagccttgagcagcatttgacatcatgagatacgtaacagccatcgctgtgtaacagccagcccaaaactcagtggcttaaatataaccatttattctcctaccacagatttatggtgggtggaggtcagcttgcgtgagttgggctcagctgggccatttaagctgctggtccagctgggcttggctccagatggtgggttgaactgtgtagttcattctgaggtcccagctgagggagcagcagctccctcgggtggcgggtggtgcggggggaagctcttcttgtgaagggggcagaaatgcagaagggagggtcccactgggcaagcctattccaagccattgctcaaccgaacatcccattggctaaagcaagtaacatgacaaaaccccacagtgatgggatgaagaagtaggttctgcccacagagaaggggagaagggagtgggtatttgccgaacaccagttcaagcattcacaaggtaacacaggatagtgtcaagagaataggttctggagtctgggttcacattttgatattcatcagccatgtgacttcaggaaagtaacttcccctctctgtgcctcaatttccccaccaaaaaagcagatatcaaacatagcccattcaatgacataatctccatccagccttctagccttgggcttctcacagagtgagcacttatgtccaccatgatttcaaagatgatgagagatattccaatttcctctttgttatcctttctggttccccgcatcctcctttctttctgctgggccaaaccaccctcccttctccccctccccagggcctccactctcttcaaatatttggaaacgtccctggggtccccagtctcggtcctggttaagccaagctacacagatttcgttcctttaatctttcctcgtaaattaatccctctgaacctttaatcattttcctcgaatgagattcaaatgagacgcttgtctggactcccaccgcacacgggctgcagcctggtgacagcctgtcatgctgacaggtttcttgccctttggggagggtgcaccaagctgccccagagataagaagattgtgggtatcaggaactcataccaacaaaacaacccaagcttttgtgggtatcctgcctctttacctgtgtgtttcctgaagtaggaatgggtggttgatgacgtgcaccctccctcccccagctcctcttgtgacccactggccaccagttatcccttatatggaatgtgtgccctgtctttgtacttggcatgtcaaatcctcacgatctccctgagaggtgagatgagacaatagtaagaccgtgagttcaaatcccagtccagacacttctgagctgtgtgaccttgggcatgtgtaacttaactgttttctcacctggaaaatgggttcataagagtacctgtatcatagagttgttggaagaatacaagggacagcttcaagtagtatttggcacaatagtatttggtcttgatgaatgttggttgttgtaagtcataattactcatgcatggcagatggagagagtcattcagagaggtgaggtgagctgcccaagttatagagatgggattagaacccctctcttaatgtaggtccaacactctggctcagcctggcagaaagggtgcaagggatccccgcatagtgggacaatgagtgggatccacagacctatctagggactaatggaatgtcagatacacgaacagcttgtccttctcttagtctctgggttgtgggtttggaagctggctgcttgtttctattaccttctaggaaatatccttctgactgatcttcaagtggtttccaagtattaaagttaatggttgaggagaaacactggaacaaaacatattccctcccagagttccgccaggcagcaggatccacatgaatttgtaattcctaatggcatcactcaggcattgctcgggcatttaagctgcaggttgtgcagcctatagacagctggggtattgttacactgggcagatctgagttgaatttcttcttcctaattgtgagagcctggtgttaaagatagattttggagtgagacttcctggctcagaatcccagctctgcctcttactctctgaccttaggcaagcaactttacctctccgtgcctcagtttccccatcttggaaaaacagggatgataataatagcacctatgtcatagggttgctgtaaggatgaataaatcaaaatgttgaaagtgcctctgagagtacccagcacaggagagctggtcatgtgtttgttgctactgttgttgccatttcactgtatccctgcagctgggcaagtcattgcccctctctgagcctcagtttctataaaataggtgcactggtccttgtctcccaggagctgggtgagaatctggtgaaataaagtggtggaaagtgcctagccaaatgccaaagcgttatgcattttgagggattattagggggatggcaacataagtgtgagtggcagtgaggtgagtgatgagctgggctatttaaatgagaactttgaagctccccagaagcctgtattccctgtcccccagacacttgctgtgttggaatatctcgtagttttccactttccacctgggagactgatttgctcaaaattggcttggggagggcaaagctcttagggggttgagcacaaagggacagggaaattgtaaatcttgcccccaacagtgagttgctggatgattgggaaatggattgttgaatctcaatctctctgtctcctgctcttcctccctcctctaaagcaattgaagaagaagatggataccatctgtctcaaagccgggcacctggaaatcactcctcatacctccttcttcaccctccgtggctagtcagtcaccaaggcctagaaagatccctccagaatagcacttggagtgacccaatctgtttccctggctggagagcccagtggctctcccctgaatgtctacaatgacatctaactgcatctcttacctcctttcttgtccttttagaatccactctccaagtagcagcttgcagagtatttaaaaaacactcatctgatcgtcccccaattctttgttggcttcccttttttaagaaaaatgttcaaaatcctataaagaaggacctgtttttaccttattttgcagagggggttcagtccaacttcagtggctttgcatatgcctttcctgccccctggaattctcttccctcctctcatgatctccctgccctcacctaacttccctggggtaacttctgctcattcttcaggttcccgttgccttgctcactgatggaggccttcctggctgtgtctgggatctatgctctcatagcatcctctgtctttcttcaacacacttatttttgtaaccatcatccctcctgtgaccatcgttttaacctctcctgggggagtggtaccataaaggcaagctcgggctgctataacaaaatactgtaaactgcgtggcttcaactatagattatttttttttttctcacagttctggggactaggaagtccaagatcagatggcggaagatttggttcttggggagggctctcttcttggcttgcagatggctgcctacacactgtttctgaatatggcagagagagagatacagagagagagagagagagagagaaagagcgagtgagcacactctgatctctctctcttcctcttgtcacaaagacactaatcccatcataagggcctgtattagtccgttttcactctgctgataaagacatactcaagactgggtaatttataaagtaaaagaggtataatagatttgtagttctacgtggctggggaggcctcataatcatggtggaaggtgaaaggtacttcttacatggcgacagcagcaaagaatcagagagccaagcaaaaggagtttccccttataaaaccgtcaaatttcacgagacttaatcactacaatgagaacagtatgggggaaaccactcctgcgatccaattatctcccactgggaccctcccacaacacataggaattatgggagctacaattcaagatgagatttaggtggggacacagccaaaccatatcaggcaccaccctcaagacccatctaaacctaattacctcccagaaatcctacctccaaatactgtcacattagggattagggctagggcttcaacatatgaattttttctgggggggtgggggagacataaacattgagtacgtaacaggcagttatgttcctctctggaccactgattctgagcacagtccttggtagtaagcggacactcagaatgtttgttaaatgaatgaacaaatggataaatgaatgaatgaatgaacaaacaagtgaatacatgaaaaaaattatagtcctgcttgaacattgaatctggaggtcccccctagattttggaggaaccctgtgaatccacgtatgcctcaagaggtctttgtgacaacaggggaggctggataagacactattcagcaaagactctatcttttcttagcagtgacctaactggtagcaaagttgtggcttgctaggatattttgactttttctgaaacaaaaataaattttcgaaaaagaagaagaggaaaaagtcacgtggaactgctccgatctcccagccatgaaatatccctctgggattagatcccctgctgtgaagtattgccccatgattagatctcaagccatgaaatataaccatgaatttagatctcctccttggaaatacagtttgctgattagatcgcccccataaaatatggcctttgggttagtgcatgccagtaaaatatggcctttgattagatcaccgcagggaaggctgaggtgctagctgagactaggaactctcaccacatcctcacaaagtaaaatataaatatatggagaggaagagaaagcagaggaggtaaattaataacggtgacattttggaacttggactttcttgaaggttgtcagcgtgagggaagggatggggacagacctgggcgtgtagactccttcactgggtaacctggtgctggtgacagctggtgtatgaggctccctgtgtacccagaactgtgcagagcacttcatgtgtgttagctcctctagctcccaagaggaaggtgacattattatggtccccatatacacatggaaattgaggcacagagaagcaaagtcagttgatcaaggactcatagccagacgtgtcagagctggatttgaacttggcccctctgccccttgagcctttacccttagccactgccctttggttggcccagccgatgccactcctgacttgcggtgctagggcagtgtggctcccacaaaccctctgctgctgcaggggtgaggagtgaggatccttgtgagagtcagagatgagctggcactgcccctgggctcaccctgggtgaggaacagaacagataatcccagagtcagagcccagggaaaggccagggaggcccttccccacacttaacaggaagctcaggcccagagatgggcagtggcagcaggcccaaggcctcatagcggggtgccagcagatccagaccttgaagccaatgtcgcccgactttggggcaaacatccccttcttgctatgtagttctctctctcgcttgctgaaaggagcagaaaactaaatttggatcatgagtttattcagagagatggcttagtgtcatcacctcccagctcacttagtaatcatgtgagctggacattgtgctgggcaccatggtgcagccgtctccaacctttttggcaccaggaaccagtttcgtggaggatgaatttttccacagaccagggcaggggcgaaggtttcaggataattaaagtacattgcatttcttgtgcactttatttctattattattacattgtaatatataatgtaataattatacaactcaccatgatggagaatcagtgggagccctgagcttgatttcctgcaactagatggccccactgggggtgctgggagacagtgacagatcatcaggcattagattctcataaggagctcacaacctagatccctcactgatgcagttcacagtagggtccgtgctcctatgagaatcgaatgccgctgctgatctgacaggaggtggagctcaggtggtcatgtgaacaatggggagtggctgtaaacatagatgaagcttgcctgccattcgcttactgatgtgtggcccgtttcctaacaggccatgggctggtaccggatttgaacttggttcctctgccctggagcctttacccttagccactgccctttggttggcccaaccaatgccactccaggcttgtggtattagggaagtgtatggctgctgcaggggtgagaagtgggggccggtaccagtccatggcctgggggatggggactcctcccttggtgggccaccctcagccctcttcctggacagagaccctgctcacagctgatccatgtctgggaattgcccttgaaggtcaccgccagacccaaggtgatgctctccagaggtggcccccatctgtgctgctggatgaggacacaaagccctgcctcttccctcaattcagggaaagctggtctcagcttcagagctcccagtggatccacagccagctccctctttgcctggtctccacttttctgcagaagctgtcttgagagtaccgcaatctcctgcacacagctgtctatctcatggtctgtttcctaagcatagttgtccctctgcccctccgattccatctgtgaaatgggaatggaacacctagccagaggtagtctggaggcaagcatgccagtgtgcgtgtgatgtgtgcacaagattcctggcacacactaagtgttcataaatatttgccaaaatccctgccaggtcatctggagctgagaaagtcacagagaagggattcttcacctctattcatctgcaacgtggggccgataagcctgtcttatgggtcattgtaaactctgctgggcagtgctggggacagtgggggtgagtggttcctcctcagacttcatctctggtccctctttctttccctgcagggtgctcagtgaaagccccgggcagaaggctggccacttctttatctcacaggagccagccactggccagctgttatcggggatttgtgagcttgtaaaacatggccagctatcacgccatctccccagggcacagtgctttctcggctgggcctaatcaccgggtgatcttggcctgtgattgaggggagagctgggttaccctgggaaggcagcagccaagtcctctggaaaaggctcgggtgggtggaggagctggggggcatcagggccaggcctgctggggctgacacatcgctggaatggaccatggcagattccatgccccactcttccttcttctcttccctgcagggagatggtagagtgtggggggaccctgcgaggctccagggacccagaaggagataattccagaaaaaacattcagaactgcatcaatgtcagtggccccctcacccattcctcgttaagcacccactcagtgccaggccctctgctaggctatccaaagtgctggactttgctgtgtgacctcaggccagtcacttgccctctctgagcctcaagtgtccaataggaataatagtgcccgtctcaccaggttactatggggatcccttgaggcagtggatatgaaagaattgccttacaaactgtgaagtcctgtgcccataaggatgagatcaaaggataagcctgcatgtggattacacacctagaggaatggctttagagggatgagggacatctcagggggaccagagaaggactcccggagcaggagattatgtgaggctttgctgaagactctgggggaaggaggggttgaaatagagagggcattccaggcaaagggaatgggatccatacggtctgctgggcaggggatacacggggtgtgtatcccctggcgcgggagcacacggcttgagctgtgtggatctgtggcaggcttgcgggttggggaagccgggcccatctggctctgtttttctgctgtcattttggatgcttttgtgctgaattccccttttgtcactgtttccctgcgattttcttttgaacctggcatctgtttggggcttcatccggtccctgccccctgcgttctgaggctcagatctgtttgcaacctgggcatctgctcttagggcagtaggtggttccggctgcctcagcaggtctcagagccagggtccgggatgggtggggcaagggcagatctttgtggaaggcgctggccctgcctgacacaaacatgtgacatctgccctcctgagagtccagtaagaagctttcttcctccctccagccctcctgggccggggagggctgccacgctctgtcatgcacacctgtctcccccaccaggcttcagatggcagaagagcccagccttccccagcactggctttggagccacgcaagcctgggtggactcttggcgctgcatttaccacgtaagcatcctgagctaaacctccagaagcctctgtttcctgcctctgtgaaatggggatcatgctcccactttgtagtaccataaggatgcaacaagatcagtcttgtctaacaccttcttgcctgtggtcagcagactggggcatgaacacggctctgggccgggtctctggagtctgtatcttggttctttcaaggcatattagtgaatctctccctgtgcctcagttttctcatctgcaagatgggaataagacctgcttcatagaattaatggaagtactcgagtctgtatatctgcaacatactttgagggtgcctgaggcacagttagcgccatgtgggtgctcacattgtcatccctactggtgttgtcctgtgacttcactgggacccatagagggtaaggccattgccaggcttgcagctgggcatactggggaccacaaggttcagcatatgcaccgggatcctatggctgagctaagatttgagtctgtgtgctgagggctggagagcagtgcagaggggtgatcagaaggcctgggttggcatcgttcccctgcaatgaattatcttggtggacaatagccagttgcttccatactctgagtttaattttggtttccttctgccagaaaattgggataatctccctcctgaagtctctgtgagaattaaacaagaaaataaacgtgaatatcctttgaaagacataaaatgcagtgggccgattcaattcgtttattcgacacatattaattgaatatctactaagtgggaagtgcagccctggcgctgaggatctggggtgaataaggcaacactggaatcctggtcctcacaggccttcactccaaatgggcagcaggtagcaacccccaagcagagagacaagcacaccaagttcatggggctgagacaaggggaaagagaagtggcccacagggaagggggtgagggctgtgtccaggggcttttgaggaagggcatttgacaccgacagctgagtgaagaaagaacaagcccagacttgtggggccaggggtagtaggcagagggaagagcagcatagaggcccctgtggagaaaagaggcagtgggagagccagtgtggctggagctgtggtcaggggccagtgcttacagggccctgtgggccaaattcagaatctggaatctagtccaagggagacgagaaccatgggaatctgtattagccagggttctctagagggacagaattaatggaatatatatatatatatgaatttattaagcattaactcacacgatcacaaggtcccacaattggctgtctgcaggctgaggagccaggagtgccagtctgagttccaaaacagaggaacttggagtcctatgctcgagggcaggaagcatccagcatgggagaaagatgtaggctgggagtctaggccagtctaaccttttcatgtttttctgcctgttttatatttactggcagctgattagatggtgcccatccagattaagggtgggtctgccttccccagcccactgactgaaatgttaatctcctttggcaacaccctcacagactcacccaggattaatactttgcatcctacaatccaatcaagttgacactcagcattgaccatcacagaggctttggatggggcagggatggacagggtgggtgtttgtctattatatgcttatgtaacatacaaatatggtttagcctacaatggaacaagctgaaggggagtttccccctgagtgtgtgtctgtgtgtgtgctggatgctgccacacttgaggacattcaggaatcagaaaagggttggactagtcagcctcagtaagccctgtgacctggagattctgtggttttatgaagaaatgatcatgtgggctgtttcctaagtccccagagagtgaaagagtgaatgagtgaatttaggataataggaatttaggatgtgactggatgtgagagacgctggagcaaacaggtcagtaggggaagccactggaattcccacttccacaaaacagcagttctctgcttttggtaaagggaagagaaaggagaccctcctactgagttaaaaagggaggagagcgaacatgtttcatgcaggtaccatgtgcaggctctgtgctgaccattttacaaacaatccccctttgacccttattatcttagcttcctagggtgctatgacaaatgatcatagactgggtggcttagaacaacagaaatgtattcctttgaagtttggggactggaaatctgagatcaaggtgtcggcagggccatactctctctgaaggctccagaggaggatcctttctgcctcttccagcttctggtggttgccagaaatcttggtgttctttggtttgtggatgccttgctccaagctctgcctctgtggtcacacagccaacatcttcctgtgtgtctctgtcccttctcttcttattaagaccccagtcatattggctttagggctcaccctcatccagtatgactgcctcttaactaattacaactgcaaagacctatttccaaataaattcacattctgatgttccaggaggacagggatgttgtggggttcactagtcaacccaggagacccactcttttgacggagtgataatgtcaccctctgttctcagactgctaataaagacacacccaagactgggtaatttataaagaaaggaggtttaatgagctcatagtttcacatggccgaggaggcctcacaatcatggtggaagatgaatgaggaccaaagtcatgtcttacatggcagcaggcaaaagaccttgtgcaggggaattcccatttataaaaccatcagctcccttgagacttattcactgccacaagaacagtatgggtggaacagcccccatgattcaatgatctccaccaggccatgcccttgacacatggggattattacaattcaaggtgagatttgggtagggacacagccaaaccgtatcacgcccccacttcacagagcatccagaaagtaaagaaacttacttaaggccacagagctagaaagtagcaaagctggatttgcacccaagagcgtctttgatgagagtcttcactcactctacacagccaagctgtctccaggggatggaatgtcatgccagcctcggaacagcacagggaacttggggtgctctgggtgccatcgatggattataacggctggagcaggcatggagacaggtcagttgaaatgaagttggaatgaggatcagaacaggcttggaggggcagaggaaccccttcttcctcttccttcttctccactttctggaaccttctgaacctagcacagagaccaccatcctctaacaccttcccagattccccggctctgtgtgaatgtgttcccttgctctgagctgcccagccctgttgtctgtgcctctctggaatgaattccattctctttgcacctggcgttctctttggacctcctcaagaccagggcttgctcttttctcctgcattccctgcacctaacacaggcagcggcacacaacagctacactgcggattcactgattccacaggagtttttaaacacaattatgtgttcaaagcagaaaacacagaccggaatgaaatgaaagacagtctggtggggaccaagactcataaacagatgctggtccctagggcagtgcatggcaatagtagagcccagagagaagcctggtccagactatggtatgggagggaggcagagaaggcttcccggaagaggcagcagccagcgcaagtggcaggtgcagagcccttgggcaaaagcgagagctcagccttctggaactgcaagcagcttggtgatgctggggggttgtgtgcagagagacttgggaagggaaaatgttgatggagaggtccacatgaagaggctggggcttcatcctggggtatcccttctcttgagattgacagtagggttgaggaggatttgaagagtttaatcagggggctgaatgtggtcggatctctgtcagatatccagaggctggaggcagggaggccggggaggatgccaccttataatccccgagaaagatgccagcaggctgaatggatttggggttacagggaagggaggagtaatttgggttattactaaatgctcgttgagctggattctgtattgacctgcaggactccatctgacctaatggcagggaggagaggccatgccttggatacttcctgagtccctgcagggcgcgtctgcagaatccaagtgtgcagtgtgcagccaagagctcaacaaccaacatacttagatgtcagcaggagagcccagggtctgtcctcactgccaaagcttagcagggggctccacagggtcctgaaggtaccccctgaaaaattatccgtgtcaaggctgacctttattgagcactgtctagttgacagagtctgttagaagtgctctgttttatctcatcagagccacataatggccccatgaggtggtgctcttcttatatctgtttgatagacgaagaaactgaggctccaagcagggaagtgacttgcccaaggtcacaaccctaggcagtgacggagctgggacttgaacacatgatcttgagcctctcaagcccaggcctctgctgccacctctggaagatgctgttttcccaggaaggtgatatctccagtaagacacccttctatgcaagccacagagacaagtgggggagccgccccgtgcccctgtccagatgagtgaaggaagacggacgagctggcttcctctcttttcccggcttcccggtaccaagtatatattttttctaatcggcccggctgctgatggttatctggcttcgctagagagcgaaagagactttgtgtcaaatgctgaaaaatgacttttcaggcagcctctctgtctcctgaaaggaggtgacgtgctcagagcatacaaatcactcagcattcgggtgtctcgatgcgaggaaggagtgtgtttggattgctaaagccactcctgtcccttcacaaggtcatgggcgggcaacccagtcttgtcagtgcctggagagcagagaagcctggtgctgagaggtgctgtggcccccagatggcaagcctgtggggtgtctggacccaggaggggtcccttggatgcacaaggtacaagagtccaagagggaggctgacctcggattctaggtctccatcagcccacagtaagctgtgtgaccttggataagttacttaacttttctggtccttggaaatctcgctccataattatcatcccacaaatgctgttttcagctaagccattcaccctgctggatgttctaataactgcatttgtctggtgctgacaaatcctcagtgattcccaggcagcagaaacttgcctggtacctacagagaagtcactgggtgtgaaggacaaaggcagacgttggaatgctccagagagggccttgaatccaggctctggaggcagcctgtgggttcaaaccttggctctgccactcaacagctgggtgaccttgggtatgtgactttatctatctgagcctaagtttcctcatctatcaactggggaaataaccaagactacctcatattggggctatggtgaaagccaagggcttagaatgatgcctggaacaagagtaagtcttcagccagtgtcagctcctgtcactgtgactgtgtcttagctgtgctgacgtggccactggcttctataagaatccagtggattcttggaaaggtgtcgtaacctctccaaggcttggtttcttcatctgtgtagaggggatggggatttaaaaattcaatgtgcttaaaatgcttggcacacagcagtttcttaatcacttgtagacatttctctggctctttgcagaaagatattttaaataaaatttcagttttcaagtgtatctgatattttgcaatcctttgaaaatttataaagatgatgtacacagtataatctgtctcgaagtgaacacggggttgactggacaatgccattttctgagtggccataccagagtaagagcccactggagatcagaacttgggggagagtgcccagagccagctccagggagtaggacctgcccaagtcataagtggcagctctgggtcctgcctgcctctcttcctgagatgccatttatagctgccgggacccacatgggcccgtagggtggccctgcccatgcagagaggggagcagctgtcattgtaagaactgagtgagcccaggagccaggctcccagggtgccaagggatcgtcgtcattcatctcccccgtttttattttcttcactataaagcatagaaaaaccacgtagccagaccttaaaaaatacagacggtctccagatgagtctgtgatgttaggcaaggcctgccaggcgctttcttaatgctgtaataaaactggctggggaaaaactctaaaattacggaggaggccggcagtataaaatgtatgggatcaagagagagagagagagcagagtattgcagcagttccacactgggccccaggtggaactgggctgggtcatccgatggcagagtgacgccacttctgtcaccacccccctggccctactttactgctggggtgttttgaggatctaataaggtcgtgggagtaataggctttgttatttacaaataattcgaataaaaggacaataggaagacctctcccctgccccctctgcccagatgcccccccaaagcaagacttcttgatggtggcaggttccatgggccagatgagggtggccccctgggactctctgtctttctcccctgcccatctcactggtcccccttccccagcgggccttggactggggtgctttggtgcccgtaaatgggttgaatgaattaggcccatgtccttctaaagcaaacttttaaaaaatactcagttttgcaaggccccccggtacattaaacagatagaagggagggtggctctggtgaataaagagtgggttggggcccctgcacccatcagtggcgtgccctgagttcaaatactgtccctgccactcaccacccaggggatgtgtttcagtgtttcgacctctcccagcctctatcgcatcatctgtaaaatgaggatagtgctagaactcacctctcatggtggagattcagtaagacaaaagatgcacctggctcagagtaaactcctcagatatccccattacaacaacggctactgtgatttgactgctgttggatacacggacatccaggcgcccctcggatcctgggcaccggctcttgaagtgccctcacagaggccctgtcaatccaggcatccgactccacagttctcagcttcccagccctggtgactccactgcctcctctttggccatctgcatgtgcgtgatgggaagctgtgcctgtgcctctcctcggtggctgcggtaatagagcccagagtgagcaggtggcagcccccctcccccttccctggtctccctccctccctatctctcacctcggctgcaaagctccgactttatttaatcgcttccattgtctgctccacgcctggtaatctcagctgggaacacatgttaacaaatgggcaaagttttatcgggagctcagagcccctccccgcttcgtcagataaggtgctcttgcttgggggctcacactagggaagctgctcccggcccccccctacccccgtgagaatccatccctaggcaattgcattgtgtgagcagggtaacaggagggatgggtaggagcgggtccaagggggctctggggatccagacaaagaccccaagcccctgctccttccccactcatgggttctgctgcttctcctgctggctggaagacccttgagattctgcccattgtgggacagtgggaaggcttgccttagttcttggttcacatccgggctcttgcgtcttcccaactgcatgatggtcacttccattctctgcatcttggtcacctcggttataaaataagaaacaagcctatctgtctcctgacaaagagagtttaagtgaggttatgtgagtgaaattatctagggaaatgcctggggcttagtaggtagacagcgcccccctttgcttcctacctgaattagtttcctaggactgctgtaacagtgacttaaaacagcagaagttattgtttcacacttctggaggctagaagtccaagatcgaggtgtgggtgggccacactccctctgattcctgcagggaataatccatcctggtgccttcctagctgctggtggctgctgcaattcttggtgtttggtgttcctgggcttgtgcctgcatccctccggtctctgcctctgccatcacgtggcctgctccctctgtgtctgcttctgtgtccaaattccgctcttcttataagaacattatattcaattcgggcccttcttcatcttaacttgattatgtctgcaaagaccctatttccaaatgaggccacagttacaggtgtagggcttaggatttcaatgtatcttttagagggatatagctcaccctacaatgctaccttttggctaagtcttcctaacttgagtggccgggatccacgttgcccttggatcagcctctgtcactgagctgaccctgctttgagtttcacgtgatttatgtcgttgattttaccccagccccatgaggagggataatgaggaggggtccacctttgctcttctgctgcgctatcctgttctgtgctagggatggatgtaaacagataatagtgtttacatgagacaggggccacactagggagataagcatttatggaagcaaagatagtgtccctttctcactaagtggaagtgaaaataggaaggctctcgagagacccactgagctggtcctggaagggtaaagaaggcattctgggtagaggaaggagcttgagctggggactggaggaaggagcgcccctgagctgtctcagcatgggtgagcagccctgggagactgagtcagggactgagcgcgtgctcagggaaggatggagctccctggaggtcaggctttaagggcagccgggctgacactcagaatggccaggctaagaagtgcagacttgattgtgccagcactggggagccagtgaagattgtggaactgagacatggtaggagcagaatcgtggctccaagggctaatccagcagcaaacacatttcaaagtttttgctgaaggaaagcctcaccacggagggacacaacgagcactggaatttcaaggagctgtggaagtctatcatccagaaattccccagaggaacctctagcctggctggatggacagcacccatgtcaactcagcctcctggtcctgattcctccttcacgctggtgagggacaccaggcatggccccaggatatctgggagctgggacccacctgctctcccttctaagggaaatagcaaggaacaggtatctctggactttgcctcctctgccctctcattggggtgtgtgtcggggggtctgtccgttactggcatccctctcccatcccatgccgaagattttgacctttatagccaagtctgagctgtactgatagaacatccacaaagtcaacagtgggaaggttccacaggcccaagcatcccttcctgtgccttacaagtggaatcatttatttctgtcctctaatcttgattaaacccatctgaaaataagttagatatcaaatctgtgatttcagtcctccctccgttcctgaccctcttctccctctagttgccccaaaagtggccagttttgttcaggagagcaccaagcacttggaaaattccattcccagccttcccagctcatttctgcttccacgcaccctgctgcctcctgacagtctcacttttaactctatttacattctggaaagtacataagatttttatcatgtactttcctaatgtcaattttcccctgatgagaataaggctgtaaacacccatattttcataagcctgttatagtcctccatgtattcaaagtcgatgagcaatgcaatctcacattctcagggctggctgggactggcacaggaggacggctcaaggcaaactctgggagccaaactcctaggtgtcttctttgtctttccttgggttaccaccttcattacttttgggggcccttcttttatgcctaaatctgggtgttccttctttttcacactgctataaagaaatactcaagactaggtaacttatacagggaagaagtttaattgactcacagttcctcatggctgaggaggcctcagaaaacttacaatcatggcagaaggccaaggagaagcaagcaccttcttcacagggtggcaggagaaagagagagagagagagagagagccaagggggaagagctatttgtgaaaccatcagatctcatgagaactcactcactatcatgagaacagtatgggggaaaccggccccataatcccatcacctcccaccaggtccttcccttgatacgtggggattacaggttgagatgagacttgggtggggacacaaagccaaaccatatcaatcagtatatctatttttggttggaaccatcaaaacctgctagactactcttaagctgtgggaatggacaaacaccaaaaatggcatccagagaaggcacagactatgcatcccctaaaccttgttatcccagggaaaggtgccatgggcctggtccattagacccatcccagtcttggctttgggtgagggacaccattcgtgacactctacacacttctaaggaagttgggagtggccaggctgcatcaggctagctgggtaacactgggatttgcaagcccctgagcctctgggtggttgagtgggctttctctagaggacatcacaactcagttactgagacgttttcttatcaatctagttttactgaaacctcatggtccttcctgctgagcccacttgttgcaaggctaggtggggaaaggctccagggatgctgcaacaagcaggtctttgcctcctcaagtctagggacatgactggctccacctctggcccttgataactaattgtttttgttttgttttgttttgtgttgtttgagaccgagtctccctctgtcgccaaggctggagtgcagtggcgcgatcttggctcactgtagccaccgccatccaggttcaagcgattcttgtgcctcagcctcctcagtagctgagactacaggtgcatgccgccacacctggctaggttttgtatttttagtagagacagggtttcaccatgttggccaggttggccttgaactcttgacctcaagtgatctgcccgcctcagcttcccaaagtgctgggattacaggcgtgagccaccgtgaccagccccttgataactaattgttaatgaatgaatgaatgactgtttgtatatccttgaatctgaagtcacttcattcaccagaatgagagcagcagagtctgctatgaaggggaacaggtggggtgggggcgagggtggtcagaatcctgcctccagtattagttctttctaagcctggggtcagcacattttcctgtaaagagctagatggtaaacattttaggctttgtagtccacagggcaaaatcgaaactgttatgtgggtatttgtatatcatttaaaatgtaactatttataaatatgcaaatcattcttagctggtgggtcctacagaaacaggctggccaagatttgatctggggccatcgcttgccgagagctgttctaagccttgtttcctttatctgtaagatgtgaccaacctctgtttctgagggtggttgtgggtattccatacaccagacagaatgtgcctggcagcgcttagcacatggtaacaccataatcctaaaagccctatgggatggagggcttactcccaggcactcctctgagaatatgaactcataagctcctctgaccccataacataggtactgttcggtctccattttacagatgaagaaactgagccttagaacgatgcagtcatttgcccaaagttacatgttggttaaatggcagagctgggatttgaacacagggactcagacttcagagcctgtgctcgcaacttcagtgatcagcagctgcagtagtcattgttgctgctgttaattatccttctcagggatccaaaggaatctaaaacgagccaggacaggaacactgccagaaaatggatgatacaaaaatcttccttctttgagtgtggcgtgcgctgcttggttttatttggccaccagttcacctcttgggttaccatggcttgaatctgttggtttgacgtctctgaatgtgtgctcagaggtggaggggagatgaaggggagaggggctagagaaggctaggtcaagtaggagggccatccagtttacaaacacacaaggcagtgtgtgtctgatctcccttggagcatgacagctggcttctctcagtcctggaaagagagatttaggttgggcaggagcaggaactagagaaacatcctgagaatggatcacattcaattcatgacctggttttagcccagaggcagggggatgactgagttgacctttcagggctacatcctgtcttcctgttgggcttgggagtttatgacttgcagagaaaaactactccataggtacaaataccttccttacagttcaggtgttcaaaactcccttttcgttttttgtttaaaataaactgatgttggacacacagcctctgagaggatttccaaaaactcctggaaaagttttagatcgttatcatgtaggacagagagggattacatttacatgtcaaaagatgcaaaggccacagagtcctgctaaaaagttgatggggagagagaggaatgggggagagaagaaagataagaaggggagagagagagagagagagaaagagagagggagaggagagaggaggagagagagaattctgcaatattaaccatggctttctctgtgtagtggtttatgggagaagatttttgtttttttatgattacctgggttattttttattttctacaataaacatatatgattcttgaaatcaccagagagagatgtcattaaagattaaaatattgataagagtgggtctgtgcctcttcttccagagccaggtaggagtaggaagctacctttccagcgagaaaaatcatcctgtttgtacaggacacgtttgtcatccggtgtttccttgactccctcttatcttgctgacaaggagaaggatggaaaagggactgtgatcgagtgaggcccacggagcatgactcaaacaacccattgtgaaggagggtaatcgcagaatcagctttggaaatcaaataaaatgccatgtcttgtagccaagagacactgcccaagcgtttgattttaagctcagctgaaaccctggagtctgtcttgaactgggaggaggactgactcaaggtgggactaaggtgatctatatgaagaattctaataaaaatgtagattggaatcagacttaggagaaattgtgaatgataactgtcagggattcgtgagaaagattcaaaattctacctacggggttcttttaaatgcttgccctgtatgatgatctcttttaatgctatgttacagaatggttgggttgatgtgtcattttcaagaagcagtagaaagcacttaacactatgcctacctcatcataggccttataaaatgtcaacaattcctggatactgtttcttctgctggacacactacagtgaacaaaatagacaaaacccatcccctcatggggctgacattctagtcaaggggtagataaattttaaatatggtgtcaggcaaagatgtagtgctgtaacaaataaagcaattttcaggatagagagagaggttagctgggaattttagagcatttgagactgggtagtcaaggcttctgtgggttatgacattgaacagagaccagagcaaagtgaacgagcaagccatgtgcacagctggctcaaatgtgttctggggctgggtgccgtggctcatgcctgcaatcccagcactttgggaggctaaggtgggagtattgcttgagcccagtagttcatgactagcctgggcaacataatgacaccctcatctctacaagcaataaaaaattaattgggtgtggtggtgcatgcctgtaatcccagctactggggaggctgaggtgggaggattgcttgagcccacgagttcaaggctgcggcgagccatgatcgcaccactgcattctggcctaggtaatagagtgagaccccgtctcaaaaaaaaaaaaaaaaagagtgttctaggaagatggaacagtaagtgcaaagaccttggtgtgggaatgagcttgggatgtttaggaatgagcaaagagtccaatgtagctggagcagagtgggcctgagaaagtggtagaagtgaggctggagtgagagctgggtgcctcaccgcacaggcttctgggccatggagaggactttggctctgactgttcagtatgatgggagctacctaaaggcttggcacaaaggagcagcatgatctgcttgatgcttcagaggactgctgctatctcagataaacatgatgtattggtctgctattgctgtgtaacaaattactacacacttagcagtttacaacaccacctgtctattttctcacagttctgtagcttagaagtctgagtaggctacactcaggtctctactctggggctcacaaggtcaaaatcaaggcattagctgactgggctcttatctggagtcttaggagcaagaatccacttccaaacccatttaagttgttgcagaattcaattccttgtgggtgtaggactgaggtcccggcttccttgctgattgtcactctcttctcctgtagactgcctgcatttttcttcaaagacaatgagggcatgttgaatccatcttggactttgaatctctttggcctcctctcccatccctagagggagaaaacttcccacttttaagggctcatgtgatgagaggaggcccactgggataatctccctatcttaaggtcaagggtgtcatgtaacattacatgatcatggagtgataacccatcatattcataggttctggtgattaggatgcagaaccttagggaaggggatcgtttttagaattctgcccacctcatgtgaggcatggtttagctctccttgcaggaaaggcatctgggtatgtggaagactctctaatatggaccatgaaatccagggttacaaagtcaggactacaataccagtccttattgcactccctcaaagagcatttattaagcacttctgcattcctaaaagtgttttgcatgatgaaggatttaaaacaacagcagacaattgcatatcactggggagctgaaactaatgatgcagaaagcaagtactggatttggtaaaatgcaagggagctcagtgctaaaggatgcaaaggcaggaagaatctggcaggggctgggattccctgttgacacctctcccaccagaccagtccatgttctggtctggtgcctggctcagaaactagcaggtgtttcataaatatttgtccagccagtgcatgaatcaatgtgcttcagttttcataccagtaaataggagtattggcctccccacatgtttgtgggaagatcagatacagaagggctgtacacttggaagaaaaaaaacgggttcaaaagtcagtgtcattatttttgtgagtggcaggaattcgctttgacatgcccctgggagagagataggaattaacaaccacatcaaatgcatatcattggccaacaggggagttttcctaagggaagatttatcggaaaaagtttgggttggtggaaggaatagcacagatgcctgagggcccctgggaggaagggaaggggcccagaggcctggtgggcatgctgaaagcaaccttcaccttcttcataacccacctgatctccttgcccagagcagaattcagttcccctgggaaggaatgtgctgggaagcaatttttccttcccctgggaaggaaggaaaatgctgtccaaaggtttcgggttttgggcagttctccttcagtttaggaataatatatatatatatatatattttttgagacggagtcttgctgtctcccaggctggagtgcagtggcgcaatctcggctcactgcaagttccgcctcccgggttcacgccattctcctgcctcagcctcccgagcagctgggactacaggagcccaccatcaagcccagctaattttttttttttttttttttttgtatttttagtagagaccgggtttctccatgttagccaggatggtcttgatctcctgacctcgttatccgcccgcctcggcctcccaaagttctgggattacaggcatgagccaccgtgcccggcccagtctaggaataatatcttaataccaataacagacttttctcataatagccccaaactgaatgtccttcaatagtacatggaaggaataagtggattgcaatatttcacacaatgagatactaaccaggacacatttttttgaaagcacaaactcctgataaatgcaacacatagaggaatgtcagaaacatcatgctgagaacgtgtagccagatgcaaaggggcacatactgcaggattccaggtatgtgggctcaagaaaaagcaaagctaatctatatggagaagccagcatagaagttatcgtgggggtgaaggtagtgactggggaggaaggagaaggtgggaactttctgggtttctgggaatggttgagtggtgtctacatgagtgtgcacataagtaaaaatgcatcgagttgctcgcttgagcatttgtgcatttaactataaattatacctacaaaaaggaataaaatcattacaatagtggtagcatcaaccacattttgagtgctacattagcactatacagctattatctccaaccttgggagataggcattatgattcctgcttaatagataaaaagactgaagcttcctgtgtccaagagcatagttaggaagtaacataacaagattcctggctgctttcttggcctgtctcaatgcctttcctatcaggaaggccaggtgacctgggcccagggcctacccaatacctgcatacagagggcccgccttcttttcttttctttctttctttttttttttagacagagtctcactctgtcgcccaggctggagggcaatggggtgaccttggctcactgcaacctctgcctgctgggttcatgcgattctcctgcctcagcctccctagtagctgggaatacaggcgcccgccaccacacctggctaattttttttttttttttttttagtagagacagggtttcactatgttgggcagactggtctcaaactcctaaccttgtgatttgcccaccttggcctcgtaaagtgctgagattacaggcgtgagccaccgcacccggccaggcctgctttcttttctaaatggtactggacagttggtggagtgtgccctgccctggtcctgtcatttcttgtccctggagacaaacctgccccagacacggtccatgcatccgttgccttgaggccccaggcctttctgtcttcatgtagaatctggcagcctgcagattgggaataaatgatcttctgttcaccccaccccggcccacttgctcctcacccaacccctccattcaatgagacgtctacagtctgcacctgggccttcagcaggacgaagttagatggtgtgtgaatcaggtacaaatagccttcgggtgacatccaggcactctataaccatgcaactgtaataggctgatgtttctcttgctggatgtaggatgtatgcatttaatgaagtattaatatgaagaccggattgcttctcctgtcaagtggaagaacgagattagagaggagagagaagctgggtgctcccctgggaagagggatcccccccagacactctcctttgtgagccaggactcctttgctttgcagaataaatgcatcctaacagagtgactgtaaagggactttctcataggatttttgcattgcaaaatcaaaatatgttccagagagcaggaaagatgctcccatggagtgagtggatctagtttagtggcaaagaagtttggctgaatgtcaggtgttaggcatagctagtgtggggtaacgtttggggagaagttttccagtaatccatacttccagctttcgacggccggtcctggtgttggagactctctctgctgtgctagggaactcctgagtccacgtgcatacccccctgaagtttgttttcttacctttattgcagggtgtctcagcctcagaacttcttgtgcttggagccagatgactcttggttgtggggctgtccccgcactgcagggtgtttagcagcatcaccggttcctgcacaccagatgccagtagcgcagcccccctccagttgtgatagcagaaaatgtcttcagacattgccaagtgtcccctgggggtcaaaaatcacccctggttgagaaccactctgctttcttgaaccatctctttattttattttattttattttttggagacagagtctcactctgtcactcaggctggagtgcagtggcgtgatctaggctcactgcagcctccacctcctatgtccaagtggtcctcccacctcagcctcctgactagctagctaggtttacaagtgtgcaccaacacacccagctaatttttgtgtttttagtagagatggggtttcaccatattagccaggctggtcttgaacttctgtcctcaagtgatccgccctccttggcctcccaaagtgctgggattacaggcatgagccactgtgcctggccttccctggaccatttctaacggctgctagagtggagatgtgaaatctccctgggccagtcgggctgttgccctgataactaagctgcccagcttgaagagtctgaactcaagagctttgatcctgcaagaagagtccattcccttgttcttcagtgggaaaaccctgtcacctgagttcatttaaaactgatgcaaatccagagagcaaagccacgctgcattcagaacatgtcttaagacaataggttcaaggaaacagcgttgttactgagcaaattccctttgcaaatttccaggcccttccgtgccaaagcaaggtaatccagtttaatgcgagttgcctttttgggagagaaaaataaaaggcaaaatatttaaggattcctttattctgcttttagcttctgagcccagcaattaattcgtatgtgctaaaggacttctgtgtttatgaggcattattatttaatgtaggcctattttaaattgtaatttttttcattaagttgcctcttttcacttattaagaccagttttataacctagcatagactgtattccttgagtaataactatttttcttttaaaatattccttaataacccatcatccatattttaaattttattctgagtcagagatgcctccctgttgctcacacgtctctcctcatgattctgagtaatgttggaggatacagggctgccagatcctctgccagctttgctttaagtctcagtgcagaaagcgaaacagcagccactggtgactgcccagcctccacgctcctgaggcccatgtggagcagccaacaggttgggccatctgcctcacagcttcccagcaatgttccataaggcaggcttgctgggagcagctgatgggggtggaggggcgcagagaagtgggatagctgcagggagctggagcatggcagggcagtgaatcccaggtcatctgcggcagcacggcccccgggtgccgggcacagtgctatggtccttgcctgggccatctctctgcatctccccttgccagccttaagaagtaaagagaattatcccattttgcagaagtggaaactgaagctcagaacagtggcgtgacttattcagggttgcaaggctagcttgtgatagagtcagaagctgtccccaggtctgtctgattcccaagctcaaagttataatctctcagcactagtggtcctgacaattctcctacaagcaatgagaccaacttctccaatagaacatttcagaacaccttccctgctgttctcatcttggcatcaccattgtcctgagaaataagcgccatgagcccatttttccgatgagatagatgactgaggcccagagaggagtagggacttgccctttgtgtccatggcagaatgagggctagcccggggtcttctgcttcaaggtctgggctgctttcttttcttcctgcctcagcctgtggtttccctattgctgactgcaccaccagcccaacccagggggggtcctggcccctctgctcaacatgcccctggccctggagagggcactgcaaagacagccatgggctgtcagggcacctcacaagcatcctgtggtcacattggtctcagccctcctccctgtcagcagtttcagctgttccttggatgcaggattgacccagggttaagaaaatgggaattcccctcacccaccaccaaggacatggagaaagttccagagggtgaccacaggctgtcagatgaaagacggtcagggaaaagacactagtatggtagaaaggtcataggactgtgctttaggagacaggggtcctggtcttgagttgcctgttaattggctctgtggccttggcccggggctttctcttccctgggccttgatttatccatctgtgtaacaaaagggtttcaattccagatccttaagtcccctccctctgatatcctgccatgggaaacctcctttgggatgccaattcagcaacagtatggccagacccactgatttattttgttgctttttcattcatcttattcattcattcactttttttccaccaagaacgttattgaattcccactgtatgcaatgcattagtggaatgtaatagtagactaactgctgtaacaaaccaaatttcagcagcttaacacagtggtattttatatcttattcatatcagggcttttggggaccataggaggacttggctccatacagtcattcaagtacccaggtttctttcatcctttcatcttatgatccaccctctgccaagtcctcagagccctccccaccctggtgatgaatggagagagagggtgtgcaggcagcatgggaggtttctaggggccaagcaggaaagtcatattcccctggccaggatatagtcacatggccctgccaaactgcaagtactgcctgagtagctaggagggaaaggaaatggagtgtggggagcacacggccatcttcctgggtctgggcaacacacacacagcacagagcaaggaccatgtacaagacagaagcttcagatcccaatttgagctcgggtgaaggagtctgggacaaacacaagaacgtgaggtcccaggtggacccggaattggcaggcccagcattgcatcccacaggaatccctctcatcagcccaggatctgctgcctaaggaagcttttccctagtctcatcaccttccctgcccaacacttcaaaggcctgaggactgactgagcaagtcctgcccttctctggcctcattgtcacccatccataaaatgggaagaaaaatgaccaacattagctttgcagggaattggaggagcatcaggtgtctacaaagggccatagaacagccttcccaagtcttattaatagtataagcatatcattatcaataatgaaacacatattaataataaataaacaaactaatgataaataatacatacatcatgaataatacattaatcctacaagtttttgaacatctattgcctctgacagaggggaatttgattagtttgctggagattagagagggggaatatttcaaaagagcccgggaggtcggggcaggggatggatgccagaaagcaccggggactgctccctgcaaaggctgtaaatcatttgaggtccctggtggcccagagctgagctgacctgttaggggaggtgagaaccaggaatcttgagtgagatgctccccctctgatgttctttcatggcccaaatttaggatgggaaatctatagctcaataaggcaaaaagtatccagccgcagcaaaagtagagttcatggtccaggctgggccagttgaacatacctattatattagtctgttttcacactgctataaagaactacatgaaactgggtaatttataaagaaaagaggtttaattgactcacagttctgcatggttggggaggccttgggaaacttacagtcatggaggaaggtgaaggggaagcaacgtatatcttacatgcaggcaggagagagagaaagcgggagagaaagttccacaattttttgtttttgttttggtttctgttttttgagacggagtcttgctctgtcgccaggctggccaggctggagtacagtggcgtgatctcagcttactgcaactttgcctcccgggttcaagcaattctcctgcctagcctcccaagtagctgggactacaggtgcacgccaccacaccaagctaatttttgtatttttagtagagacggggtttcaccatgttgggcaggatggtcttgatctcttgacctcgtgatccgccctcctcggcctcccaaagtgccaagattacaggcgtgagccactgcgcctggccagtaccacacttttaaaccatcagatctcatgagatctcactcactcacaagaacagcatgggagaaatctgcccccgtgatccagtcacctcccaccagatccctcccctgacacgtggggattacaattcaggatgagatttgggtggggacacagagcgaaaccatatcacctgtagaacttattagttcattcatggattcattcatagattcatggattcattcattcattcaatgtgtcctcaatgccagtagtgtggccagcaacacgcaaagcactaagaatgtagtaacagagacaggcatttggcccgttagaggctcccagtctgctgtgggaaacagactggcaaaaagaagtgtcctcatgcaatgagttagggctatggtagatgctgtgagagggccacctaacccagatttgggaatgctgggcatggggtaggtgaagctggagtgtacatcaggagtggtctttggggtaaatgacatctaagctaagacctgaaggacatagcgaagtgatgggggcaaagtgacggtcttccaggccaaaggaacggcaggtgcatagacccagtggcccgatgcagcctgacatacttggggagctctaagtaagtcaggatggctgtggctcagggtgcaaaagatagaagggcaagagatgagcagagcaggaggaagacccatgagtggttttgtataggggtcaggggtttggacttcatcccaaaggcaacagggagacaaagaagaatttggatgcaggccaggacatgagcaacctgggctacagcataatccacattgttccagggctccatggctcacaaatccccgtaaggtacagtgttcatgtcttggttcattcattactttatttgtgcagcacactcactgagcacccatcctgtgtcaagcattatgcagaggtgcataccgggtccctgggcttgagcgctagtctgatgtctgagacagacacacgaagaaccacatgttatattacaatggaatgtgtttgggctgtgactgagatgtttacaaaggtctatgagctcaggagagggtgtatcagactcatatcagtcaaggagggggtgaccatcacattgaacctggaaggatgcaaattaccctaggtgaactcagaggagaagggtgttccaggaagaggaaacagcacagggaaaaataattggaggggtttggaagggctgatgagggtgctgcaaggtgggcaaaggcacaatgtgagactgattgagttggaggggcaaagagaggcaagctcataagggactcagttggccatgacagtctgaactttatcctgaattggaaggcaatggggcagggaaattgaatggcattaaccagagaggtggcatcatcatatttgcattttagaaatatcattgagattttagggggctgggtaccttagagggacaagtttgggggccagagaccagtgagctggctattgcagagttccaccaggagatgtggagggtccaaactgaggccagattggtgcagagtggagtgaaaaagacagttgtgagagttattggagaagcagaattgatccgtcttagagactgatgacctgttagctttccccctctttatggagtggctttcttttcttaaaggcactgcccactcctggccccacctctcacccttttttcggccaacaaggaggtagatggttgggagtgcccattagtccagcatggaagagtgtatttcacagaactctctgtacctgcctagaagatatggttgcagtaattggtttgttgtaataatatttattacaatagtaattatgtagcactggaacccagggaggatgtccttagtgccaagatagggtatttgtcttcatgagataggggtgacctcttttcttcatgagtggtagtgcgtggagctcctgttatcacatggagataaattccagacccacagcagggggagggtggtgcgaggaatttatgtggccctgactgtcatggtccatcccagcaagacctaaaatccagctagtggagctgctgccaaccacctgaccacccgtctgccccaggtcaagttgtggtgtgatccacaatggttctcttaggagataagggtccttgaattcttgtcaccactgctgcacttccagatgcagagtgggctgagaacctgtccctgctctcaggaactcctagtccaatggcagacatacccgctgccccctgaggaaaggatggatgacccatgttgcttttcagtcttcactaattacttgctatcaataagtaatggtttgggtgatacacggcagacacttctgggccaaaataactggtcctgagctaggttcagaggactgtgtgtcagagatgtggcggaacaaattggccagcccagccacaagtctcttacagttccagagacgttctcagtcaaacacaacttcctggccctccttgcagactttgctggctttgaacttgaaaatggcctcagccatctgtcttcctgctgccaccttgtggatgcattgtgtcctgtgactatagcagggtgcttgaccctgctacactccagcaagacttcttgtgtccttcctagcccgtagtcccactacccactacccactcctgttttcagcttctccatttagaagcaagggggagtgggttgccatgaggtggtgggaagagtgttggactcagagtcaaagggcctgcctgccaagcctggttctctgtgatggtgagaaagtcactctgcatctatgagcctcagtctcctcacctgtagaatggggacactatccgacagggttgcaatggtaatcaatgagctagtaattacagaaatcctttgaaaactgccaagcactggtcacatgttcattttttcattccttcaacaattatttattgggctcctactaagtgccaggcactgttctagattctagggatatagtagtgttagtccattcttgcattgctataaaggactgcctgagcctgggtaatttataaagaaaagaggtttaattgactcaaagttctgcaggctgtacaggaagcatggctgggaggccttgggaaacttacaatcatagcagaaggtgaaggggaagcaggcacatcttacatggctggagcaggagaaagtgggggagctgctacacacttttaaacaagcagatctcttgaaaactcactcattatcaagagagcagcaagggaaaagtctgcctccattgcccagtcacctcccaccaggtccgtcttccaacactgggtattacgattcgacatgagatttgggtggagaccacagagccaaatcatatcaaagtagtaattaaacaacacaaaatcaaggacttccagctctggtgagatgaagtgaagacaagcctcatttcatctttcactaattcaaatataaaacctaggcagaatatatggacatctatttgaaaaatctgaaaagtaaatactagcagatggattggggaaaacactagaatcaaggtgccacataaagaatgaagataaataaaacctacagtcttactgggtaatacttaaaaagtgcagaatacaaatgaaaatcacttgatacacacacacaaaaaacccatgaaaatctcaactcacatggggaaagaaaatcagtagactacaatgatgagatggcacagatggttgaagtatctgacagagattttgaggcagctatgaaaatgcttgaacaagttatcaaaaacagtcttgaaacaaataatgaaatagaaaggctcagcaaagacatagaagatataaagaagagccagttgaaaaagtagagctgaaaaatacaataaccaaaataaaaaactcactgactagactcagtagcagaatagagatgacagaggaaagaatcagtgaacttggaggtagatcaatagaaattatccactctgaataacagagaaaaaagtattgaaactcacacacacagtctcatggggtgtacagtctagttggaggtcagggatgtcaacagacaataaacaagtaagtatatgtaggcagtgataaacgtctaagaaggagtaaagcagggtaataagtcagagagtgacaggggtgctatttacatggggtagtcgcaagagtcttctccaaagtggtgacatttgagcagagaaaggattgagggattgagccatgtgggtatctagggaaagattgttctggaaggtgggagcagcaagggcaaaggccctgaggtgaggatattcttaggaagctcaggggccagcagcgttcattgtgagtagagaaactgaatgaattcagagtgaggggagctgaaatcagagaggtagggaggacacagggccaggtgaaggcagaacaggtgggccagtgaggagatggagcagtaggtgaggaaacaaatgatggtggccaggtgcagagagatagcagcggaggggtgagctagttggattctgcatatattttatagagcttacaggccttgctggctgctttgatgtgagcatgagaaaaagaggaggttccaagaagtagattggtgtgctctgagctccctgattggcaaataggggaaacatcacatcattgtagggcctgtttccttgtggtgcctggagacaaccaagaggtgcatcaggcagtgatggactgccttacagcagggttccctacccaggacttaggcacgggcatggaggatgtttgcatttctaagtgtgaagtttcctggctaatctgagtccatgcatctgggcttgtgagatagcatgaagaaccacaccctcatctgctgcaagctcctttgttagctcccctcatggcaaggaaatgggagaagccaggaagataggacaaaagctcagctcactgtgaccaggagaagcaggatattgttcaggatgcagcagcagctcctcttgcagccctgagtctgctggttctggcactcacctgctgaggtgggcaccaagtttcttgctcgagggccttgttgttatggtggttcagttaagtgccactacctgtagatttgtctgccttacagtctctcccttaccaccgtgctgtctgctgacgcatggttaacgtctcatatcctaccatcctgagtgagagaacctgatagggtggccactcaccactcagtgctgatttcctctgttggatgcagttctgatgcttggtttcatgggaggctgttggatactccaagctggcagcagcaccaatccaagcagatgtggtcagagaagcaggttcagaacacacctgaggtcgggggagactttggctcaggctgcttagggaaaagcccattagaaacaggtgcctctgtgagggccctcctgggaattataaaacagtcaagggaatgagtagaatccatttgtttctttcttcaacaccatctttgatccaggtgctgttctaggcacctggggaccatagcaaatagaaacagttcatggcctgtgttgaggtgagcataccctgaatatgtcattacaagtaattttcggtgtcccaagcagtaggagcaggagaggcaggagtgctttgaggactatggaagtttgaggagttgttttcttgaggaggtaacatttttgtgaatccttgaaggatgcccaggaaatatccaagttacccaagtgagggagagggcttagggcagagggacagcctgtgttcaggcccagaggttagaggaggctgtgtgtgcaggagagcagaggcagcaggccctggatgatgagtgagaggtgccagaggaacctgagagctaggcatgggccagatctccctgctgggaggatgtgcaacttttcctatggagcaatgggaagctcctggagaccctaaagaaagccaggggcgtgcatattagagaaatgatcagggaccatgaatgggtgcaggaagcccatgttgcatactttgtcaccaccaccaccaccaccattgtctgagaacccaagagcagccatgctctgaggaggggattaccattcactttccttcagctttacaccgagtcaagggaggcatcgttacccctattatccaaataggcacagaggtttaagtgaattagccagggccatccatggaccacggtgaagttataacaagggtgaaaactcatctcggtttgccagaaacattgtcagttttaggtgctgaaagtctctcgtcccaggaaaccccctcagccctgggcagatagggacatgtggtgactctaacataatttatgtctcttttcagagacaggcccatatccctctcatggaagccctcgctgaccccgtcccctggggccaggcctgagccagccctctggacacatccccttggagctgggaaagggcggggagtgatgtcgggatgttgccaggagagttcctgggtgtaggagctatttgtcatcacctcattagaagggtgccaggttcctaaatattgcccgcgattttgctaaatgtatctgaacaggagtggtgtaaacgctgtcagagatagaggggagagtgatggcaccatccaggataatgaactgcttagttaagatggatccgtctccactcctgatccacttctcgataccgcgcttagtggggctcacacatcgaggctgattggtggcaaatttaatgccctgaaagacagagctccgtcttcagctggtggctgagtaattggtggatttgcttctctaaggaatggtgttgagttgtacccaaaaggaaggtgggaaggtggcctctgcttctggcctcccaggttcaggctcagttagcatctgatacggggttagttggagcaggaagacccccaaaatcaagctcccttctcattttacagatgaggaaactgaggcccaggaagagggaaaacttgcctgaggtcccagcgctgggtggcagtgttgctgagaccagaactcacctctcctctgctcttcaccgctgtgctcctggcttcccccacccatgcctgctcagctgtgcctcctcattcccaggggctccataggagggatgaaccccgaagtgcttccattcagaaacctctccaggagggtccccagcagaagccttcttgagcctcctctctagttttatgtcctctgcctcgggggaggatctcactttgtgggtctcctgactttgaccccagcctggatgagatgtctggctgagctagtcatctctgaatcttctcttctctccagtcagcttccagatgccagtctctgttctttcaacctctaccttggagctgtctttcctagactggagagtggaatgctggagggagtgcaggcaagggaagggggttggcgggaagcatggtgccacctcgccctgatccaggatgtcctgtttgggtagagcttgtgttgaatgaagccctggaccatgctttaccactttggaccctgtgattattcctgcatccacattacacatggggaaactgagtcccatggcagtcccataacttgcccaggtcgctactgaatgctagagtgagaaactcgattctatcgacagacttcaaattctggggaggtacatgggtggagaagagccaggaaggatggggaggagattttcaggaaaagaatccgtgcagggtatgtggaagatgatggaattttgtgagatcagggctgggggaatattaattggacctagaggagaacttttcctgtgtttttctcttggaaacagctcccttgctatatgaacccttgccatctcctctcctgtgtgtgtctgtgtctcagaggtgttttctcacctgtgatccaggtgttgattggtgctgtcatagccttgcctggcacatctgttggaaaatcaccttgctttccaccttctccctcctcaccccagccagagagcccacctccagacctgagacttagaccccacacatcacctgatgtttgtcctggccttggataagaagggtggagcccacagctcattgccaggctctgacctcaagccctgaggcagtagggtctcccctctgcccaccatctctcacgtgagcctggccccaaccccaggtctctctgtttatggttcctatcattcagtgtgtaattctgggtcagtcctttccccactcacctggcccagctcctgcactggcttccctgccctgtctgagagccaggcagctggtgaagactcagtggcaatcgatggagctgcaaactgggggataccacccagaattcccaagagaccccatcaagtagtatgttctgctccagccagtagcaagaagtggtagaaagaagttggctttggagccagatagctctgggttcagatcccagcttggctgctctgtccatgaggcatggaatgaggtgctccatagctctgaacagtagctcgttcctgtctgtgacagaggcatatttacaggagggtacgaggacccaaactgcctgtgcccatgaacgctcagaatgcatcgcttattgtattcatattttaatactctactgatattaatggaattcatattccagaaggagaggcagatgtgcaaacagacaattgcactccagtgtgacatactcatggtcgtggcatcgtacaaggcactggttgctgcctgagctgctgaaaaaatgggagtgagagtgctgggaaaactaagtgacacatgctcaggcaaggagttttagtccttagagctaaacctgtctctgcagcctggaaaccccactccctcagcttcctgcggggatgagaaggggagtgcccagctacgagcatttctcctcctggctgctaccatgactccaagtagggccatccctggaatggaagacacagtcactcctgcctcggtttacagtggtgtttcccgacatttgttttcaaggactccagcagggctgagactagggtgaagctagccaggtgcacagggggtaacattcaaagaggcacccactcactctcaggatggtgcaatgagacggtgtcctttaattttgcactgcaggccccttgcttgtctcactgtattcgctcccattcctggctcaggttctacaagatgctctgaaaaagatgggctccagagtgtaaaatatgaagaaaaatttcccactctggcccaaacttggagggtcacaaggcactgtgagcacacactccagcttcagggcctttgcgcttgacatgtcttctgcctggaatgctctctcctcaatacccctatggctcacaccttcctttattccagcctcctcagaagggcctcccagggcccctctggctaaagaagcccctcccccattgccttctatcacttcactctgctttgcttttcctcattatgtttatcaccactggacatattttccatcatttatttgattatgggctcttctgctaaactggcagctccatgaggacagggacgtgtctattgttactgatatgtccccattgcctacaacggtgcctggtacggaatagattctcaattaatttgtttttcatgcataaaggaaagacaggaagaaggaaggagagaaagttaagagaagtcctgaagggaagaacgggtttaattatacttaacccaatatctcttaaaattcatggatgttggaaatcatgttttcctgccagacatggtggctcatgcctgtaattctagcactttgggaggcccaggcgggtggatcacttgaggtcaggagtttgagatcaccctggccgacatggtgaaaccccatctctactaaaaatacaaaaattagctgggtatggtggcaagcacctgtaatcccagctactcaggaggctgaggcaggagaattgcctgaacccggtaggtggaggctgcagtgagccaagatcacaccactgcactccagcctggatgacagagtgagactctgtatctctctctctctctctctctctcacacacacacacacacacacacacacacacacacacacacacaaagaaatcatgtttcctgaaacactggtgagaagatccctattctctgcacactctgggaaaagctgtcttgtcttaacctgtcagagccaccccactcctgcacacacttcctgattcacctctaagactgagtgcgtatgcagtgggctctctgatctcaccctggcatgcctctgtgaattctactgccccagacatctgctgcgcctgccagtgctcctaacactaccacccaatcaccagagctgcaaccactcccctacttgccctccccgccaccgccacacttacacttgcaattccctcatggcttgccaacaaatggtgaccctccatcctgccctgcctgcctcacaggcacacaccatctgcacccacctcgggctgctcaaagatttatgcatctgagaatatgtccttccctcctctttccagtgggaggaggaccttcatgagccttgatctcatcagccatctggactgatgaggctcaactcataactatatctgcaaaggtgagagagagcccaggggagggcagcctcactggaagattgagccacgtggctcagaattgtggccatggggtcaggtcctcaactcctatcacagttcctgccacaatgcccatcctccatctttagggctggaagaaaaaagtatgcaggctgcagatgtacagtgtttgccactttctctcacctcttccgagaggctgtaatagcgtggtggttgtcatggagcccgaaggtttgggtttgaattccagctctgtaacttgcagctgtgtgatctggcaggggacttcacctcttggttcactcacagaaagtgggaatcataatagttcctctctcctaggagtgtcctggtgattaagtgagtagatgcatatcatatcaagtgcttagcccagtgcctggcacaaagcaggtgtgcacatgtgagccagtatcacaatgttacactcaggcttggcttgcccggaggtctccctttccgtggggtctgtcctcctgaaggtggcctccttgtttgtcatgccccatggctgggatcatccaggctggatcagattccctctgtgcccacccacaggcccccgtccgcctacctagaggctggctggtcacctgagtggtgactgtgttgggcatctctgtctcaccctcactgcttgttcctggagggccgagcaatgcctgggtctctgcttcccagatcctggccccaggcccgcacagggtaggtgggagtgaactggggttgagtaaatgaggaaaggaggatccgggttggtccttctgatcttggaagttggaccggttggttgtggttgtggctttgtcagaccaagtgggctccagggctatccaggggcttgacctctggcctaagttacaggcctccctggagtgagctccttgccttgcccctcaccctggaggctgggtcctgaagccttggaccgtgcaggtccgctctgactccaacttccaaattgatcctctccaggtcgattcttgttttgttttgttttttgttttcctggagtgttgtaaccattgagttccaggcaggggtcaggcccatgggctccatctattcagcttgcctgcacaattgaaatcttcgaacccatcctggctagttttctcattaagactatcggactggattgatccattagatcaatgactggacatcagccggcaggaagccgatcagatgagcctggatgatcagcccaggaatgaggttcccctcggaactgcggtgaaggtccaggcctctgggatggggctagtggaggcagaggagtgggttagaggcctcaccagactagactttggtgtggagagagcagtgtccccaaggtgtggctaccagggcaagagtcccagcgtctgctccaggcactcccaggggcagctggtagtagtccgggaagcatcacctggtgtttgcaatgagttcagactcctccccagatagtgggtctataatggacttctctaacatatcaccactgccatggccaaggcttggacccgaccctccctttaggtggcaaagtatgtgtggtgggaaagccaatggagggtgttaaggaagccaatggtggtttcccagggctctctttttaccaggagtcatttgtttatgaggttggaaatggaggagtatgggcacttagaacaccatgtcccagtgtgtatttctcagatcctggctgcgtaggatggtggtggggcttaaggggtggctgagcgacccatattcaaataggtttggaaatgccaagtaaatacatttcggcattcatttcctgcaggaccgaatagatgaatcatgaatgccacaactctaaaaaggggtggaggggcgatgttggggcacagaagccttctctggggtatcttatagaaatacattgaggctgttcttggaggtgccagcaggtcctaccttcagggaaaaatgtgtcccaagcagaagtgtttttggtttggagggatccattggagccagggaggcagccaaaaaggagatgttgaagagagggaagaagagggtgattggctccatttgggcctgcagtcaccattcacagaaaccacagtgtgaacagcgtccctcaaagttgtgcaactacagaccccaaacttccctcctctgtctgctgtctccctggccctgccctcatcagcccagcccctctgatctgctcgtgcccttaccacccctttctcctctcttctgtaggctacctgacagtcaacattgagcctctcccccctgtggtggctggagacgccgtgactttgaagtgtaacttcaagacagatgggcgcatgcgggagatcgtgtggtaccgggtaagtcactactactgcccccttcatgcccatggccaggactggtgtgaggtcctcagagccctctggacaccctcactggtgtggctatgacctcagccctgacccagtcctgagttgtcctgggcatctgctgggtccccgccctctgctgacaccctccttgggtactagccatcccttctaccctcaggactgatctggtttccaccttctttgtgctcctattatgcccctacgcttggaaaactccattaggcaaagtagaagttactgagaacaccctggaccctgggcacagtgtaatcacaagtgatatctgatggtggaattttgagcatgaggcttcggataatgtttttggcaagggagagagaaaaacaggaaggcttcctgccttttgcaaaatcaaatcacagagatagtctgccacctaatctgactacgtataggactaatcctggtgtctggcaccatctgagaagggaattggttagagatgagaaggtacccacctgcccagggcccaggtgttggcaccaggaagaacagcttggaatcttgagcacaaggggccttttcaaccactgagtgaaatcttcttgtgtctggatggggcatcccagtcttctatccctttgccacaaaggaattggggctgggctcagaaggtccagggggcagtgatgcttttcttccaatgcatgcttgagtgtgcacagataaaggcaccaccatcctgggggagaactcctcttctgtcatctaaacaggggttggcaacattttttggtgacgactgagattgtaaatattctcctgtctgccaaacattcagtcttggtcacagttactcaactctgctggtatggcatcaaaacagccacagacagtgtgtaaatgaaagggcatggctgtgtgtcaatgaaactttactcatgggcaccaaagtctgaattttgtacaaggttcatgtgtcataatttcttcttctttttattttttttcaatgattaaaaaaggtaaaaactgttcttagctcgctggctgtacagaacaggctatagaatgacttggttcatgggctatagtttgcaaatccctgatcagaaaccacgctttcctaatctttgttgccctttcttcaaatgaaacggatggatagcacagttaggtggagctgttctggaggaagtgatggagcatggaagagagggcaaggaaggtggggggtgggcaccaaactgtgattcaagatctagagctggctcctctgctccttggagctgtcaccacatctacacacagagcatggaaactcagtgttagaggaatccctggggcatgcgtgctgttcatagtcttgactcagaacagctctcttcagtctccttcttgctcttggtccaggtgagctttgaaccagcctgtcttggctgctctgctttgcattttcggtctctgattcatggtttgcttgttgttgctattttgttggctgtgatctgcactccttctaaccaaaaatcatagttctctatttcagcattgcagtctctcctgtttagagttaattctagtgccctccacccaagctcttcaggtagcctgggcttcacaggtgtgaacctgacatccagcaccctagagggtcccagccttaaggaagggtgccatcctggatagatcagtgggcctagagaaagtcaaggcatatgttaaatagtgccatgaactgaatcactaagaggtgtatttacaggatatgggaactgcttggctgacacaggctgggagcatctcattagcacctggcagaaggacagggataaattaactccagctcactgctgatgatgggaccacatctctccctcagccatcccatagatgggatcagagggaggggtggtgaaagacagatagaaatatggagacccagtgggaacagttaatggagcgaaatggaaggaagtttggagatgggaaaatagcagtgggcacctcattgccttccaagctcttgaagcaactgtcctccctccggtttgaaatcgaatgttaccatagtcacagtggtgaaaatctccctgcagaggctcctgctggagttatgggcaatgctagtgccaggctgtgcccaggtgtagaagccaggagcaggtttccacatggcttgacttgatgttcttgaagatggtgagcaggactggggcaggaggatccatgtcctgggctggacagagactctcctttttcttcgccatcctccggtagggagaccctcctctctcccccactcttgctgcctaaccttgatgccactggtagttttaagaatcagtggcatctcttaccattgtcaggcgctgcatatcgggccatggtaggctgcactaattaatttattttatttcatttcacatcctttgactgagggcctctggagcaggcatatgcagatgtatgcaaatcacatgcaaatcacccactagagccaaatgcctgggcccttgtaattctgtagctggacggaggtggtggctcagctgactggttactgtcctcaggtctcagggagcccacgtgcccgcctatgatgggaaggatgggggcagaggaaggaaggaaattccagggaagggctccgtgtggccagtttttgctttctgccactctagctttctctagtgattgtctctcttcccaaagaggcagctgaagggagagagataagagcctaccaagatgggggctccaggagtcaaggtcagggcagggcttccagagggaatgggagcagcagcaacaggagctccagtctccttctccagccagaccctcctctgaccccttcctcccctgccagacgaaccccccactgtggcttccttccccatctccctctccccgcagcctgcccccctcctccaagcagggagctgccgagtgctgtttgttttctgtacgtgtgtttgcttcccgtcccagcttcctttctccatcctccgtgaatgagcttacagagcccggcttggaaggaaatgaatagattacacaggcccagtcaggactgtggctccaaccccgttagaaggaagaagcagggcattgtgatgaggccgccactgcctgctcagcacagtgggcacaaaatggcccaaaacatgtgtcaagcccagcagcctcccctctggtcctaaatacattatcttagcaaagggatcatcctgagctgtcagaaaacatcatgaatgcattggattctttgggtaaatcagggcagctgatgaaattatctgaagccatagggatcacctaaccttggagctaacaaaacctctggctggatatttgggaaggtcttgcttgtggacccctcaagggaggggaaggaaattgggaggaagcggcaagagcctgactcttggacactttacccccatggtctggccaagtggggaggagctcagcccgtttgtagaataagatgccaaaactatgagaatagactcaaggaagtatgtgtaatcatagccccttggtctgggttgtccaatatggtagccaccagtcacacgtggatgttaacatttaaattaaatcaaattaattttaaaattcatttcctcagtcagactagccacatttcaagtgctcactagccacctatagctggtggcctccatattggacagatgaagtatagcacgttcccatcactgcaggaagtttcactggataacctgctgtagaacattgagattttcttttgcagcctctggaatacactgtgctcacctgacaagagaatagcagtgagtgatcattgagtcagttttccaggcaaacttgccctgaaatgaattttagtaagatggatctcatttggtaacctgacatcattagatcgtgtgtgtgtgtgtgtgtgtgtgtgtgtgtgtgtgtgtggtgagggagggtgaaaaaagggagatggtcatcatgctcaaatcacttctttgaaaacataaagatgtcaagagagttgtcatccctctaaggtgctgagtatcgtagttgtctattaaagccctgtccaacttgaggatgcttttcaccatccccctctgctttctccactgttacatgggttcatctcccagatttgagtgtccaggcttcatcttcacagctcatatagataagctccagacagcttttttttggctaatagagtaggggtgcaattccatatttcaccagtaggaggctgtcagctaataactaatctaccctagcacttaagttgggacttggttcaagaaaatgaataataaataatgttctttacttaatcattcctatttacatctgtaactggggacttatttattaatgctgcttatactaatttgagtggctgacattattgagcctttactatgtgtgagcactagatcaagtgctttacatacgtgatgacatttcattttcatattttcactgaaaggtagatactatgattaattctattttccagatgaagaaactgaggccattcgaagagactgtgtctcgggtcatgttgccttccctgacttctccagaaagctgtaggcacaccctcctccatgaatcctctgtgtgggtctttacactagtgcttacctcatcatgtcaaaatacctgcccctggaccatgactatctgaagagcaaagactgtcttttctcctgctgtattcttgacacctagagcagagtcacctcagtgaacatttgctaaattaacaaatcatggagctataatgtgcacctgttgacagaccatgctatgtagcccacttctgtctcatgtgggcatctgtgtaatgttgatagtatctgttggtcagggggtggggagtgtgggtctttggatactcagggggctttgttaagtatgaaggaaaagggaacatttcttattaggaaacactgtctgaactcatttggttggaggccgcctgcccagcaggcaaagccgaaggtctgtttatatcatggaactccattaaacagccacagagaatcatgggagtttaaccttttacagcagtttttatcatccctcctttgttttctctccttcttttacaatttgttcccaggagccactctgggcccaggttacaaggccacagaaaagagagccagatagagagagaaggagatctacaaacagtgataacatccctgctttcagtacccctttatctcacctttttcaccatgtgggaagatgcatacctgggtgtgtgttttgtggtgcagatgatgcgacctcgccaggtgatcgtcccctctgggttctgctggatgcctctgcaatgagggtttgtggttgcttgggaccatttgaaaaggaattgagactagaggctgggaaggctgaggtaggaagagagaggacttgagcatcagaatacctgtgtgtgagtttgaccttgggtggtgacctaacctttcagccttttagaaacttcacctgaaattgggcatgaaaacatgtattttgtaagcttaaatgagataatgtctgcaaccaaaagaccccattgttcagctcattgtggcacctattcaatgatagctattgtcatttcatgtctgttgatagcttacaggatctagagagggaaattatagaataagaggggaaggtatttggggaggatcaccacggttagattccttgaattccatcctaccacctgcattcccaagggatatgggcagagacaacgctttaaatggttatgctggtgaactcactgggtttcaattcttggaaacccagtggcttaacacagttaagccatttcaatggattttagctctccctgaaacagggagctatttcaaaatggctttactatcattggctctctctcagtcccagcccttcacaatgtttcattatttgaagcaaaactgaaaatgatgatcctaaggagacaggaaacaatacagtccaaccatatcataagggcaagaaggtaggtacactctcgggtgaccaagagagaccagcaccaaggtcccagaggatgggtctagacaacccctttggcccttcttgcttggcagccactcatcctggctgctctttgctactcctctgaccccacattctgatcttgagttcagatcttacagatataagtctggaaaaggatgtgagtgaggaagacaaaagccagggttgagccaacccaacttgccttgtctaggcctccttccccaacccctggccttccaaagagccaggttctccctgatgaggtatgtccagtgctcagtcttatcatatcagtcacatgggaaggaagagaaggcagccagagagggcccaccaaacaatagttgattttacaacaaatgtaataacacataaacaggaaataagaacaagttcccaggtctacttccattgtaatctgtattcgtctgttcttatgctgctataaagaactgcttaatactgggtaatttataaaggaaagaggtttaattaactcacaattctgcagggctggggaggcctcaggaaacttacaatcatggtggaaggggaagcgaacacgtccttcttcacatggtggcagggagaagtgccagcaggggaaatgccaggtgcttataaaaccatcatgtcttgtgagaactcactatcatgagaacagcatggggaaaaccatctccatgatccaatcacctcccaccgagtccctttcacgaacttgggaaccacagttcaagacgagatttgggtgggggcacagccaaaccatatcacaatcctttaattcaaccccaaggaaaactccacccctaaccacagctgttaagttgtaaccatccagactcatcacactgagctcctcctcctggggatggggtgatgggagaaaccttcagctccctctagaggccagagtgtgaatcacaatcattgcagccctgatccttgatctttaatggaagttctattggaaaccggcaggggtacctgactctgacagctcattagacttctcagaggccactaaaaatacactgttgtctgagactcattctacagttattgaatctgaatttccaggactggagcctcagggcatttgtacttttaacgagttccccagatgacagtgacgcactcaacccagccacggagcatgtcatggcgtttgtgaaactctgatagagggagctgttccatgcactcatccaacattaattcaacacatatttatgaaaccaggatggttctaggcactgggatttcatcaaggaagaagacaagatcctgtgctcacacagtttaccatgggggaggagttaaaaagataaacaaataaggaagataccagctaatgataagcgcagtgcatataattaaaatcgagtggtgggatagaaagagattgtgtggtcaggaaaagacatttaagctgagatcgcaaaggcaacaggaaacctaccatgccaagggaagaaggcagaataatccaggcagaggggaaagcaaatgcaagacagttctgtgggaaaaagctttgtgtgttcaaataacagaaagtgcatgtggctggaacaaaacgaatagggggtgatgttggaaaaatgggcagagaccgttcataccaggccctgtgctgtaagaaactgaatctggagttattctaagggcaccaggaagcattgagtttaagcagagaagtaacagggtctggtttactttattaaaaaggtcacttctgggtggagaatggtttgcagaggaggtgagaaactggcagcagaggggtcacttggaggttagaatagttcaggcaagaggcaacagtggtttggttgactaccaggatggtggtagtggagatgatggaagggaaaaatgttctgcttatgatttgcaggtagaagttaagggcttgctaacatgtggaagggatgagagaaggggggattcaggatgactccctgctttggggcttcggctgggtttgcaggagcagtgctatttaatgagacagggaggacaggacaggagaagcaggttgcaaggtgatatggtttggctatgtccccacccaaatctcagtttgaattgtaataatttccatgtgtcaagggtggggccaggtggagataattgaatcatgggggcagcttcccccatactgttctcctggtagtgaataagtctcatgagatctgatggttttataaatgggagttcccctgcacaagatcctcttgcctgccaccatgtaagatgtgactttgattctcatttgccttccaccatgactgtgaggcctcctcagccatgtggaactgtgagttcattaaactgtccttttataaattacccagtcccaggtttgtctttattagcagtgtaagaacagactattacacagggacaggcgtcaagcactctctgttggctatgttaagctgggagtgcctctaagacatggagatggagctgctgcagccgctattgaggccacaaatctggaatgttggggagaggtgaagcctggagacttatacttggcattgtcagagaatggatggtacccagtgctagacccttgggcactccaatatttagagatagaaaagtagaccaacagagaggctgagaaggaggaggaacagccagcaagatgtgaagacggtgaggagtggagtgtcctggattccaagaaaagaaagtggtttcagaaatagtagagtcagctgtcagctagctgtgtctcacactccagtgagtgacttgagagcagagaaatgaccatgaacttggtaacatatggagcccactggggacctgggcaagggcagattccttggaggtcgtgggggctaatgcctagctagagtgggctgaggggtgcattgagatcagcagtaacatggccttgagattttgtctagtaaagagttttgagcttgaacatctgaacaaacctttgcaagtaacatgaagacccaattgcttctattgaatccactcctatttgcatgtcattcataaaattacaagcccactgtcttttcctaccatccttagcctttcaatctgggactggtggcagcctcgctctcctcatcgagaatgtgaaagtggcagccgagagcgtttaggggattctagtgtaattaaaaaatgcatttggtatttgaaagaaaaatcctgctctaccatttaattaactcagtggccttggatgacaactattcccaaaacttcctaggcactgtacacaggtctgaaggtataaagaaggacaggtgggcccactcccctcgaggggagcgcttcccgtccagttgcccatcatcaagttgttaagttctgtttcatcacctggccaatgggcttgactgcactttccctaaggatctcacaaagatttgtgcaaaacagacgaaaagccccacagacgagctgcttctgtcccccgtggcgcaggggaaataggcttcacatatattacttcatcttctcttttccgcctgggcaaatcttactcattctctcctctgtgaagccttctgacccctctcaccaaagcagaattaagagatcacctgctgtgttctctcagcgttttgtacattcttcaattagagagacagcacctggtagcttagttattcatctttgcatctcttgcggagttttatttttccgcttctcctatgtgtcattcataaaattacaagtccattgtctttagcctttcaatctggaactggtagcagccttgcactcctccttgaaaatgtgaaagtggcttcccagagagtttaggggattccaatgtaattaaacaatatatttggtatttgaaagaaagatcccgctctagcccttcatttatgaatgatccttgggccagggattctatgtgggggcctcagggtccctaggaaatatgtggatgggcttctgggggtgctcaaaccccagaaaatatgcctaatatgttgtgtgtgtttttgtgggagaaaggtgcagaatattctcaaaggactctgtgatgcccccatgccccaactgaaaaacccaggaaatgcaacagcaggcatgcaggtgttcgctgagtgtgaaatgtgtagggcatctcattatctccactcttgggtcatcaaggtccatatttaggttggctctaccagaccctgtagctgcgaggttgtgccagatggcccatgagtggtccacgagcttccaaggagtgcagtggggaatgggggtgagaggtgaggcagtcaaccttaggcaggaagagctgctgtgtgattgggatccgtccagacaccacagctcagtcagcctggatttgtgcacagatgcccttggacgggaagaggagataagaagcagggtggtgggggaagactggctttggccacacatcactgttctccctggcttgaaggggagcggtttttgaccaagcaaatccatcttctcttggggattaagatcagtttctgataatggcaaggagaccacttccctggtccacatggggttgataagagctcttggcttccaaactcttgagagggggtgccaacagctgaagtggacacccaaataaccaggtgttttgttagaccacatgcagagtccaccagtgatgggctcccacactgcatgggtgagaaagacacggcatatctaaggataacacactgatggctcagctcacttcacttaccaagaaaagaaaagagcaagggcctgggacacaccatcctgctgtgtgatcttgaaaaaaccacaacccctctctgagctccaggatcttcataggtaaaataaaagcgtgcagtgagatggtctctaaggaatatgcagcctctctcccaccttgcggtcaacctccccaccccgctatcttttccccagaagactcagagctaatggaagaggtgggtgcctcccaggtcagggcaccccccagctgaggcttgaacaatgctttctcaggggtgagagtcctggcctgagctactactgttggggcctccgagcacatggaatccggaagtatattaagcccaaagtgtgatttccagcagattcttcctggctttcctatgccctgttgggtttaaatgacaaaggggctgacttaacttgtcggaaaaggattaaaggtgaacttcagctccagcacaccagtgaaaagaaaagaacatgactgaaatgagggatgtttcccagctcagactcaccatccctcctaaatcctttctcccctcctctccccacattttccttgttgggtgtgagctcccacagggcaggcagtcttcccgttgcagacaggcacagccgtgtgcttttctaaaacacatatctgaccttaccacgaccacccctccctgccccacacttcgcaagagcttctcatcacctgaaagaccaagttcaaggtcattggcccagcatacaaggttcttcttgattcaacctctgttgactgatttcttcagccttgcttcctaccacgttcccaaatgggcccaccattcgaatcatatggctgatttgcagttctcagaatgtgccaacgttctttcccacctccgagctggtgcatatgtgctgtctctgcgtgcaatgcccttctcccctccatctggtcaactcctacttgccctccaaggcccagcttcagtgttgccccccctccccgccaccagaggcttttccccatccatttttcccccttcaatcttcttccacattcaactgccatgacccaggctgagttagcttctcataacactctcaaaatactaagcacgtgaccatatgactcaacacactggactcatgtgttcatttttgcagcagatatttcttgagtaccaactagtgccaagccttgggaatagagcacagaataagaacaatgggctgggcacacacaggctgtggctcatgcctgtaatcccagcactttggaaagctgagaaggatagatcgcttgaccccagaagttcaagaacatcctgggcaacctgacaaaaccccatctctataaaaacacagaaaaattaaccaggcatggtggtgcttacacctgtagtcccagctactcaagaggctgaggtgggaggatggattgagcccaggaggtcaaagctgcagtgagctgtgattgcaccgctgcactccagcctggaggacagaaagagaccctgtctcaaaaacaaaaacaaagaaacccaaaacaaatacgcaaaacaaggtagccctgtcttttgtggagcttgtagttaagcgggaggaaacaggtattacatgaaagactgtcaaataaatgcttctttcaaattgtggtcaccgctttgacagagaaagacaggtgtctgcttgctgagagctcatagtaggagatgaactgtaatagttgaatgtctctctcccagaatgcaaaccctttgctggcagtgaccaggtgtcctgtttgtctttctctcctgagtgtctagcatgatgctgagcacatagcttagaggatggatggttggatggatggatagatgtatgcatggatggatatcttatgtggccctgagggtcacagaggtaaacttgtagttgatgaggttaataactttcccacagttggagcttttcaaccatggatgggctgtcttaaggactggtggacttcctaaccctggaaatgtctaagcaaatggcatggccacctgtcaaaactgcagtaggaagtaatcctgggcccagtgcacccagagctattgaccctatttgtttcagctctggaattctgtgctgcctcaagctcagctgcgcagccatgatatcatgacaaggggtaagaagcagagtgtccagccaacctggctagttggggttgagtatggggcttctgtggaaatcaggcatcagaaagttccagattccccaggagtagggttatgtgactgttctgagaagcagacatgtgtggctgtaaatgtccagagaaagtgccccacccttgagtgaacattcaaaggtgaggccaggggacacctgggagttgagaggagggggaggatgtgaacgaattttatagggttcagaagtccactccacaacttatggccttatacaaagcatctctgtccatgccacactgctttaaacacatcagtgatgcctttccatggttcttaggatacagacaaatatccctggtgttgccatacaggactttgcattgtctggcccctgcctgcccctcgaggctcctctcccagtatgcacccataagtgaagattctggggatatcagagacctcagagagccttgagagaaggaggtagaaggactagagtcagggagactgaggttaggtgaggttaagcaacttgctcaaagtcctgctgctagatagtggttgagtcaaacttcaaaacccaactctctgactacaaagttcagctctttctgttaggtcccattgaaggccataaataccctgttaggggttggagggatttccccctgagcgatgggcagtatgaggactggaccctcgaatgcgctgaatccctctggcttggggagcctgtggcaggtaagacaagccttcctcccatctccctcatatcatcatgaatgccactgctgtagcggtgcgttcaggtcaggtgctgcgctaggtatgttacaaagatcacctcactgaatccatacaggaatcacaagatgccggtacagttgtccattttagggttggggacattgaggctcagagaagttaactaactgaccccaagtcttgcatatggtaaggcggaaggggtttgtctgagtccccttagagcagcccagccttctcactctaagctgatggagtggtctggatccccctttgggaagctctgtggcctcctccgtgggggagagatggagatggcctgggggcagaggagcttctggacatggctgcttcaggctgtcctcatcatcaccctgccggagccatctgtctgcagtagtgctgcggcacagatccacacagaggctgtcaacgtcaaatgaggacttgagggaaaacagcttccaccctgcagagatgacacaggcagcacggttcacctactctgagatgacacaggcagcatggttcacctactctcagcacggcagagcagacaggtgtaaggaagggccccttctcccccacgctgcctccctgcatgcccctcccaagctggactctcttttggtgaatggtggaaaatgtctagcaaaaccgtccacggctgaggctgcttccagtcatggcacacagacctcaggaatcccattaatgagagggatggcttctgaattggataccattcttcaagaaaggaagttgtattattattattttattattttgcaaagtggtagagtaactcaaatgagtctaaacaagtattgtcaagtagtggttcttgggggacctgctgtaatggctataatagtcatttcaattggcacattaattatatgggagcaggtgcttctaaaataattgagggtgtaagaaggctgtttatttccttacgtgctttcaacgttccccttcaaccctctttactctatgaatatcaagtcatgcaaagcctgttctttggagacagagaagtgaagcctgtctgaaatcgcaggctctaatttagggaagtctccagtttattcgttcatcccttcatccctccaggtagagaactaacacctgcagaaaaccttggcagggccttggctgcagcctagagatgccatccctggctcacactctgctgggggggacaggtgtcatgtgacccgcacccttgtctggagctattcaagagtgaggaagggacagtgggcatggcaagtagaggtgagagcaggtgcaaaggcctgggggtggcccatctgactcccatcaggcgctcagtgaagggtcaggaagaggggaggcaggaggaggaggctgagggcaatcagggacctatgccaagtctggggtgccctgcaatggagcttgagctatatccaaggggaacagtcaagaaattttaaacacaaaagcatcatcattcgattttaggaagctctggacccctccctagagatgtctgataagcatctcagacttaacatggccaaagcaaagctctgcatttcttccctaaacctacccctcccttagtcttctccacctcagcgaacggcatcaccatccaccagtttccgaagcgaaaaatctagggcgtctctcctatcacatctcatcccttgcccctgcccactccccgcatctcttccatcgaatccgttctaaaagacaagccctgaatccactgcttcttccccattcctgggcctccaagccagctgaagcctctatcactacttcaagtcagcaccctcctgatcacactctctgcttccactcttgtcccctcagcccccaaatccagtatccaccaagcagccagagtgaccttttgaaatcagaacagtcttatcattcctcagttttgcctgatacttaacaataaaacccgggaggcaccacccggtctggcactgcccctttctggcctcgcccactccactacctcccaccacaccagcctcatttgggttctgtaaacaggagccagcccacacctccagatccacgatgtgcaggcccttgtgttgggtgctgctgggatttcaaagatgagcagcatgaaccctgaggagcgagcatatggaccagcagtgaagatgctgctttgccaaggtgcctctagagacagaaagatccaagagcaactcctgcctccacctcttcctctgtcacctcccccattctccatatctgtgtctataaaatgggatggtgataatagcactgacctcgtggagggccatgacagcaaccatgcaaccaagcatgcctggaacagtccagatggcgcttgttatctgagggtgactgttaagagcaacccttgttcagcctcaaaagtgcctgatttggacgacaaatgacacttttgccaatgcagcattctggaagcgctttgcaaatgtcgtttctcaggatggtgctctacttctctgtgcacatagaccatgggacagattcaagggcagcgctccatgcattgcccccggtcgggagatttcttaagctacaactctgggcaatggtagaaagagggacggagccctagcctgccagatgaaaagagctgactttggaattcacctccctctccctttccagcatggaccatgggccttgatcccacctaggtgttgggctgtgatgggcaggacaggaatcacggtttaaggggttgttgcaggtgatgctgggtgggcctttctctgtgtctgaaagctcgtgaaggaaaggcaacccagtcacccaggagtggactcaatgccggaacaatggatcccttgcacaagtccagctgcattgctgacctatgtggcctttccaaactgtgccatacgtagagcctgttgcttcatctttcagcaaatagttattgagagccctctgtgtctcaggcctggtgctggatgctgccacagaggcccctgccctggtggaataaaggaaactggtaattgcacattgatcttctatgcagacatcttactgacacttatcagtgctaatagattttttttattttgatcttttgcattatgatgtgaaaatattatctgcaaataataataataataatacttctcctctcaatgcctgagagacagcatttttaaggtagaaaaatgtatatcctggaaccagatcacttggattcaaattccagcattgccacttagaagctgtgtgacttttaacaagttacttaacctctctgtgctccagtttcctcatctcatgtaatgaacttaggacagtgcctgacgctatataaatattggtagggctatacttattgaactgattataatttcttgccttattccattgtctaaaatttccagaatgcttgtaaaaaagggtttccctgtcttattcctagttttcataggaatgcatttataattttaacattgcatatgatacttcctgctggcttctgataaatattcttttttgttatgaataggaaggttacttctattccaatttcacctagaatttttataaagaaaaattaattaaatgctccttaaaaatctattgaaataatcatatggtttttctcctttaatttactaatgtaatgaattatgttgatgtttttcctaatattgagcctccattgggtttttgtaatttctttaaacaaatagcttgtgtagcaaattaaaagagctctcaagtatttgtttttttattattataaatgggatctttttcattggattttctgtgggtctctgggatgtaagaatgcaattgattttttgtggctttatcttgcatcctacaaattagatgaattcattttttttctctttaataagcatgtagtgctttctctgagttgtctaggcatccagtctccccagctgatatttttgtttccttctttcctgtatttttagatctattgcatttagcaatgagcaagcatgtgttgagtgcctactatgtgccaggcactgggctaggatctgtttcctctgctgctgttgctgctgcttggcagggtgggtggttggagtaccctcttcagctggaatattgagagcaggggccttatgagggaatgaatcccaggaggtcccaaaccacttagagtcagatcaggattcaaacacattaaccctcaggtcaggctgcctcctgaccgatgactctccccttcaaggggcaggggtaattaaccttgacaaagaaggggaaaccaaagcttgggaatgcagcagtcatttctggcctggaggtgaagatagatgcccttaccctgcaacctggccttgaatggtccagctctctgaccttctttttgttcttgcatctgggacttgctgctattaaacaggagtgaaagtcccagttatattttgtttctcttgagcagcatcccagctctggggggtgtgagatggcatggcagcatgctgccatcccaggccctccctgagtctgtgaatgaggccctcttgcttcctgggtgaatgtcactaagaggctgatggcatctcagtgcccagtgggcccccctcactgcctggcatgactcttgctgcctcaggtcccaccccttcctgcctatagatttgcccttggtttttgagctaattactccgtctcatcactgcactgactcttcccagcatctgacagccctatgagcgtgtatcttgtaatctcccttcacctaacacaagtcagcttaattatgcatgtggagcttaggactccaacctccaggctcatactctgcaattatttctgtggtcttgtcccctctggcttcctgcaaagatggcagctggtgtcttgctgtggagtccctggagttacaccctacacggggtgcctgactgagaaggcagagggagctagctcggtatgtgctgtaatctccaaactccatgcttgggacatcttttattaattcacactaaattgcagtgtggtttgtggcaacctgtctagcgcaccctggcggcaccaaagagctgccctgtccacaccaacaacaggcttgggagcctcccaggatcccgggaagtcctcaggctctgcaccctgccccaggctcttggcagactctgtgaagctcaacacatctgagtttggaagctgctttggactcagggagaagagagcgaatctttgttggttattgatgctgagccaggcactaagctaagagctctccatgcaccaccggaaggaggaactacaagtagctccattgtatagacaagaaaactgaggcgcagagacgtgatgtgaattcccaaaagttgcagagctggaattcttttttttttttttttttttgagacagagtcttgctctgtcgcccaggctggagtgcagtggcacgatctctgcacagctggactttgaacccagtgcttctaactccagactgccactctacccgttttcttgttcccttgagatggtcaggggatgtgaaccttccacttcacaggggctgccagccttggtgaccccaggatgggggccagctctgtcaggcttctggaggcaagactgggtgcctggactgtgctggggattgaaggagcaggtacatccccttcctcccctgggccatcaactccttcatccgcctgggacctgctgccagcctcatccaccacgtgtctttgttgccctgggtggtggcagggaatgagggtgccatcctttgagtgtgagcttctggagctcttacactcaaagcatcagaggtgaaagtggcaggagagtgcccagccaggaaccatgggccaggaagcagcccatcctcggaggtggcaggtcactggcctgtcaaagcctccattcccttatctgcaaaatgagagaagtaacgcccctggatggggtatcgcagggagaaaatgacatcactctggcaagggctggcaaataatatcaataccaataacaagctactgtttattgagcactgactatagaccaaatgctgtctaaacacttacatatatcagcttatttaatccccatagcaaccctaggggtgggtactgtcattgtccccattctatagatgaggagacagagacacagaaaggcaatcatttgctcaagatcccacaggatttgaagtgggattcaaactctggtggtttggcttcagcatctacactctcatttagtaccttctttaaaatgttagttcctcccccaaactccagccccacacacacgcagtctgcccaggcaaatagagccattagctataggtgtgagcactccagttaaaaattccagggattaaagcatctacactggcaaggatagaagtgtctacactgcaaggaggatttttcctctagtgctggagagaaatgtgcacgtaacaccaccaaaggagatgcaaccaggttattggggttataaatgtcccctaagctgagcttctgcctctacttcccttttgtttcttcaacactccccacaagaggctgtgtacacagtgggagcctggctgatgctggctaactggactctgaagggagacactgcaacgcatttcgagctgccagaattaacccctctgtacatctcaaaactttgcacagcatagcgggggctttgggcagcctgtcggaggttgatttctgtgatctggtgaaattctgtggcgtgattgatagattgcctttgtagaaaagtgatgctgggattttccattagaacagggaggctcgctgttgtggctttctagaaggtcagagggtaggagctgggaaaatgctacccaagcagacagacagtctccttcttggggccttgagagattcattcaatgtgttcacttcatgcctgccgtggtgcttaagacacagatattgataagataatatctgacaagtccacatggcgagttctccggtgcaaggtgctctgggtgaaaatccttcattcctccaacattcccacaccattcctttacttaacaaatagttaccgggcccctacaggggtgtcaggccctgtgctagttgctgagactaaatatagcgttgaacgagataggcaagttctctctacacccaaggagcttacatcctgttgggatgcagagcaggtaggcctgacctgcttggtaagtgatggaggggtacatagcatggacccccccaagccagactcgagtggtcaaggttggcttcgcaggggaagaaaagtatacactaaggtttgaagaatgagtagaacctagctgggagcctgcgcaggcctcctaaaatgagagaaagtgtggcacccccgcccaaattaaactggatcatgcgtttggaggccagacagggaggaggaaaggaatggatagcagccagagaggtgggcaggacccagatcaggtattcaccttggtgagatgcttgaaccttacctggagaacaaaggggagccattcttcttaagcagaggagcagcatggtcttatctgcttgctagctgtgaggtccttgaactgggattaggggagggtgggaggtgtaaggacagggcaagggctccaggttgagggcagctgcagccattcaggtgaaagtgatggcagcccgagttaggggatcagcagttgggggtggatcatgggcaataggtgggtggccaggtgcctgctagacacaccgcacagtgaacagatggctgagtgagaacgtggaggctgcttcaccagatgcagaaggtgagggagagggaaaggtggtgtgggaaggggcagctgtacgtgcaaaagcagtgtggacattgggggcagcctctctgggcttggagagctcagccggcacagttagatggccgccctgaatgaagcccaagctgttttgcccccgtggtgtctctcaccccgctgtgcctataaatctctctggttggggccagaggaatggcccagagccatgcagcaagagaagaagtttcagtttttcaaataacacctgccaacagttgctctgattctagatgctaggttttgcctccctttcctctactggcccacagttgtggatgggaaacccactggcacgggtgctggcaacagtcagactgcaccccaggccctggctctggaccaccttccctttgtgtgtcttcagcctcatttcctgctgccaggggaggcattggcaggatctgactctgctgccggctctgccatgaggcaggctgctcccctcctttccctggggagagaggtgtggacacggaggaggcagttggggccccagtgcccaacatggtctctgtgtctctgtctctctctttctcctcccctccctcctccctccccccttccatcccccactccctccctcgctccctccctccctccctccctccctccctccctctcctgctctctcttagttcaatttgtacaggcttttcagagaccccagggaattcacatgtgtattgctttgtaaatgttctgacgatgctctcaggtgccagggctgtgtcttcagcatcagtttgggagttccttcaggagcaaatgactgcatctccctcaacagactgggaacccctgaggccaagggctgaatgaagagaaattactaaagacagagtaagtgcttttgcacgtacagctgccccgtccacaccacttttccctctccctcaccttctgcatctggtgaagcagcctccatgttctcactcagccgtgtgttcactgtgcagtgtgtctaacaggcacctggccacccacccgtcacccatcgctgtctctccctctcttctttgtgctgtctcataaagagatatgtaattaaactaccttcaaacattatatggcgaaaattataaactagaaagaggatcgccaggtagttaaagccaggttgaaatctcggctctgccatttactggttttaacctctctggacctcagtttcctcttgtgctaagtggggatagtaactctaaactcacagagccataaaagttaatattcccagtctacaagcatttataaagtgcctgagtgccaggaactattctaggcaccaggatgtaatggtgaataagacaaacaagatctctgctttagtggggtgaggagacagaccattaattaattaattagcaagaaaatatcagataatgataagtgtggtgtagataatttcaggtgatgtgatagagagtaactggggcttcttagatcagctggccagaaaagatgcctctggggaagtgacattgaagctgagctctatatgacaaggagttagccaagcaaagacctgagggaagagcatgccaggcagagagggtatctatggatgggatgagcgtggtcacactgtcaagggattagactgtgttcttggaaaataggcaaaggaaaggggaacacaagtcagggcggtgacagggctttctcacattgggctttgtagatcttattcttagcataataggacttagtggagagtcttaggtggagagtgacatgatctaatttaggtttcaaaaaaaattatctggctgttgtgcatagactggactgtaggggagtgtgctagtcaggagagcctgcgttgtgccccactaacaaaataatcctcaaatctcaatggtttgttacaacaaaggtttatttcttattcacggaaagttggatatgagtctggcaaatctccagagctactctcttccatgaagtgactcagggatccaggctcattttgtcttgtagttccatcctctcaatatgcacagttaccatccaaagggggcacaaaaccaagagagtcatgtggattgctcttatgggccagtctggaggtggcttaagtcatttccactcattgtgtccatccacacggatgcaactgtgagggaggctgagaaagtgtagttttactggatgcccaggaagaggataatgaaacaagatttggggatcatacagctgtttctgctaaggacagaagtgtgtatatggaggctctcccaatcttcctgactaggagagctaagaggctctcctagtcttcctgatgagggatgatggtggcctgcatgtgagaagtggcaatgaggatgcagggaagtggacacatgtaacattcatacaacacttggtactatggctaagcagtaggcccccactacacaatagctcttattttaatatcctttataattaaaacaccttaatctttctttacaagatgaagtcatatttgccaaatgggttttctctgatttcacaaggtcaataggctggaacactttctgaccaaggcgtttttttttttttttttttttttgagatggagtctccctctgtcaccccggctggagtgcagtggtgcaatctcggctcactgcaagctccgcctcctgggtccatgccattctcctgcctcagcctcccaagtagctgggactacaggcgcctgccaccatgcccggctaattttttgtatttttagtagaaatggggtttcaccgtgttatcaggatggtctcgatctcctgacctcgcgatccacccacctcggcctcccaaagtgctgggattacagacatgagccactgcacccggcctgaccaaggcttttttaaagacatgctcataaaaccttggaatgtagtaatggcttttagagatgttcaagtcttccttctgcattttaacaggtagaaagagtgagtgcttcagaggtggccgtagctttgctccagtcacagaggcagtcgacatctaagcaggggccagggccagggcccaggtctatgtgcctgtctatgaagtcaagtgatttccggatttcttctcccccagcaagtccaagagtacaaacagctggggaagcctggggtagagtttctctcctggtcacatcagataagatctgagtggaagaggaggaagggaatcagagaggacttggtcttgcccacccaaatctgtctgctgctctttttccttcttgtgcctgagaaacaatatacgggggccgggggtacaaagatcatgggttccagcccacctctgccatttcctcactgttatatcttgagttagctacttaccctctctgaactttagacttcccttttagaaaagaaagctaatgatgccagcctcgccaggttgttatgagggctacatgagatagtgtaggtaacaaacctttagctcagagcttgatacctagaagatcctcaaccctggaagtaattaattggaagaaacgctgagcctcctctcctcaccttccccctcacacccagcaccctgggtgctgtccctgtgtcaccttgtaaaagcccttctggaattgggacaagcttaggaactcactctaccataataaatgaatgtgtccctctttccccaagcaggctgcgtttcccagcatcttcatccgatgtgcagggtctacccagccccgtgtttctctgctgtaagatacactatgcatccttggcaccttgcccagagggccagggggggcctcagcaaacccaaactttcctgagtcatctgatgggctacactgtttcctggcaccctaatgtccttaaatgaacttctgttgtttgccttgaatcaaattcactgggagcaggggagccaatgcacacccttgaggactgggccaggtcccaggatgggccacagcccatcagccttgcagaagctgcatgggccccttcgttgctccttggtcctgcccagagaacccccaggctggatcctaccagtccctgggatccagcatggctttcagaagtagctcaataaagagaatgttaaaaccttttaatgcttggcagggaatctgtcctttgccaaaacaccaattaaaggcccaggccagttcaacatgactttattactagcattttatctggaagagaagggatggggggaggtagcattttatctggaagaggaggcaatgaagcctctgggaaacaccctctctgcttcctctgacaggaacaaccccgcacagtcactgggcgcctgcttcctagaaggctccagagagaagccaaaagagagaaatgagataatggagtgaggttactcaaagaagcctttctgaaacagcagattttaagctgggctttgaaaggtggatcaagtcaggggaaagtggaaagaaagtgggggcttctcaggcaggagattctgcaggagcaaaggtgaggctgaggggctaatcctcagtgctgattggacactttcattgtctcaggaactgcgctaagcattttagacgtgatctctaatctttcaaaccaccctgggacacaggctctatgattatcaccattttgtagatgtagaagctgaggtttaggtgcttctacccagttcatgcttgtagtaagttctggagcctgaactaggcccaagcagatgatcccagtgcttctgctcttaaccccaggctgagaagtgagagatgagttggggagggctcaggcagatgtgaagtggagagagtttgtcattccttgaagtccagaggcccccatttccctctttttgagccattcactggatctagacctctatctgaatacagcgaatggctcaaaaccctaaccctaaccctaaccctaaccctaaccttatctagctccatccacacattcactggatctaggtatctttaaccctaaccctagagttagattcaaaaacataatcctaaccctaatcctaaccttatttagttctacccacccattcactggatcttgacctcctgcctgaacttgtccctgggccctggtccctcttgtcagctgtcttcatcctttctagtctagtaggtgccattgaaagccattgctcccaaaggggtatctctctgtcaggtggccttctcaggttgtggctgatggacttgaaattcctcatcaaccactaaataggctgttgcctgtgccactcctggacataggttgtccaagccaagtgtctggtggctctgttccacttctggaatcttccagaaactttgtcaatgcttatagcctataagagcatggtgattcttcagttgtttgcccattcttctatccatccatccattcatccatccatccatccatccatccatccatccctccattcatccagcacttattttgagccagtgacgttgtccttcttacactgggccctcagcactgtgggctgggactatctggagaatgaaggggttagttcacacagcctatctgccttcaggctttgtcaagggataggtgctttgaagccacaaggtgaaatacactgaccccagcgaaagtgacaaatttggccctgcccagatctggtcttccagtctccagccccttcctctgtagagatgtgcatgaagaagtgtcccagcacctggattacagagtgagaaactgaggcttggaggagggggctaagcctgcctcaagagcatggcaatctaaagccaaacttcactctgcactcccctgggtacctgctcattactcacccaccttgatgcccctgctgggcttgtgggggctttctcccatccaagcaggatggtttttgtcaagcccaatattgcccatggtcttgtgcagagagatgtgccctctgcctgttgcaatgctgtgattgggacagacatggacacatcctcacaggacacacagatgacaaaataaaggctcaaatcccttctcctgattctgccatcatgcccctaacttcctcattccctcacttctcatggccctccctttcttccacactcctcactctcatttctttggctctgttcatctctgttctaaatcattccctctttctttccctgaaactccctcttgattataccctgtgttcctctcttcctctctgcatcttacacctgctcacacacattgagagtcatcctcaaccccccttcctactgtttccccatacccaggtcatcttgctccaagtcttgtcaattccacttcctaaatctctcttcaatgtgcctgctcctcccctccctcctgaggtcccaaagtgctgttctagtccaccatcatcttagtctgaatgtctgttacctcccaacttgcccagaggtgcaggcttgtgcagccccagtccattctccacactgtagctagagggaactttcaagatgcacatctgatggtgtcatttcactgcataaacccctgcagcagcttgccattggcctcaggatggagtgcagctctgttccatgtcctacaaagcattacagaatctggcctctgcccaccctgcaccccatctttcatcagccccaacccaggccctcccacctgatgggctagccatgcaatggggcttctttctattcatcaaattagccatgccctccctgacctctgggtctttgcctgctgtatatgccctcctgtatgactagggtaattcctacccccctttaggctggaaatctttcctcaactgccaagtctgggtgagatgcttctgcactgagacgcaactgcactgcaatggttccctgtgattcctaaattacagcatttattaaagtgaattctaattgcctgtttaattgtttgctttcactgctggagccgcaagggcttagggtacaataggcttccagttccccaaggaaagcgtacagctgtctccctaacgtttgttttcaggtcacccagggagccggctcccagggctagccctgagagctgtccgtggtgctgatagttcccgtgtttcagcaaggggcagcctcactcagaaaccaccctggcggtgccctgtgcgcttctcctggatgtttcccaagggggaaggaaaggccttggtctgacattctgaatccacgatctgcccttcccagtggatcggggcctgctggtttgcggaggttcactgggaaggctttgagctgctgccgttacctcctggtaccatatttgcctctcagcatctggctatatttctgagacaggggaggagacatcccagccgcaaataatttaataaagacttttccatccgctagcctaatcccctcttcctccatcttttagtaccagggacatggagaccaggtcccctttcctaaaaccctggcccagttgccggcaagcggacactctctagccaacttctttactccacatcattccaggaactggctgactctctccatagctcacccatctcagttgcctcctcttctcctctcaaacccagccctcttggtaatattggattagcccactttcttgaaagctgattttctatttgcataatccttccctctcagagttgctagggcctccatgataagctgatgggccagggcagtcaagcaaattatactctttattctgaacagcattgaaagtgagggaaattattttttaaagaaaacacacgctttattttcatctccacattccttttgaccaggagcatcatgccagtgttgactgcactagcctatgtctcctggaatacatagatctttattttaccaaactacagcaggcagaatggaagtcagacctatggaaggtcttcttaatattaatagtggagagaatgcatatgaaagccccttgtaatggcaatacattactctttatatatataaatcatatttccacctgtcatctaatttttttccccatccaacactatagacaactgtataggtactttccccatgtgacagtggaggctacggaggctcagagagaccgtatgtcaagtcatggctggagtggaaactagagctgctgattagagtttctaggattcctgatgcactgagctcaattctggccaacaaacacttagcagtacccactgtgtggcaaaggcaccgagctacagccacagaaaggcttgggtacagtgaatttctactgcatgcctactgtgcaccaggttcagacattacaacctggaggatttagcccagagcacagacatctacaaaaagggggctggaagaatagtcaagaggaaggcatccttttccttgaggctcttctctttgtccagtactggacaaagggtagaatgacatgggaaacttctccctccccctcatgaacccttcacctgaagtcttctgagagccccgtgggcaaggggccccctgctgcagtctcccactcaaaagtgagtgatgctcttcattgagctgaggcagggccgctggctgctgagttatatttatacaacttgtaaatcatcctgtcaggtcctcctgagaaacccaggcaccaatgtgcaggaggtagcagcctctgttggcttcttcaattcctttgggacagttgcgctccttgacactccccaagttttttggctgcttaaggtgacccaccaaggatacacaagcaaagacagaagggatgggagagggaaaggggttcccttctttgcactgggctttgttgctctctccaagatctcttctagggggtgtttggggattaaagggacttctgtctaccaccctgcctacttctgttctcttctctgtctagactgattaaggagcagaatgtcccagaggcaagagaagggactcagtaaccaccaatggtaaggtggaccctgtagcctttggggctccagcaaccttgaccttgacagttggtgcttttagcaaagcccagtaggatggtagaaggaggactggattgggagtcaggaaacctgggttttagtcttgatttttgtcataagtacactgtttgaatttgggcatgtctgagcctcagtttccttgtgtgtgaaatgaagcccctgtgtaagaatgtttaaggagagaatccttccttagggtggaggcatgatacagtgaagagctcagacctgcattcaaagcttggtccttgcgttttccagctgtgtaaccttgggcagtttgcttcacctcattgagactcagtttcttcatcaataaaatgggaagatacttccttccatgtgatcttgtgagaatggaatgcacagcaaagctcagtttctgatacaaggcttagcacctagtaagtgtgcaaaagtgctcatctctccccttccgccaaatccagtttccagacatgctttctgcaactgattctgaaagagtaaccaggcttcagtgctcatctgagtttgatggtggacagaaccaggcaaggagccaggtccagcccttttttccctctctctccctttggcctctgctggggcccttttgaaagcaggcaaaacacaaatacatattgaaagaaattaaatgggtttggccactgggcctttaggtgaataaataaaacagtaaaaggagaaagattactcttaggttgggcacctgccacatcccctcggggctgagccacatgactgaggccagtttatgagagaaatctcagtggaactttggggccaggccagcttgggtttgcatcttgattctccctttgggcatctttctgatgctgaatggggccactctaagtctcaatttcttcatctgtaaaatgaggagatccatacccatctcacaatggtcaggactagaaagaaagccaccatgaactcattgtggacagtaggtgctcagtacaggctagtattccaccctgtcccagaatcatagaacaaatcaaggtcattcattttaactgcagaggataaagaagaggtctgaaaaaggccactgggtttggcctccataaagttcctgttggaaggaagtccccctacaaatgcctttcctccattctttgcctccccagaacctcttgcattctagtcttcactcttttctcttcatggggactttcctcctgacattttatataaagaagagagagagaaaagtgtgagggatgaggctcaaggaggaagggtgtgtgagtgtgtgtgtacacacataggatgaggaatggtacacacgtgtataggctgcagagaaggagccagtgggtggagagaacttggaggtgcactgatgtgaaagtcaatgaagagatgaggccacagcatgtgtaggcaatggcgggcttgggaacccaagtgaagggctcaccatggaaagaagcatgagttcttgggcagtaggggcacaacggtgttctggagttgtgtgtgtggtgacagacaaacctgggttaaaactccagctctgtaacttgctagatgtgtggcatttgtcatgtcccttcatctctccaagcctcagctttctctcttcttgaatgggtataaaaacatccccctcatcgtttggagaggcagtagatttaagtcaagactagcacagtgcttggcacttggaatattcttaacaaatgttggctccctttcctcctcatggctggagaagcacgcagaggatgagcgaagatgtggagaggggcaaacaggagggacactgaggatggtccgaggagagtgaaagcccaatgtctgtcgagggaaggggcaggtggctggtccaggggccaaggccagccaagaagcaagaggcccagaaatggtggcaggagagctttgtcttatctttgtgctgcagggtgggggagccccaaaattggagcttagcccgggagggttcttggcttcaccaggaaataattcagaggtaagccgatggtgttagacagcgacttctattgaagcggcagtgcgcagcagccgctgagggaatgctccttgcagagcagggctaccccacaggtagtgcacccatagtcatagtgcagaggccgttttgcactcctatttatacccactttcaattacatgcaaattaaggtgtgaattatgtggccatttctagaaaaagggtggtgacttccgggtcatcaggtcattgccatggaagggggcagtaacttctgagtgttggcatggcaatggtaaactgacatggtgcactggtgggcatgtcttatggaaagttccttcatgtcttatggaaagttccttccatccagtccctgttttagctattcctcagtttggtccagcgtccgagccctgcctctggagtccagtcccacctcctacctcatttggaacttctgcacagttgccataggaatccatcctggtcttggctagtggggccttttccacgtggaggtgttgggggccacctacctgaggggaggtatgcagagtgagggagcagcagatggagcctaggtgaagagatggggggacatcgctttgcctcgagaccagaagtgactggagacattctaatcagtcctatctcttgtattttgattcaaatggagcctaggactgctggagcacccagctggggaccccaggccaacccagctctctgttcctcctcccacttcagccaggccaagcatctctggctgcacctgcttcaggaagatgcttgcagcaactaaatgagaggacgcatgggaagcccttagcaccgtggctggcctataaaatgttttccagaagtgtcatgcaagaagggagaagaggagacagagaagaaaagccagtcaggggtcttaggtaggaggtgggacttgacttcagaggcagggttcggatgctggaccaaactgaggactagctaaaacagggactggatggaaggaactttccataagacatgcccaccagtgcaccatgtcagtttaccattgccatgccaacactcagaagtcactgcccccttccgtggcaatgacctgatgacctggaagtcaccaccctttttctagaaatggccacataattcacaccttaatttgcatgtaattaaaagtgggtataaataggagtgcacaactgcctctgagctatgactctcggtgcactgcctgtggggtagccctgcctgtgaggtcttaggtcttggccctctgggccagaacagaaggacctggtacctctcagaactcactctcaccatcagcgtccagaatgtctccctgccttaaccttgaagatgccagaggaagtggagggacttgggtctgtcctaggcagggtttcccctgaagccccccgacccctcagacaaggatttgagtacaaatcatgtattttggaggtgacgtcgggaagtattgtcaggggagtgtggatgtgaaccagcaaagggaagaaagccagtgaagttgtagcactgggcaggtggggctcagcttcaccagtgagctctgggaagtggagtagaatggagttgctaaatctccaatgtgtgtaagaatcacctgaagaggcttctgaaaccttccagagccccacctccagagagtctgattcagcaggtctggggcgggactcaagaatttgcatacagcaaactcccaggtgctactgatgctgccaaatcgggaccgtactttgaatagcagtgtagactacacctctgggttaatccccagcccacaaagggatggggaagctggagtatttatccacccactccgcatctgtccttgttgagggctgcttctgggggcatgaactctggaggttctggcgaccggataaagaacctgaggcagagagtgcagtggatggcagcaagtggacacgtgaggacggatgggatgaacactgtggcatctgctgcaagctcagagggtccggctttgaatcctggccctgtcttctataatttgtgggatttaggtaaagtctataatctccccaagcctcagtttcctcattgaaaaaatggggataataattccaacatcggtgtcattatggagatgtaatgagattaatctggtgcgagtgtctggcacatagtagatgcaccgtaaatgtttattgcatctgtagcagcgctgttccagaagcgggatgagagaggtctggttcctggagagagctggaggctgcaggctggcacaagccctgcatgaatccatgtctgcttggatcctcgttgccttaataagtaaataatcaattgagagagattcttcctgggtgctaagaaccaagtcctttccatctgcagccatccagaggcaagctttactagagacctggcctcaaggggctgcctgcgacctggcatgttttccaaggggctggtgaggcaagtctgcatttccaggggtggttggcaactgcaactgcacactgaatgccgtgggaatggaatgcattggccgcttccccttccccaccccggggtagctcccagcccattcttttccctccctcccttgagtatgtgggggatggcataaaaggaagcattctggacatccgcaggatggggcaattggcacctgcaagacaaaatcaagaatttcaggtggtgggaggtcgtgcagaaaagaggagaggtcaatggtggaaaatacggagggccacttggggaaataaaagaacaacaactcagagggttaaccatatcacactgagtttttctagtttataatagcactggggatttggatgtaggatgctactcagagccagtttcgggaaggactcttactgcctgggagccatttggctttctcaacctacttgcatcactgcttgtgaaacaacaatgaggtgagcctgagcaaagggaagaaagagtgtgggggtcctccagccccacccccacctctactaggcacctgctcagcaccattgcagtgtaacgggtccagttttgaaccaggcgaatgcacatctgagtttcaggttcatttttgcctctcactcgctgtaggatcttgggactccggtttttatttgcgatgtgaatctattcagttatctctggggtcctttttgctgacagcttctggatcttaattttggggaggtctctcagaaccaaacacttctccagccaagcaggtttagggagaacccagagcaaccttctctggcagcatcacccagagcggttgcgaaaagtgcggattcccagtcccactggggccctgcagagtcagacactcttcctgtaaaacccaggaattttcttcttccactgcatgctcatcccccctgactctcacacgtattgcattttgagaagtcctgtctaaaaaacaagaaaattttctcgtcttctttctcttctgtagtcagttaaacaaagccacccagctgggccaggtcacctgatgctggtgcatttaatatctaagtggaagcaacaactcatcaaaaggaacagtttacaattgcctgggataaaactattttcttttcaatcttccctggaaagtgacagataataaccagcctggagactgtaatattattagggccaaaaataaaataaaaccccttaactgcttcctcttacagagagaagccaaatagttcttcaactcatttaaataaagtgattgttttccttgctcattatcttaaattcccaggagtctgcagtcccctccttctgtatgaggggatggccctatttccccctctctcatcatttcttatttcacaagaatcccgttaagaccggcagcaagaagccatgcatttatgaaccacttttagcatgcttgctttctgcccggcccccaacccttaaattaaatgagataatatatctgaggcatatagaacaactcctggcatagagtaagtgcccaactcatgtttattgtcattattaatgacatttgaataccatgattctggtctcaacaagatagtctgtgccttcagacaagtcattgcacactgagccttagtttttccagcagtgaaatgggggagagaacacatggacggagggagcccagagcagggattattatgctagaatctcattacaggagggcatgaggacagatagcccctaggcaaaggggttagagttcttaaggccttgttatttccttaacatacctacagaacatacaggagctatgtctgcccccagaccggttggtgcaaatgtagctgaaggaatcattgaatttgacctaaacctctgttcttctaggaactttgttccagatgattctctgaggacaatttacctcctctatgctctgtctcctcttatcagttgtggtgacttagatggctcccgttaccttgacaaccctacccttccccttctctaccaaatgaagaagacagggcctgctttgcagggccatggtgaatattcaagccagcttaggctcagggccaccacaccgtgccatcccacaaatagcagctattacagtggtcgtgagcatgatgtcacaatcccggctcttttcacaagcctgcaaccccttccctgcaaaccagaaatccaaaaagctctgataaatgaaagatttattttattttgttctattttttgtaattcattggatgagaaaactgaacctgacctgaactgacttgaaatgacttggtggcaaaacccagcctgggtcgatgggaggatatttatggtatttgtttttctcacttagtatcaccatccaaatgcgtcactgcagaaatattaatgttgagtgattacacagtgattctttggaccccagttgtgttgtgtgatatattgaacaagccccatatcacctttcagaagtagggttcagcctgagctctgggacacatctggctccaagggttcgggatggtggttgtggaactagtgttaatgtcaggcaaaaattctcacctctgggtgtcctctgggtgttcctcctgcaagcttccattctgggaaaattgttgttcatgcagcggcctcctcacttgcccctgtacataaatccagctcaaacccacccacttgggtacacctgcatccttggggagcccctttcttggagtgcttagtctccatcctatcacgctgcccacctgcccctacaccagtccggtttccaggccaactcctgtgcccatcaggccactggaagggacagcgtcctccctgcctgacctccacatgcttgccttcccccatgtggcactgctggctgaattctctgctcttcactccgatttttggcaccagagccacacaaccgggatctcaaaacagaaagaatgcatttcctaggcaagcccgctccttccttaagctcgcaggctgaggagcgggcaaggtgcagccaatgggctctgtcccagcgcctgggccttccactggcattttctccagcaggttttcctcctgagccatagagattaagagcttggaggtgcccactgagggagaggcttttagggatttaatgcagccttgatgaagcccggagacaggggcaaggggttctttgctatcagaacgtgcagatgaggtgggaatgccccagaaatttaccctgcaggctctggaatagcaatattattatgaataatattgattgatcactttccatgtgtcaggctctgcattgagtaccttacatgaactatctcatttaatcttcacaagaccctaggaggtggctaccattattattctcattttatagaaaaggagagagggtcagagaggctaggtaacttgttccaggccacacagccagtatatggtagagccaggagctgatcacaggcagttggattcaagagcccaaattcttgaccatatgtgtatctgtgatctattaccatgaacatgctgtgtaacacttggacacagagcctcagtggtgtacaacaataggcacttttttctcacacattcaggtggatgagctaggtagctgtgcacactcatatgtctgagagcatctgacctttgactgacccaggctgtcctcactgggacaacaggagtgaccaactctgtcccatgtgtctcccatcctccagtgggctggcccagcatgtactcatggcagtggcccaagaacttatgtggaaacttgctaggcctccagaggccatgcactgtcactcatgcattgtcacctccctgttggccagagcatatcacatggccagcccaggtccaaggagcagagaaatagatgctgcctttttagtgagaaacgctgagtgtggacccaagaagtcgtgaaaatgggaacccttttgcaattcactacgtgacacaggggccttcacagccacagtgtgcacctatgtcctgcagggagacaagagggaccacctgagagtctcatgaccctggattccacctctgtgagctcccaatcaaactgaaagggagacccagcaaatggggtcaatgaaagctctctgctttcaggaacttccaggactaataagggagacaatatttgacctccaggagaggccagcatgatggaggagactcagtctctgcccttggagagcccatggcccctggctgtggagagctgtatgtatgtaactcaggctcagagagctcccagtaggacagggtaagcattgacctcactctaatgggaatgggttgtctaataggtgaggcaggacactgatataagcagaaaataaatgtcattgtacactgaggaccagctgatttggggagatacgggaagaacttattcaggagagtcaatttgtgtgggcgttttggaggtggtgaggttcagctacagttaaggaagcagaagcagctctcagctggacaaggattagaaggtgagcatcagggtgctcaggaaaacaggatgtggggagctcattttccagttccttggcctttgatggagactcttctctaccctgccctggcctcccacttgggcccaccctctggtaacatcctagatttcctctgcctccctcactccacagcagccactatggaaaaagacatttctaggctcagagggagagtggaaagaggtttggagaaaggcctcaggccactttgagaagcttggaaaaaggggagcatggaggaagcgggagaagagggtagctctgcggctggacctgggactttcccagacactgagctctcagatcacgggccctaggtggaggctgctttccttggaccatgcctgggtccaccgtcagagttggaggagctcattctgcagcctgtgtcttctagaacaggcctctaggagagaaggaactgcagcctgcaggccaactctgggccaccacctctttcataaataagattctgtttgaacacagccatgctcattcactcatgtattgtctgcaataacagactgagtagttgtgacccagaacatttggcccataaagcttaaaatagttactgtctagctctttacagaaaatgtttgccaatccttgctctatctagaacgagaacaccactaggacagggatcttcgtctgttttatttgctgctgtgtccccagtgcccagaactgtgcctggcacataacaggtgcttaatcaatgcatgcagaatgcaggaatgaacgacttggcctctctacaaatcatgttttcaaccacacggagcaatattacccaacccctttgttttaatctacttcgactgatcattttacagatgggaaaacagaactttgggaagtccaagtgagcagcattagtcctccagccagttagtagcagagccagctctgggacacaggactactgacccacagggcagggctctttctgctggacatgctgaaatgctcctcaacagcttcttaccacaaggtagcctgcaccatcagctaggagattttctcctttggcatttggcaaaagattcccagctgctgtaagtgcttttgggctgtggctgggggtgtcagggactcctgggtcccaagaagtgaagctgaagccgagatgggtcccaaagacaggtcaccaagcttacatgtgatatgtctggaaagacacccaaccccaactcaggtgcgcggtgaaacctgcagctgtggtttgcctcatctctcctccggccctaaggtggtcaccaatgtgccttgggagtgggggaagttatttgtcagaacttgcaaaacaaaaggcaatttattcctctgcagatccagaaacagatagaagggcgggaggaatcatgcatgtagttggtctccctcctgaaggtctccagggttggagaaagggctgagagctgtcccacaggcttatccggatggaaggcagtcttatgtcccacatgtgacaccaaaagcaggaatccctcatccctgtccttggcagattctacaagttgaaacacatataggacaggcccacctcactcttgatgatagctcccaggtatgttgtatagtaaatcctgtgcctgtaacaattcagggcaatctctttcctgagctggtcgattgttcttgatgtcctcagctcctcgtccaaacctcttaatccaggagcaaatgagctgtaaacaaccgcatcacatggggcgcaggaggagctgctattgaaggaggaagtgaggctgcagcagctttgcaaacagagggtcactggggattggggtggctgcagactctgatgggatcccatagcatctgcaggtgagggtggctgctgatgccgatgagacttggggtgatccacctggggcaggtcttggacaagtgtgatgccctgaggggccatttgggcatttgcctgagactttagggtgactgtcctttctcagtggatgcagaaggatccagacagccttgatcctgtgtcattggcatggatgcaagtgtttggggaggacttgttggaggaggaggaggaggatcagcatctttgaataaatgatacgtttacaaggaaaagcttactgtgggctcccctcagccaagaagtgagactgaacagaaggtctcttcttggcccagaagttctctaaagtccagagtctgcacctcctgctgcagagctgtgtctgggagctccataagagtcagagctgtgtctccaccatcagtctgatgattcctcaagaccagtaagtatacatgtgcaccggaccagcagctcctagtgggtgggtgctagatacccccagtctgaagcgcatctccctcatccctccagcagcaaggtgagccctttcttgctctccaatggtgatctcggacctttctttccccgcagggccccttgagaaagagcagagtcttccaggaaggcaagggcagccactgagttaggaactggaatttactgtgtgaccttaggcaagtccttttccctctctgggcctcagtgtccctcaaacaaaaacccagagacttttccagtatgttagaagcatccttccggttctctcagctcctgccatgtgccttctggaggtaaccttctaaggactctgcaccaaccaccgcccttcaccctcatgctatctccctttctcaaggaccccgggccccaaggcagagccaggtggcatctttgcacttacactggctgactctacactagctgttttgctccccattctgccttcacagcatttcttgtggttgaactaccagtcttgcagggaagcaaaatgaagagaccccaaccctgcctgccatccactcactctccaaagtgcagggaaacagctcctttgaagacctcaatttaaacaagggagagaacagttctgagattttcttcccactctcttggctccatcccttataatggtttcgttcccaagccccagatattctggggagggtgaatgggcagaggatgggggtgggcctggatgactcatgccctgcaaggttctgccaacactcggcatctggtcctgcttcatgcctctccagggcagcctcgggcaagagggagcccttggtgtcagaatgcagggagagggcactgagcaccaagctggcacctgggtgggaggtgtccaacacatgcagcttccttccctgtgcagagcatctgcagcaggactcttcttggatgctcagagcccaccattaactagagaccagatttctgaccaaggccatggaggcggccatgttggctgcactgaaaacagccgggctccgtgacaatgggcttcctgcccttcgtgcagaccccaccagtggaggggtgttcttcagcctccttcacatcagtgtccatcagagattcaaaaaaaaaaaggaaactacccaaactggtgccatcaaggctgtcactcactctcctccctacgagccagccgcatgtgcgatttgacacactggtagcatttctgcaaattacacatcattctccccactgaagccacacctttgactgctgtaatatttacctgaccgtgcaagtaattttcaggcttcacttagtgggccactgaggcatggaagaaagcagggatggcgttgactttggacagcaggcccaagagaagctgaaatattattagaaggtgtcctaatagctcagacaagcacagagagacagctgctcgcagagctatgggcagaggattggttttcatggttctctatgaagcattgtctcactgctgcttacatgactctgaggatggagagctcaccacccaccgtagacataccattccatctctgagtgcctctgacagtgacaaagtactgtattgacactgatgatatctgtcatcccataacttcaacccattaatgctgcctctgcttcatgggtgatgtagaattaaggtgatcagctcattttgacttgcccagatgtttcccagttttaacacagaaagccccacatcccaggcctccactttaatgagtaactcagtgtggtttgtctaaacctatccagattttaagtctgaaagtcctgcatcctggtaaccctctcaatcacaagcaaacctggcctagttatcaccctatgcagaaaaatctatgtcagcaaatctgaaaatctttcctcctccatctgatagcctacccaaggtacaagtgcggttgctgtgattcctcttgccctccctcccctaggcaccccagggaggcaggaaagatcaaccgggagcatcagtggctggtcctgtctctagaaggagcaacatggtggatgggccagactcagtcttgggctcaaacccacctgtgccacttcttagctgggtggcctcagccaaagccccagcccctcagggctgtggaaggtgtcaaggagattttgggtaggaagccccaagaccatgggtgagtagctggcatggaggatggcaccttgagaggctagggatggagtgtggctcgtgatggaccaacagggtgtcattgagaggcagggcagcatggcaatggtcatagcctgagttccaagtccactgtattagtccattttcatgctgccgataaagacatacccaagactgggtaatttataaagaaaaagaggtttaatggactcacagtttcacgtggccagggaagcctcataatcatggcctcacaatcatggcagaaggtgaaaggcaagtcttccatggcagcagacaagagagaaatgagaaccaagtgaaagggttttccccttataaaaccatcatctctcgtgagacttattcactaacactagaacagtataggggaaaccgcccccatgattcaattacctctcaccaggtccctcccacaacacgtgagaagtatgagagctacaattcaagatgagattgggggtggggtgggggggacacagcgaacccatatcaccctctctgccacttcctggctacatgatcttgggccagtcgcttcacccctccaggcttcagtttcctcatctgcgtggaataagagccctgcttcctaaggtagttgggaggatccagtgagcaagtgcacacagggcacttagcacctggccttagatgagttctgaggaaatggtcgcacttccactgttgtcatcgctgctctccacatcattatgttcatgctgaagatccatcacccatgtgaccgcgacagccccttcttccattttccagctttggaatgagtggtttggaagaagctggatctcttaataggttgagtgtgtcccctcggctcttgccagggacctggctgccctggggcagtggagagggggcctctcaagcctctcacagtcttgcccactggacaaaagaggcattttaattcaaagatgcacttaactttaaagatccctcccccagaattttccccatttggcctttgacatgcattcaaacccctcagatgacagagatatgtgggaggagacaataaaaccacaaaaggaatggacaagaggcccagcctctgtccactttatgctcaggtgggagctggtgtctttccccgttactggccaggtctccttgcccccactgggccctccaatcccttctccactagcagccagacggatctttttttttttttttttttttttttagatggagtccccctctgttgcccaggctggagtgcagtggcatgctctcacctcactgaaacctccacctcctaggttcaagcagttctcatgcctcagacagtagctgggattacaggcacatgtcaccatgcctggctaatttttgtatttttagtagagacggggtttcaccatattggccaggctggtcttgaactcctgacctcaagtgatccacccacctcggcctcccaaagtactgggattacaggcatgagccaccattcctttcctttcctttcctttcctttcctttcctttcctttcctttcctttcctttcctttcctttcctttcctttcctttcttttcctttcctttcctttctttctttctcactttctttctttctctctctttctttctttctttctttctttctttctttctttctttctttctttctttctttcgtctttctttactttttttttttaaccactctgcccataaagtccttgctctctggggacaacaaaacaaaacacaaccagatctataatgaaaagcaaatgggtttttttgttgttgctgtaataacaccaagggtttgttcaaagccaggtaaagatttttttttttaatatactgggtgattttttattgaacagtttccttataatagaaaccaacactagactcttgaacttcctctctcccaaaggaaataaaccaggcctcctgcagacgaggtgggagggaaaacatgagcacagctctcactgggacctgagataggagctgcccgtgctacctctcaggctctattaggaccccagtgcctaagtctaactcctgggtgtggctgaaatgcacctggcctgggagtttgaatcccagcttcgccactagtctgctgctctatgtgttgggggaaatcactcggcctctctggtaaagacacctaccaagtcaaagatgagtcaggggctcacatggtccagttagaagaaaagaattgtaagtgtgtggcagagcatttgggtattggctaacttgtttctttaccccattattatactaggactggagatacacggtgttgggcaaaatggttccagcccctacccttctgcaatttatagccaggtactatcaggtatctatggcaaaggcctatgaaggctataaccacaccttcttgctcaacactccagaccttgtgccttatcacaaagctagcctcttagcctgggctcaagaagtaagtatgtacaggttctggtcaggttggccagaagaggagaaactgaactcttcctggagagattaggaaaagctattgacctgagtcgcaaagaatgagccagaatcagacaggtagatgaggaaaagaggggcttataagctagaccaggggttgcctaactctggcccattggccaaatctggccatctgtttttgtaaataaagttttattggaatacagtcatgttcattcatttctggattgtccagggctgttttgtgctataagagcagagttgattaattgtgacagacgctgtgtagcctgcaaatcctaaaatattcttacagagaaagtttgctgtccactgatctaaacaaaggagtcaggccaaggaaaggcccagaaatctctttcttgcttagaactagaattggccacctaatgactgggcatggtggctcgcacttgtaatcccagcactttggtaggccaaggtgggcggatcacttgaggtcaggagttcaagacctgcctggccaacacggtgaaaccccatctctactaaaaatatgaaaattagctggatgtggtggcatgcacctggaatcccagctactagggaaggctgaggcaagagaatcgcttgagcctgggagacagaggttgtagtaagccgaaatcgcgccactgcactccagcctgggtgatagagtaagactctgaaaaaacaaaaacaaacaaacaaaaaagaagtggctacctaaattgtgtggcccaatgcagaatgaaaacaggggcctcttcttaaaaaccgattacaaatttcaaatttcagaagcagagtcttaaaccaactgcagagcccttgtaggcacaggtctttgtgcagctcttgcaggctctgggcagagttagaagttgcgctcatgctcttccctgggaaaccacactgggagtagatctgggaggcagtcttgacccagggatctaagctggggcttggcgtctccaatccccaagccaaacctccagaaagaccagcctcggatctactccccaagccaaggggatggagaactgaccttcccgtctcagcaatcccgtcccattcttggagcctggctgtgatgagaagcagaggtgggcccagctgcctctcccaccgggagtgtcttggtgatcagacatgcagcagccataagaagacacatggcagtttaatgggaccctctctctgacgatgctgttctccccatgctcacctggaactatctgatgggggagcagtggggaaaggaacctcacctcacccaactatggaacagcaaaatgagaacaagggctcatggaaaccttccatgctaggtgtccgctcaaccccaaccccttagattcctggactaaagtctgtgtcatctgcccttccattgcacagacacctgcaggagacaggaagccagatggaaatgcggccaaagtctttattccccagctcctcccagtggggcccctgggtccctccacccaagcttttgggtggaattcttcttcagctgctgctctcttggattcagggagacctcccactcctttgcccccttcccttttctcctaagaggactacagtccccaccggtctctgccccagtgttgcctcatgccttattggaatttctccgccgtgcccatatctttgtaaatcaccttggaattaaggtcttcttatttatgatcttttcaaggaatatctgtttcctgctgtgccctgcctggcacaaccatcttcccccaacccaaatggcttcagtcaaatagagccttgtaacagatggaagttgcatccacacttcctcttgcaaaggtgggtgctgaacagggctcctccttggcaagaagttgaccactgttctggctgagcaattctaatgcttcccctggtgtctgctgggatcactgggtagtattcagtgggcggctgatctggtctgcaggggtcaaggcagctttacccacctgcaggcatggctagaaggctggctcagcaaggtccccctccttctccaggtggcctctctagcaccacaatgggatgtcttaagcagcagctcaggatgtacttgttcccagagccctgaatgaaagcttccagcccctaaggcttgggcttggagattggcacacgtctgccacgtccgccaattctattggtcaaagcagtctccaaacatgtctagtttcaaagggagagatcgtagaccccccgacccccgccatctctaatgcaggaatctcaaagaatatgtgccatctttcatctaccacacattccttcctctcattatcatcaccttcttcatttgctgagagctggggtcacaagccattgtctggggccaaatttgtcctgcagattgtgttaatttgatctacactggggtttctgtttttaattagatgacttggacctgcatagactccctgtctcaacactggtcccacccttcccgctgcctgccaggggctctctccttggctcctggggccatcgtttggtggtcctggactaacaggtgcatgggaccagtcagatgggccacacacaaggacactcatacatacaaattatcagaacttttatataactcatctctcccagcccaatttctggaaataaatgctggttcaacaaatgtgtagaccttttctgaagtctccaagatggtgttggggaaagagacaggactgagagacccaggggcctgtgttcttgtcaccgtactgcctggtggccttgaatagatcgcctggcctccctgggctgttgcttctgcattgtgcagaacaaagaaaagatgtcacccctgcatcgtgcaggacaaaggctggggtcaccccaagtttgaggcccagctcctgcctcttgtctcaggccgatcactccatcactctggcctcggttgcctcctttgaagattggggccataacgtgaatcccgtggggtggttgcaaggatgaaatacagtgccaggcacggagcacttggtcctgacaggccctcctgtacactctgatgctctgtgcctgcgtggggccttcagaggccaaactcccccgccctagctgagactcactcacctctgtgtctagcacaggggctgacacatagtaggtgctcagggaacccttgttggattggactgaccctttgtcaaacaaagcagtagcaagagaaatgaaaacgtgactttttttaaaaaaaagaaaacttgtgcaagaatgttcttagcagcttgaagcatagcagagcccaactggaaactgtccaggtgccttttaacaaaagaacagcttaacaaacatagcgtctccttgacatggaatactactcagtgattaaaaggaataaaccatggtacacacacagcaggggtggatctaaaaaatattatgctgggagaaaagagccttccctggaatctacgtaccgtataattcgttgatacgaaattctagaacaggataaaatgtgacaaacagattagaataacgatcatctctcgggtgaggtttggctgggaaggagcggagggaattttctggagtaatggtagtgttctgcatcctgagaagggctcagcttacactggtgcacgcatttgccaaaactcaaaaagaaccctgagtggtactcttgagatttgtgcaattcattgtgtgtaaatttgacctcaaaagaaaaggaattgtaaataaatattgaactctaaatagaaggtttaggagtaaactgtacaggtgtctgcagctcactttggaaggcatcgaataaataaggctgtgtggctgcatcgagagggatgaatggagggtggggggagatatgataaagcaaacatggctgcattcatttatttatttatttatttatttatttatttatttatttattttattttgagacagagtctcactctgttgcccaggctggagggcagtggcgcgatctcagctcactgcaacctctgactcccaggttcaagcaattctcatgcctcagcctcctgagtagctgggattacaggcgcccccccaacacacctggctaatgtttgtatttttagtagagatggggtttcaccatgttaaccaggctggtctcgaactcctaaccttaagtgatctgcctgcctcggcctcccaaagtgctgggattacaggtgtaaggttttttttgtttgtttgtttgtttgtttgtttgtttgtttgttttgagacagggtcttgtcctgtcacccaggctggagtacagtggcgagatcttggcttattacagcctcaacttcctgggctcaggaaatccttccactgcagcctcctgagtagctgggactacaggcacataccaccatgcctggctaattttctgatattttttgtagagatggggtttcaccatgttgcccaggctgatctcaaactccttcgctcaagcaatctgcctgcctcggcctccaaaagtgctgggattacaggcacgagccactgcacccagcccatgttcacattttaattgtggaagccaggtaatgggtatatgggtgtttgccttaaagatttttacactttcctgcatgttgggaaatgttcgtaatcaaatgttgggggaagaaaacatgaagctatagaactaagctagggcttgtctctgagcctcatctgtcaaatgcagacagcactacccagacgggcaaccctgggatcaaacgagaagcagtgaataaagaggagcccatggggacgtggcaggaagcaacttgattcttctaagcaagcggggccccacctcctcatttggatctcagcttacatgtgaccttctgaggctgccctcccctggccacccatctcttgtagccatcaccctatgttaatgtctgcatggcaattctctctagctgatacatctcttccatcttccttaatttaaggtatatggctcctgacagtagaatgtggattctaggagaagagggacattgtctaattcatggcaatatctctggcacatagtggggacacagtaactctttgtggaatgaaggaagcaatgagtagggcctgcatatgctctatcgtaacccctcaagtgtagaattctgccacccagaatttgcctagtgttaacgccacccccatagaacagcaggaagagaacttagcaatcagccatcccctgggccccatttaacagatgggggagccaaggcccagagagggaatgcaaatttcccagcatccgctaccagtgagtggctgagcagagatggggcccaggtcttctagctcccagctcagtgttcttcctctccaactggctgctggagctcgtggtaaagtgctgattcccaggaacagccggcagatggacagacaggcttcactgggctgggctgccctgatgccatgtgttaattacagcagacaggatatgccagcctagcaatgtttgccggtgcacccgcccctcgtttagcaggtgggcaggctggcgcaggccactgatctgccacgggtctgccggcggccgatcatgctgacacaggcccaattgtgcacagcgcctgctaagtggggtgggccaggcagattggcacagcaagggccctctccgaggactggcagccccttctgactgcattggtcagccagactggtacaagctgggcatctgtcccatgatgagcccttgctggacacaacctgtctacacaggtgtgcccactgaccggcagcccggggggtgacacggggactgagtgctgagcatgaccatggggagaccttgtagggggtgtcacaggcaggggatgtgggccagaacctcacacacaggtacacagatactgggatcagataggactctgccatgctcccgccccccacacctgccctgttgactggtgggatccaaaaatcaagtttgcagccctgaaagaggggctggaaaagtggtctcttctctccaacccaatgcctcttcccaattgccactagttctactgttcacactgcagccagggggatttctctgataccaatggagctgatcactctcctgtttgaagccttcaatggctctccatttccctccaataaaataatagtaataataatatgcattattagcattttacagctaacagcactcagttatagcatgtgtactatgtgaaagacaccttctaagcactttatagggaagaacccgattcatcctccaccctagatggtggtgctattgctatcctcattttacaggtaaggagactgagacagggagataggagatctcaaattgacttgaacctagaggtctgactccagagcctaaccactaccaaacccagactccacatgtgtgagccatgaccctcccacaccaggcccttctacacagcacccccagaacttgtcctgaacccccctcactctctacccaagccttgccttcttgttgatgcctggggacccccatgatctcctcctgtctgccccgaaggctctgcttcaacctccaaagcagggctcagggtccccttctgggcagggcctgccctggaccctccctggcagagctccccggcctgcacgccagtgccatttccactccatgtcagcagcctgctgctgagcgagcacctgctgctaatgtttctctcctgaccccaacctccacctcacccattctgtgaactccctgatgacccctctgtccacaggcctggcctgcaggaggtgtttatgaatgaagaaatgaacgaatgaatgaatgaatgaatgaacaggcaagtgaatgaatgaatgaacaggtgagtgaatgaatgaatgaatgaacaggtgagtgaaagaatgggaagctgaggtcactggggttacaggaatgcacaccgagggtgtgtagtgaagagtggctttctgccgggcatggtggctcatgcctgtaatcccaacactttgggaggcgaggtgggtgcatcaccctgaggtcaggagttcgagaccagcctggccaacatagtgaaaccctgaggtctctactaaaaaaaatataaaaactagccagtcgtggtggtgggcacctgtaatcccagctactctggaggttgaggcaggagaattgcttgaactcaggagacggaggttgcagtgagctgacatggtgccgctgcactccagcctcagcaacagagtgagactctgtctcaaaaaaaaaaaaaaaaagagtggctgtcatggagacacaggtggctgaataagtccctcctccttcctcctcagcccactccttccagaacacaagaggggagggcatttgttaaactgggaaagagcccccgagcccctctctttaggggcaagccatgtgaccctgaaccctgtctctaatgctgggattttccaagagcatacttgtcgggaggcagggaggaggcagcgaggagctggacatgatcacctggtctggaggagggacctgagtatctcaggtgctgcagctgttcagccctcggtgaacctgtgcttttagggtctggattccaagcatctggatttgggggtgtggtggaaagagggtgtgcttcggagcaaagagcctggctcccagctctgcggactcctccctctgtgaccctgggcatgcccctcccctctttgggccttggctttgccttgtgtaaaatgagagccctaaatgggacagtcaagggcgctcctgctctgaatgacctcctagggcaccaagggtccagcagttgatggccccctgggaaagctgcaaagagaccctggtgaggagtgggcctgggggttccggactgtgtatccggttgtggttcctgacccctgtgtccaaatgacctgatgacgcttgttaaaaatgcagaataaggactgcattcagaagtcactgagttggaacctccaggatgggcttccggggaaactgacattttcaaaccccacccccactctggcccaggtgattccactgtgcactgaagttcgaatgtctggcatctatctgaggccctttctatttcccctgcttcctgtctgctagcccctaaagcatgaagcgggagcggggtgctgcatgggaggtggagaaggaggtctcagagctcccatgcatgtgtctgatagagtttggggggctcaggtgtttgggtcgtgactgtgggctttgtattcgactggtgggtgcctatctgggcatgggaaatggcaagggagatacaaccttacatttgccaaaaactcatccccttacatacacacacacacacacacacacacacacacacacacaaacacacaccctttcccggagtgaggagcagggtatataattgcacttacagctgtgggtgcaggcattgtgcatgcacaacaccgtaagtccacaaactgacacgcagccctgaaaatgcctgcatacactctcttacactccctgtgagacctcctggtcttccctgtgctaacatctaaaactacgcatgaacattctcattattactttgcctttcacacacatgtacagcctcgtaggcagcctggaaacacacctatttgtacagtcatccctacggatgcacagatgcacacccatactccgttgaacacaggcttccttgttcacagcaggctcacccacgcaggatggggtcccagctcacaccagtggcacacacctcctcacacttgcaggagcacctgcccacatgtggagtgtgggtcctacaaagaagctgcagccgctctcctccctgccactctccccccagcccccaggcccatctctgagctgctgtctgccatcgcacggtaaccggatgagacaggcaatttatgacaccagctgtctctgtcaaaaccggatctcccacacacaccaggggaagccaattaccttgagcccagccctgccagaaaccggggcccacaagggagagcagggactgcccagagaggtgagtggcacctgacatgaggattttctgcctcttcttgtctttgggcatctggtatcctcttcccccaggcccccttggggaggacagagcctgccctaccctctctgaggctgcttctctggcccagctcccaggcctaggaactgcaagagcggtttcagggtggagaacaggtgggcagggaggtttaggggaagagtggtccagggtcgttatggcaacaagaaagggaagaaccctgtgcccctccccctacacagcaggcggccaggcggctgaatcattctcccaggcttcctctccgccttcattcccctcacctcttccctcaacacccctgccctggttttcctctccctagaatacctactccctttcttgcccccctgcccgaaactaaagccaactctactacctgagccacttcctgtctggactttggaatcagacccatgttcaaagctctccatttcaccacctcctaactgggaatcagggcaaatggcatcccttctctggccatgggttttgcatccaaaagaaaaaatgatgttcattcctataaaaaaaaatgttgaaaaggagtcttctaagtaccagactccgttctataatcggggatgcaacattgaacaaaatgaagtcccaccctgggcttcaggctccactgcaggagtcggaaaccacacgtttcagaaatttagaagagatgagtcagttttctcactgtcctcatctgctttgtttacagccatactcccagcaccaagcacagctcctgaaaggacctcaagcaatagacaaactcacaaaggcaccagtggactcaagctctagcctgaggttgacttggtctagtgccatctttgtgcccagccttgcagggcgctttctaggcatactttctgagtgggtgggatggcggcagatctgcttaagtgaacaggaagtccgttccttccttcactgactcattggttcattccacaaatgcacattgagcatgtactacgtgccggttcccatgctaggctcctgggatcaagtgagatgggcaaggactcccacttgatagttgcatggcagaagtttctagatttgctcatcacctcccacagtctagaagctgagcaataaattcacactaacagcagtgtccacttgcctttgcattttgcaagatgcttttacatatgtttgtttcttttagtatttctcacaactctggggtgtgagtttgtttaatatccctcgcgttacagatgaggaaactgaggcttagaaacaatcagtgacttgcctgagaacccagagccagggagtgaagcacccacagtaaaactgagtccctttctagccctcattgtctcttgcattatctaatttaatgcccttttcccctaactaccatgaaaggcaggtatcgccttaggctgtttacagccagggagcacctcttgcctgggctgggattggaagctgtgctgggctgacacaagatcccaggtgccatccactcctctatatctaatcagttcattaaaaccctccttgcaaacactctctcggctgcctggacacagagacctcagctgctccatttccaggagagcaaattccttcctggctggagaggagttgggataatgtagacaggcaatttaaacagccggcaaaatacaccagcagttttcactctctgccactattacactttccagccgtggcgggattggcccataagtgggatatcaagtttattacagctatttccaacctgtaattggttttgtggaaaacaaagagaaggaggttgggaaggtggggggaggtgatattttccccttttcttttttttttttttctttttcggatgacagcacccagggacattggtgaggcagccgaagttggagacttatttgtttttcaaattaaacagccaggccggtcagcgggctctcacactgctggctggactaagtccaccggccacgctttgatgactctacttgaaaagcaacctggcctggctgcagcctagatttgctggttggggtcagggggcagtcagggcccagaggtggggtctggcagctctggagcatgagaaactgtggtctctaggctgactcttctagaatcagaacactgcgggcattcagggcagcaaagagtcctcagtttcctcatggaacatttagggaaactgggtcccagagagaggaacagtgcagagacaacctttgggacttagaacctagctctctgcctctcagaaacttctacacagtgtagctggtcatttgggggaattcctggctgagatgctctcagcatggggaagaaaagagacacctgttcttaagaacccatgttacggtctgctgccatcattgcagtccacccaccctgaccaacctccctacttcggacttaagaaaaatacgcaatagctaatatgatggagcactttctgttacgatgacaggaggtgatgtttgcaagcaatatctggcacagggtaggcgccaatgtatgccagctattgttattcccgtcatgctattattaccgcatgccaagcaatcccctgggctctctgtgtgttcactcttacgcactgaattctcacacgtgtgccttacagggaggcatgatccttcccgttttgcagatgaggaaacaggcacacagaaccctccaacctcacccagcaatcaactgagtggcagagctgggatctgattccagagctgtgtgaccccaaaagcctctgcacatttcccatatccccaacctcaaagtaggtcttctgctcccttcttttggactcatccatgctgagcggtcagctctgctgtttactattacaagtataatacatgtgtgaccttgggcagttcacttgcctctttcttggccgtggttcctgtctgcaaatggggatcatgacacacgtctcttggtatagttcacttattcaacatcccttcgtatgccaggcactgtgctaggctctgggatacagggctcttggagcttacagtcctgagattccaaggaacaatggaagggagggctgggggacactcagcctgtgtaggcactggttaggatgcagattcttttgcataactacgtgcacagcctcttctgtctggtccaggtgtacgctttgcagagttaggatgttttcctgcacagaatatcattaatgctgggagctttaagaaagagaaagcctgctggttccttttggagcctcacatcggaggtggtctgaggccactgtcccgcctgggccaggctactcttaccagggagtcccagacagatcagggtccaggcacagcaggctgtcctggggccagtctgtatcgcagagcagcaagggccttttcccttttcttcatggtattcccagtgcctggcacatggtaaggtctcaactcattcattcactcattgactcatccagcagatatttatcgagcgagtgccatttgctaaattctggaaacagagcaatggacaggacagataaagaccccatcttcggccaggcacagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagatcgcgccactgcactccagcctgggcgacagagcgagactccgtctcaaaaaaaaaaaataaaataaataaataaataaaaataaataaaaataaaaataaaaatacaaaaaattagctaggcgtggtggcaggtgcctgtagtctcaactacttgggaggctgaggcaggagaatggtgtgaacctgggaggcggagcttgcagtgagctgagatcgtgccactacactccaggttggtgacagagcgagactctgtctcaaacaaacaaacaaacaaacaaaacaaaaaaaaaatccacccatcctcatagagcttatgttctaggagtagctcatattcaaggacctgtgtgtttgttcatcaaaagtctgttgaatatggagtgaatgaaatcattcatttcagaagtgcctctcgctctggggccaggcaaacccacacatccacagggcttggcttaccttgtctgccttgtcacctctgtggttgtcggtcggccctggcctcgtggtccctacccactggcaccatgggagcctctcagagcccatgagacctgcctgcctccaggtactcactcagggcatccctgcactttgttttgaagctgctacgatgactactagcaaattctcggtccctgctctctgcaccccactccttatagacacaacccagccttctggcaccttccacctgcctccctctctgggtgtgggctcccttctttcatttactgaattccacatcctctggcattttagcaagagatgctttgctctccagccccatagacagaaagagccctggagggtggggagggacacagaaaaacagatggtccagaaaggtgtgagtgctcgtgaaaataccccatgagtgagcacttcccacccaccagggactctacaaggctcatgtaatcctcatagggaggaacgttgccttatccccatttcacagatgaggaaactgagactaggggaggtggaatgacttcttcagagcacaaaattaggaaccgaaatcaaacattcaactggggatggaggaaatcagccttgcttcatgctccaaagcctcccatagacagaaagagccagcctaggaccaagcactccctgaaaagggcctacttcctccaggaagccttccatgatcacccttccctccaaggggattcttggctccttcagaagtgtcagaacatcattggataacacttggtaattacctgttgctgctgcagccatcatcttactgactctggaacctcagctaattgtggactgtgtacctcttgtgaataaggtcgtaatgggctgcaaccatgtctgaaatgtatttccttctcggccgtgaggctgcaactgcccctgtatgtctcaggcgtggagaaatgtttctagaattaaaggcgaggtgtcttccagcacacccaccacaccttctgtccacagcctgtactaataatccccaactcccacctggcctctttcttgggccctctaaccaccaggaaccacagaataacatccttgcaaatagctgctagcccgctggccccacctgagcgtgtctgagcctcccatttcctttgccttccgagaggctgagggaggaaggagtgtgtaccacagacagctgggacagtggggcctgccctccagatccctcaccctgcagctgagataagcacttgtctccagctgcctgaagcaggtttcacagaagcagttatttactcctctggctgacagtgaggccctgacacagccccagagaaacagatgtaaataaaaccaaaggaaaactagtctcgtccttgaaactcccctgtccctcagcctgaaacagagatttacgactcggataattcttcagtgctttatctggggtgtgtgggtatgtgtgtggatgtgtggggtgtgggtgtattttcctcgtaataaaaccctcagtctcggcgaataaatttgaggagacagttttactgacagatttttttctcttttgtgtaataaaaaaaatggagtgaaatttgagattgggacgataagggctgccgcattttaggaggagataaaaaagcagtacctgaagggaggtgaggccagaagacgggctgccagttaaacaggcaggatgccttccgctttatgactttgggagaaaaatcctcacacctccactgagattctgacatcctttctcctaatgagcctggccaccaggggtggaaagggacgttgagaggcattcagttcacccgcagtctcttccagcctgatgggatgggatgtgaactctggtccagaagccagacgcttgtcaggaacctagtgtggggcctcagccgaatcattttgcctctccaagcctcagtttctttacctgcaaaatgggaacattcttgtctattcggctctgttcccagggacctggtacagccacacaatgtgatgggcttaaaactgggtttctccacctgggcactgttgacatttgggggccagataattcttgggaggggggcaaggggctgtcctggacatagtggaatggtcagcagcttcctagcctctatcagctagacactggtacctaccaaaccgcacctctcctccccagttgtgacaaccaaaaatgtctcctgagcttgctgtatgtcccctggtggttagggtgagcaaaatcaccccccaagtgaaaaggccctgctttaaaggtactttggtggctgtaaaaaagtcaaatgggtgaggcggggatgggaagagggtgcatggagaatggggagcccctggagggtcttggcctctaccccaggctgggacattgggatgtggggagatggaagctctgatcccaagtacagccaactctcttctccaccccatgccaagctggacacagtcaactcagggacattcttctgggtgatgacagtggacgcagagtcaaggtgtggttggttggggtgagcatctttcttggggtgagtgccagcagggatcccaagaggagaggagaatcctcctgtccccgtcctcctcatcttcctccactctcatggtcccgtttcagaagctgggcctgtgctgcagaagcagccaggtgggaggaagtggtcctctgtctcccctctgcacatggtcagaaagcgccaagccctcagaggggaagaaagtgacgcgtgtacatgtcgctaagtcccgacagagataggaggggtgtgggcttacggaggggtaaggagaagccgtgccctgggaagtctcactgccgcttcctctcagggtcccagagcctgcgaaggccttctcatgattctaaccatcccccgtcctcacagaggccaccttactctttacaaagcttgcaggctatggaaagtgactggcacagacgtagcctgtgtctgcacacagctggttgctcaaccagtgctggccagatgcacggagtctctcctaaaccagtagcaacaccacctaggtcagagagatgtggtccaagtcagcttgggtacatatgtgtccagaggagcccagctgtgtctagggccagtactcccaggcaggtgacagggggacagattcacactccaatcctcacctttttgcctggggaagctgctttcagcatcccccctaccccagccccttggagtcacccgtccctagccagccccctccctgcccctttccccgctgcctccaccacacagagccgcagggagctaattccacttctctaggcccaggcatgaggcctccccattgcaggctgttagcgcagagcccagctgagctgcgagaggctgcaagctcccagtctataatagagttgctgagacaagcggaaaaactgcagccgagtaaacagataaataattgaaacagtgacaacacataccttgctgcttcgtggagtaacactttcattagctggaggcagcgcagatgtggggaagcaggcgggcggcagctgagggcacggacgcttgggttcgctttccatcagccatgaacagcgggacagcccggcagccttgggcttccagcgctggcttcatcgccacctccctgccttctcccacttccgcattcttaggtgaaatggggacttcatgtcctctctcctggcccatcccaagacgagggcaagtgccccacgctgtccccgtctgcatcgcccgtgccgggatgttggattcctggcctcctcccgggctccctgcctctagtcttgcccctttcgattcatcctcaatctatagccagaggagcttgtaaatctaatctaatcctggccccggggaccaccgccttcaggagaagctgagctcctttgctgtggagaccctccatgatctggcccacatttttcttcgcagcctcttctcatcccacttcctttcttctccaggtgctgtgaaggcagcaagcttcccctgagcgcacactgctctttcctgccgcagggcctttgctgttccctttgcctagaaaactcccacccgttgccaggctggctcctactcttccttcaggaggcaacttaaaacatcgctgcctccaggaagccctcggttattaccttattctcaggatgggggctgtccttcttctgggcttcctgcctgcatcttgtcagtgtcctggggaaaggggtgaccagggccggttgagcactcacgtgtggctatctctgtgctctgtggcaggtgacggatggtggcaccatcaagcaaaagatcttcaccttcgacgccatgttctccaccaactactcacacatggagaactaccgcaagcgagaggacctggtgtaccagtccactgtgaggtgagtgcctgggggtggcgggccgacagcgggggaagggcggagggatggggagtggggcagagggcagttctccagccctttcacatcaatccctcggtgctcttgggcttggaaggcagaactgggggctccccttatggaagtgggacccattccctggagggacatcccctggagggaagaggcaggagagggccaggccaccgctcttctgactggcctcctctgccagctcctccaacagtcctggaaggtgggtattccaaactccatttatttccaagtgagatactgaggcccagagagggggagcaatgggcctaaagtcacacaggcaacaatgacaccgctgggcggtgaagcagttctgcccggcttggaagctcaaacaccacattctactgttttttgtgtgctccaaggccataagggccccgagcttaagagagaatgaccccaagcaactggactcccaggtcagaagcagcagggtgggaaggagcagtgctcaagtcggagatgcttgattttcctaccccatccctgttttccaggaggcgggtggcagaatcaagctgactcgatcttccagagcctgctgttctctatgtgtgtggctctatctccttcccacaaactccctacaagatcctagtcctgttttatccctttgacccttaacacacaccggtccctcttctcaaagggcctttctcccttcggtcatctggtaaactcctcatcagccttcagaaccccactccagcaattccacccatgggagccctcaccttagctgaactgatcccccaaagctggtcggctgcaactgccccagtacccacccctcctcagagggaatctcactgcattcatgaagagtgcacagctttgcacacacacactcttccacgccacaccgccaaatgctttgccaggtgcccagcctgaaagtagtggtctgctccaaagctggagggggaccgtgctgcatcgggtaccgtgagggggactgcagccccggcaagcccacatgatgtgcactgtggcaccatgctatgtggatgtctcagctagtgcctggtactgtgttgtctttagactgagcctggaggagggggaagccgtactctccagcacgggctgtgggtctctgtgaccgtgagctccaggaggacaaggcacatgctcctccttcaccttgcatccccagctctcagcccagggcctggcacacagtgggtacataatgaaatttgcaaaatgagtggacaactcaggctacactcctcagcccttcaggcctgttttctattgggtgaaattagaaagcgggacaagaagattgtaaagggtaagtccaaccctgcatcaagaatctgacccaggcatcctcctctgcctgcttttgtaaaaatgggaaggtgagtgtgctccccaggcggcccggctgggtcctcgtcctctctgggctctgtgccaggaccatgctgagaatgtggacgtgaaggtgtgtgaagaggtgtgtgaacagccgcacaaactccttcatccccctagttatgatttctcctgaacctgcttccaaaaagaaattatggtgccttaaaatattaaagcacacctaaaacaagccagttacaatcaagatgaaaaaggagataaaaattcattttggagaaaatagctattctggaaaccacagatggttttgtagtaagtgaactcccaaataatctccacgactcccagaagcctaatgccacccagcccacccctgccggtcactgtgtctctgagaattctttcctcaccaagccacccgctgccaccagcaaggcctctaggactccttggttctgatttctagctaagaaagaaacccagggaccatctagaacattcctgagcaccaccctctcctgcttcctggagcctcaagggcaagccctgctaccagaagacccagatgaaaatcccagctcagtctctgcctactgtatgacctgggatgagagccttaacctctctctctctctgcttcaggtccttcgcctgtagagcagacttgacatgacaggctttgtacaattgtggaatttcagtgaaatttatgtccaacagcctgagttcaaatcctgcctcttccacatcctggcattagtgaaatctggggctggtaaccccacagttgagtttcctgacctccaaagtaacatgacagcactaagaggctagctgcaagttgtgaggagctgatggcgtgcattcaagtgaagtgctggtttccggcctctaagtggtacatgtttgctgccattgcctagaacaacctctccttctcccaccataaaacaaaacaaaaaaaattcacctttttacaaatctcataaagcctccttttatgcgctttctgttttgatctgcacaaacaaccccatgaatgcaggcaggtattattattattaatcattttctctagccctgttcttactacagaagaggtcaaagttcagcaggcccaacagtctccctctggaatgacatgaacttgaccagaccccttgcttttcagttgtggaagccaaggcccagagagggaatgaggcttgcctgaggtcacacagcggccctgacttaagcctgatatcaggagccagtgctcttttcttccccacatgggggccaatctccctgagcctcagtaacaggggcggtctcccaagcaaagaacaccccagggagctgagccgtcctgtttggtgaccaccaagggagagggaaggaaggagcagaccctctggagcctaacgggatcacggaggattgtcagccctcccaaccagccatgctgggggcgactgcctcttcaggctgcagagccccatcagggctggcgacggggcgcgggactccgcatttacatataaatgaagatatttacaaattaatgcatctcaacgagagagagtcccagctccacagctgtctgagccgtttcctcttcagctggggaaagtagggagagaatgagactgagaagattaccaagaattggctgagagcaatttcgcgggtagcctagaggagccccaaggactcctggagctttttgtcccactgatggggccctggagggatggaagtcgggtggatcatcaggacttctgcccccagggggtgcaggtgtgtatccctggttgtatgaccttggacagatcactgcctctctggatagagcgtcccagaggcacatctatcaaatgcttttctaggtcttagccccagagcccagaactcccaggttggaattgacaagaatgtattccctccaaggctatttagttgagcacctactaggaccttggcttggtggaaggtgcccagggatacagggggaatgagaaaagcacggctttgcaatctagtcggagagacatggcaaaatgtagatgaatacatcattccacattctgcaaagaagtgattctaaaccatgggcgtgtaatgaaggggcaagtggggtgcagtaccgggaaggaatgagatgctgggtgccatttagatgggtggtcaggcagggccatcgaggaaggtggcacttgggtggagaactgagggcaggaaggagccctctgtgaaagggaggaggcagatgtggccgacagttatcccaccctgcccacttcctcttacccctcgctcttcctggcagtgccagcatccttggtgcttccacagggctttctcagggcactggagaccactcagcctgcacatgagaaaggtgagaagtgccggggagttgacgccaccccgggagcagccttgaccaatgactgtttattgggtgcatacccagccccctcgtccctccagggggacagttcagatgcatgctcaggaggacaaagtacaagctcctccttcacctcgtatgcccagctctcagcccagggcctggcacacagtgggtgcataatgaaatgtgcaaaatgagcgggcagttctgggtatgctccttggccccttgggggtgtttcctaataggtaaaattagaaaatgggataagaaggggggacattgagaaactatgggatgaatgctgtcaactctctcccggagtttctcagtgaccccccagaataaccttgagaaggcacccgtattggcttccttcccttctagctcattccatcagcttcctgggaccccttctcacataaaccctttcctcctaaatccttgtttcaaggtctactcttcattccacccttctaggttcttggctgggtccccggtagcaaaagacgaattcacaagacaaaaggatacaagtctagtttgtatacgttttaggtgatgcaggagattttataaggaaatgaagacccacagaagtggttctagctgagtgttttttgctgggttggatgaagggtggggagtcatgggaaagtgtgaaggatagaaggacctgagctaagggcagtaaactggggacactcagcagggtggcttgttcagatcccttggaagtgaagatgctgccttcctccaggtacagagagggaacctctcacgtgaaggtcttgtgacctgcttcagggaaaggtcagagagtccttcctgcgcctgccatttctcaaattccatctgcttaaaatattcaatataccaaggtgccaaatttgaggtggcgtgtcctgaaccccctccccatggaatgtggccattccagagggcagctgtgacctccttggaggtccaagtgaatcacagtgaggcttcaaccactccgcccacacacatgctgtgtcttccatttcctgaagcaccctgaggcccttgtcccattcgatctgctcaggaagcgatgaggaacactggacagatttcactggccttaattcactggtgcagggaatctagattcgaggggctcagtgtattcctgcccccgacctgctattgcagatccctccaacaccttggccaatgctctttgccaacaaggtcctacttgtcctttcaagttcagcttaaaggttgcttcctacaggaagtcagccccaactgctcaagctcaccgactgatgctatgtcttcagagtctgcccgcccccccactagactggaagccccatgaggacagggactaggtctgatgttttcaccaccatcctctccccaacccccaggacagcacccaaccctgggcatgtggtagatgatttgtaaatatctgtggggtgaatgagttcgtggtgaacatggtggtggagtcctttcaatgcaacacttgctgctggggtggatgaacaagacaccttaggaaaggaacatccaggcccccgttccttcccccaacactcacatcattcattcatcacaaaggaattgagtagttaccatatatcagggacaatgatggagataaagtggtgaacaagacataatcagacctgctttcgggaggtttctgatctagtgggtgaggagagacacactacaaaaatgcctttaaaataataaggaaaaacagttacagtgtgtgatgagtgtggtgaagggaataaggtacaactgtccctcaggatccatgagggattggttccaggacacccccaagcagataccacaatcctaggattctcaagtcccacatataaaatggcacagcatctgcacatcacccacgcacatccacctggatcctttaaagcatctctagattacttataatacttactatcatgtaaatgctaggtaaatcattgttatactatatttttatttgtattatttatattgttgcattattattttttttctctgaatatttttggtccacggttggttggatctgcagattctgaacccatggatccggaaggccaactgaaatgtgatagagaggggtgagaataatggagtgagggcattgcacagctcctcataggagatacctggaatgtatctccaggaatctggagacatctgagcacagatctgtagtataagaagccagccaggcaaggttggggcttgggagggcactccaggtagacgacatggcaagtgcaaaggtcctggggtgagaaagagcttggtgtgatctgggagctgacagagggccattgccaccagagcacagtgaatggggaggtcagctgacgttcactctctgtgccctagaagctgctgaagggtatggcatgctctgatatgcggtttgtcaagctcaccttagttcctgggtagagagggtgggttggaagtgccagggaacgaagacaaagccgtccacagaggagcctggaatctgacttccaggtataaagtattcaatataccaaggtgccgtatttgaggtagcgtgtcctgaagcccctccccatggaatgtggccatcccagagggcagctgtgacttccttggaggtccgggtgaatcacagcgaggcttcaaccactcctcccacacacatgctgtgtcttccatttcctgaagcatcctgaaagccacaggtggtggggaacagctgggcggggcagggtggacctgggggccatgtagagaaagccaatgctgggctgcaccttttgatgtatgtttatcaggagggagactcgggagagctggagtaaatgaaaaaaagaggctgagaatgcagggcgctggaagaaatgccacttcctttattactctgaggtgcatcggttcacatgtacactcaacagtgcacaataagcgttggctgcatttgaggcacatagctacggtgcacaaaagtggctaaaatcagcccctgcctcttcggagcttacagcctgttcctctcccttcacgcccgttggcctataagctcctccaaggctcagctatatcttcttcatctcagtaaccccaggacctacttggcatttagaaaggaacaataaatatttgtggaatgaaaagagagaaaggggagataaaacacgagataaatagctaacaattcaagtaataaagtgatcgctgtcatagagaagattcagatataatacaatgatgaatcagagatgcagagactggggaaatcagggtgatgctggcatttgaagtggttctagaggcatcagtgggttttagacaaagaggagctgggagctgattctctggtcagagggccccatgtgtgcaaaggcatggcaagaggaaattgaccaagtagtggcaagaccactctatgggcagacaatggcttctaagcggaagctctctggaatctgttcaaatgaaaaaaataagggattgatttttaaataggcacattaactgtttggttcaaagagcagaggggtttgtttccctttgaaaagttaaatgatccttctacaatctattcatgtggagaccaaactctttttttacagttgatacaaagaaaagtgccatctgaccctcgttgatttcaaagtctgaattctccagctcccttctccctctgtatattttcatgaagcatacgtcttctttctctaaaatatacctaacaggtgctgcttgccacatgaagtggtcattcatttattgattcttttgaccactcagcaaacacacgttgttgttgccaggcactcagcaacaacaaacacaggccctgcccttatgaaactaactctccaagaatacgctcagttcctgacctgctggaaacccgttcctctctctcccacccagagttcatccaggagtgtgaatgagagagagtggaattgtttattttattgtttttaacagattatgcctcttagcattagaattgaaagcccctggctttccaccccaagtgggaacctggtccccctctcaaaatcaggggtgattttagaagacagggttgcaggtctcctcccagccactagggggatgctcagcagccttcagcagccttaaatttcccatcaactggccagtggctcatgcctgtaatctagcaccttgggaggctgaggtgggaggatcacttgagctcaggagttcaaaaccacactgggcaaaatagtgagacttcttctctagaataataaataaatataaaattacatatcaactgagcaacaagccacccactggtggtgtctataccacaggccagctcactgactgcctgcatcaggatcaccttggaagttgctttaaaataccaattgctgagctccaccaagacagaatttgattcaagcccagagcaagacctggggaacctggaattcatttgctaaaaagtcttccaggttaagatatgggcagtgagatttggaaagcccgcttcacacaatcccatccacctgctcggatgtgcacactggggtcaaagaattcaatggccggcaccaaggcatagataattctaattgttgctggtccctatctgccaacaggtggttattctaaggcccctaaagccagaccacttttaattgaagatgatgaaatagccaggccagccagtgacctaagagtccattccctgaggccagagtgaactcacaggcaccagccagccctggagcttgagctgcccgcatacctgggctgccagtcattagcaaagcaataatagctggcatgtgtggtgcactcattggccagaccctgggctaaactcctcaggaagtgaggccttgcctgcaggccaaagggaaggccaggagcaagatgctctttctgtagctccctggccatgacactctccccagagatagagtgtgcgcatgctttccagctagaagttccactggacccaatcccaggcctcctacccccagagctctaattaggaaaggggggcccccctttgtcaggtcccagagcaacgctccgctcagactgcaggaatctgctctcagccttcctccctggttctcatctctctgactaggaccctcccttcttcatctctgggtcctccatgctcagcccagctcctgggatagatgcccagggcctccgtaaagatttgtcgaatcaatgggctgaagggttgtattccaatgtggaattatcatttcaaacagttagcaaaactctttcccaacccatcatctggtttaacctgtggagcacagatctcagactcattgaatcctgttattcagatgctgacatggaagaacgagaggaatggtcacttgtccaaggtcaagcaggtcgtgcagtgggaagcctgggttaacgcccaagctgtggcactccatgggccattggagccaggtccacttgtggggcccctgggccatggagcatggtgagcaggtcatccaacaaatggtaattgttttgtttgtttgtttgtttgtttgtttgtttgtttttgagacacagtcttgctctgtcgcccaggctggagtgcactggcacgatctcagctcgctgcaacctctgcctcccaggtttaagagattctcctgcctcagcctcccgagtagctgggattacaggcacccaccaccacacctggccaattttttgtatttttagcagagacagggtttcaccatgttggtcaagctgatctcgaactcctgacctcaagtgatgcacccgccttggcctccaaagtgctgggattacaggcatgagccactgtgcccagccccaacaaacagtaattgatgcccaccctgtgccaggtcacttagtaggggagactgacacgtgagcttgtctctccacccctacacacatgtgcgtgtgtacacagaggatctacccaggatgcttggtccctccaagtagaaagttgccaggatcagtcatcaccttaaaaagagccacagcttggcagtcccaggcccctggatgccacagccagggagagcaagtgatgcctactcttggctctgggagagggacctgggaagccagtgccctgcattttctctgctctcttggctggtagcatcaattccattgactagaggagaaatctgtttaacctaatgtgtttcaaatgctccgcctcagtccccatggagctgggcacactcccctgctccccatcttcccctgcccctggcaccttctcactgcctcccccataccggcattgacctctcaggttcccacttcttctctccttcttcaggggctgcctggccttctctgccttttcaaagcccaaaggtgctccaggcccaagctccaatgctcagcttgacgcagcagccctccccaaccctctccccagtggcagaattgaacctgcctgctgtgcccagggagcgccccatgcattccactttagccttctcctgctggctcccacctgtccactcgcatgtctactgtctccaccaaggccatgagcagcccagacagggcagggctgattcttctccatggctcctacctcatgcataggagcaagctccacagaggaccggcaccatctccctaactctctccacctcctgttactgaaggtggacactcttctcctcttgttccttgactttcagtctttgattttcctttttagaatgatattcttctcttctttctctcccccctttccaagagcccacttcctattgcggtgcccttttcctgccatcctgtgcacacaggcttgcacggtgttttcattccctctctccccatgcattcttgcatctcttggctaggagtccctctgtggtcctcaaatctcccctgcaacacagactccagatcttgatgccccagaggcccctggaacttcaaggaggctcccgtttccaatttagaaggagggtcaggggtatttctccttggttgggtcttgggttagtgaagacatttgaggcagggaattgagatgatccctgttgcatccacagctgccactgagttctctacctaccttcccccactctctatttgaccttggacccacaaggaggccactggaactcccagaacacacccttctgacaccagcctagctccccagggagggaagcacttgcaaagctgtctgctgccctctggtgatgcactagggtatggcaacttgggggctgggggtcggatttggtggggggcgtcttgcctggggcccccaaccaccaaggatgggtcttgtttctcaaggctagggaccctcccttattcatctctaggttctcagtgcccagcaacgggtctcaggaaaggctcgttaaattaatgggctgtcaggttatccaaatatggaattatgatttcagcaaaactcttccccacccattgtttgatcaaaccctagcaaccatcctgtgcagtgcagatctcagactctatttagggggctcaggtgcagcccagagaagagaagcgacttgcacaagagctgagagctccccgttaaggcagaattttcctcccccggcagcctccccagctgaggaggctgagccctatgctcatggaatagggtgggggcactggggtcacctgttcccacctctgggtagtggcttgccttgatcaggggccttccagagacagcatcttcacccagaatcagccatcaggaattgtagcccagtgccaggaagcaccctggggggagtaatgggaagttagttccgatgttgaatgcactttggcatgtttcaagcacctcaagtaagggcttgacttaattattcattcgtccttttagaagtgtttgtttattaactgtagacatcgggagacagagatgagcaggacaggtaagttctctgtccccatggagctgacattcccagggctatgctagcaacacagagagaggtggggaggcagtggggctctgccaggaagaggttggatatggtcagcaagggtgagggacacaggcatccatgtattaaatcatccaatctgcaggtgagtttgaggaccactgttatagaacatccttggtcattagagagaacttgaattgtattcttagagtgatgaggagtcattgaaattgacctcggtttgagttttacactgccaaatgatgaagcagggagattggggtggggtgtgatggggctggacaggcggaggtggagagaagaaatggggatgaattaggaagcagacctggcagcactcgctgatgggctggaagggggacaccagaaagtgagagagaagttaaacgtggcccctagggccatagccattgcatttgggaggagaggggctccttcctgagaagaggtgactgatgaagacttgctctggctgagggtgtaggacagaactcacgagttgtttgaatcagattagacatgtctgttagatgcctgagcacagccagcaagtaggttggtggaaacacagggcgggggagaagttgtgaccacagatacaaatatgggagccaccaacacacggatgccacttaaagccaccatcccctccagactcgggacagatctgctggcagccttcagacatcacccaggccaatcctctcattctccacctgagaaaccaaggcccagagactgtggatgacttccgtaaggtcacacagcaagccagccgcagaatcaaaagtcaacttctgactcctaaaggagaactgtttccattccacagtgctcaatgcagcttccccctgacctgcagcctgctgggcagaattgctgatatggcaaatcatttctatgtctgcagtcaggaaaccagagctgttggaaattatctacacacacacatacacacacacacacacacacatacacacacacacacacattatccttttccttcttctaagtaaaaaatcagtaaccaggctgtcagctttattactaattatgcaagtgctttattgctggtatttaaaaaaattgaaggctaaaaatgtccaggaaagacccaatttagtaaacagttcagaataaagtatttgttgccgtggtatttcttcacattagaatttgctccaggtgcttcaaaccttctttaatatattatggcaatctaataaaattcccagttctgggagaatctttgccttggaagataactgtgtttcagggagtgagggttaggtggaattgaggatgatcgggaaggtctggtgagcctgaagttcctgggaaagtaaggctgagagagggcagaagatgagtggttaagagacttgcctgaggtcacagtaagcactcaataagagatagggaaggggatggatggatggatggatggatgaatggataatggatggatggacgatggatgaatcgatggatggatgcatggatggtggatgggtggatggatgaatggatagatggatggatgcatggatagataatggatggatggatgatggatggatggatgcatggatagatggatagatgcatggacggatggatggatgcatggatggatggatggataatggatggatgatggatggatagatggatggattatggatggatggatgcatgcatgcatggatgacagatggatggatggatggatgatggatggatggatggatggatgaatggatggatggattatgaatggatggatggatgatggatggatggatggatggatggatggattatggatggatggatggatgatggatagatggatggatggatggatgagcttccagatgaatcatcaggtttttgcagacctaaatcttagtcaaggaaaagaagtcatctaaaacttgccattgatagaaatgacagaaataaaagttggtggaccattgggccatttgtacaaaatatgtaccattgcctctatttgcaaataacagacttcaactgagataatgaagcaacactgcacaaagctgcagggcagggaagccgtcctcattttacagaaaggaaggagatgatcggacacattgagtaacttgcttgaggtcacatatcccagtagcgatggagctaagacaggggccagccttcctcatgtccagctaagagctatagttttctttccagctcacaacttaggtcctttctctgtgcatcatggcttcttgccacctgagtttcttctacacccacccagcagccagagtgagctttctaaagtgaaatcaggtcacctgctgcttgaagccctccatgggcttcccactcacttgggatagaacccagtctcccatcaggcctaggataccctgtatgctcggccccatccacctggccagcctcatctcctaccctctccctcttcagcttcctaaacatcagcttccggacaccttggccttctcgccaagcttgttcttacctcaggacatttactcatgctttttctctgccagatacattcttcttctaccctggtgtcagatcaaatgtccctctgcagagatgctttccctgactgcctcacctccacccagaatttcccacccctgtgtcccatcattcttaacccattgatccgatttgtttgcttgttttttaaagcattgattactacccagtaagactcatttatttatctgaatatacattttcctttttccctctcatatcaagcaccccgaggataaagacttggtccccctgcccctcctctgtccccctagctttcagaatggcaccaggcagcccctccctagtcaggggccaatgtagatttcatatacggataagcgaattcctgatcagagggcctggctgttgggccatcagctggcattgagcagagaggcctgggttctagtcctgatcctgtgacagagccatagggtgagctggccagtcacacaatgtgtctgagcctcagtttcctttttgtccaatgcacaaatgtgtttgtgctggatgatgggaagccccctcagcttcacttatcggccccttcctcggtgcacgattgagagaaacaggcaatagaccaggccccagggtgaccaggctccaggcacagccaggactggggctgaaaacctgccaccttccaggaacccagtcagccgattggttctgcgtattcgcatttggattctcaggggagtggcctgccctctcaatggcaatttccttgtgagctgggctgacactcctaattattatttggagaggtttggggaggctcagttaattgattacatatttccttccttgacagggcatttgtttggccatgtcttgttttttttttcccctgcttggttaatgttcctgggcatgttgagtattttgtggggaccatgggactaagtccagtcataactctccctcctcctccccaaccctgccaggggctttcgaacactttaatttaacttccctggacctctgcttcccccatgggagcgatgatatagcaagagccctgagatctgaggactaataataacagtgctcacagtaatgtttatcaagttcctagcatatgccctgctctgctctaagaactttacacacatcgactcatctatcctcacaatgttacaacgaagcaggtcctgttatgatttctatttgtagatgaaaagatggagctcagagaggttaagtgacttgcccaaggtcacacagcaggcaagcagctgagccgggattcaaacccgcctgctgggtgaaaactcagcaacagggcacaggctgtccatcgctgccctgtgagtgctccagcaggcttgggaaaaggggatgcgcaatccccatcacccttggccacgtgcgggcagacaggcagctgtggtcggcctctgccgggagctatcagtggtgacactgggcaggactcagagcttcagctccttcattggtaaaaggaatcacaattctgactcctaagctgcggtgagggctgtagtggttctcatcttcagggtgcctaagccagcatctcgtgcacagtccatgaagtaaaggagggctcgaccccaggcccttgctcatgctgtgcttcagaacttacatgcttattctcctggatggaacaattgtcacatcataaaatgcaatcgtcatcttaaggagaaaaggtcatcgcatcatagatgaccctcccaacggcccctaaagggacaccctgctcccttgggtgacctcatgagcctctctcttccatggtttggtgaatgtccccctcctcctactagtctgtggctcctggagggaggggccatgtccacatctccctcatcaccgccaaacgctcaccccggttcccacagagctcagcacaaagaggtgaggagggaacagaagaattaacgggggatctggcctctccctctgcttctaggggaccgcttcttggctcctctccctggccagcctttccaagtgcagcccatgccctatccaccttctggccttgagacatcactggacatcctgttcatttcttcattcagcaaacacgtagtgagcacctctgatgcaccagaggccaagtgcggcgggatgattgggtcatagaaaaagccagagcccctccacacacacacacaaagagtttaggtttgcagagcacctgtacggtttaaatatcttacatggattctctctttgagctccacaacaccccttgaggcagctcatgccccatgtcccatttttatagattaaaaaactgaggcccagacagacatgtaatgaggcagttatagtacagtgtgcaagctccagaatgggctgtgggagccaaggatatgtgtgttccatgcccgggcttcctccacttctgacctcccccaggagactcagacatgcagcaggagcccccttttctggcttgacctgagtgtggtgggaaggcaggaggatggccttgatgacctgtgagacctgtgggcccagcagagcctgagtccatgcccaggacctatgcagcctgcagaagagaccctggatttcaaggcgggcatcaggctagatcagggcagtggggcctggcaagcccaggccagggcactcacaggtgcagcctggagctgctgggaagtgggagccacttggcacctggtggcaccaggtccccatactcatattgctacctccaaggaggggatgcagctctgcctcagagctccaccagctgggtgagagccccctcactgcatacccccatactccccgcccccagcttgccccgagcagagccactgagaaacaggaggaggtagctgtagggagtttgtctgtgggcctgatgccctcaaagggcttccaagtggaaatgctactgtcattgccctttggggaatgaaaggaaatataaaggcatatttcatctctgtagccaccctaggggcaatgatgccactgtttgctaataataacacacactcgggtctagggcttactgtgtgccaagccaagtgcacttacatgtgagaactcagccatggaggggatgccactgttaaccccatttcacagatgagaaacctgaggcatcaaaagcttcaatgccctcccctaggttaggcacctggcaaggggcagagccaggatttgaacccaggcagtcaggttagggtactggcccttctccactagaccacaccccctcctttccccattggcgtggaagttcatttcaggagaaccccacatctgtccctttgacaatgtgggcctctctgagcccctgcactgcactttccatgacagggagcccagtcctctgcaccctgggtgacccttctctccaccgcctctagccgctgctgagggccggcctccttttgcctctgccctctgccagtgtgggaggcagcagtcagcagggaggtgctgcggtctgacagaggaaataccagggtgccctgggagggctggagctgctggaaacggagcaggaccggcagagtgagctgattaggagaggctagcaggggagggagagacagtttggactgagtctccacaccattagctctcctgctctgtttctcccccacctacccagactgtgatgccagccgacgaggccctggggggtgcatggaggccctgccagctgctctagctgctgatgggccaagggggctctggacttgtcataagctccctttacacaccactaaagatccccagtcccgcctgtggctgcatgtgcctcctcctttgctcaacaccccgccatccccagcctcatgaaggctgacagaaccaacagatgccttggtgaggccttccaggctctctactgtggaatccctaccaatttattttccttttatgttaaaatataacatacacacagttaagggctttataaaggagttggtatccatgcacacacagctgcccaggtcaagataaacattctcagcccctcatgaggtttccttccaccaagagggaggtgctattctgacttttgtatgaacttagactagtttttccttaagtctaatttagactattagaatgtcagggagatttctctatgtggttgctcgtagcagtggcttgttctttttcattactacgtagtactccactgcgtggaccttattagtttatttacctattctcctgtggagtggcattggagctgttgcttccagtttttgagccatgacaagtaaagctgctttgaatgtaagcattcatttttcttggaggtatcccttggagaggacgtgtggggtgcagggaaggcaaatgttcagctttcagagatgctgcctgtgcttgtttgccaaggctgctgtaacaaaatgccacaaactgggaggcttaaaacaacagaactgtattctctcacagttctcaaggctagaagtctgaaatcaaggtgttggcatggccacacttcctctgaaagctccaaggaaaagtcatgccttgcctctcctcacttctggtggttgccagcagtccttggcattcgttggcttgtagatgcatcaccccaaactccacctccatcatcacacggcgttctcccgctgtgtgtctgtctctctgtccagatttccttcttagaaagacacagtcactggattagggcccacccaactccagcctgactttatcttaacttgattacatctgcaaagaccctatttccaaatcaggttacatccacaggtctcaggggttaggattcaacagatcttttgggagtggggagcgcaattcaccctacaacaccgcctaacagtttcaaagaacatgtacacattcacatccctgccagcaggatatgagagccccaggtgccccacatcctgtgtgtcccccactcttgacccagctgcaaggatgactccctgtttctgaaagtgtccaccatgcctctccccatccagacattgcagaagcagcacctgccacctctgcctggcaaacccctccccatccataagactaatcactgtccccaggagcctccccaagcacatctgccctggccaagttcagcaggccctccctctgcttcgtctctgcactttggtcattctggacagactccactgtcattctgtgacagtgaaggctgcaggctctggagcggcggagctggtctttgaaaccatgtgaacaagtgtcttcacctctctgccatccatttctttacctggattgttccaggaggaagcccagtgtccacatggctcctgtattagtctgttctcacgctgctaataaagacatacccgagactgggtaatttataaagaaaaagagatttaatggactcacagttccacatggctggggaggcctcacaatcatggcagaaggctaaaggcacatcttacatggtggcagacaagagagaatgagagccaagtgaaagggatttccctttataaaaccatcggatcatgtgagacttattctctaccatgagaacagtgtggggggaatagcccccatgattcaattatttcccaccgggcccctcccacaacacatgggaattatgggaactacaattcaagatgaaatctgtgtggggacacagccaaacaatatcagctccctcctctggtccctctgggtctctgctcaggtgtcacctccccagagaggccttccctgaccatctgctccaaaatgccaccccatcaccaggttcaccttccttctgcttctccgtagcgtgtatctctgcctaggggtgggcacggcatcctcacttgtttgcccatctcttgtctccctcttgcactagaaatcaagtttcctctggtctcctgatcacagctccatctttagcacctggtaggttgcctgaggcagtcaatgcatatctgttgaatgaatgaattaaatgaatccgcaaaatgaaaacaaaaatagcatctactggcaggagcaggggtaattgtcaggagattcactgagataggtcgtgcttagctaggttttagcccagtaggaactcagtcaacgttaactgttgtgttagctttttattgcttctgtagcaaatcgccaccaacttagtggcttaaaataacacaaatttagtatcttacagttctggatgtcacaacttcgagatgagtctcactgggctaaaatccaagtgttgatcgggctgtgcttcttctggaggctcaggggacagtctgcttccttgccttttgcagcttctagagcccacccacataccttggcttgtggcctctttcagcaatggcatcgctctggcctctgctgccatcatcacatcccctcccgctccgaccctcctgtctccctccaataaggacatttgtgattatattagatccttgtgggtagtccaggataatcttccccatctcaaaatccttaatcacacctgcaaagccccttctgccactaaggaaacattgacaggttccagggatttgaacgtgggcatttttgaggcaggaggatgcattacataccacagctgtggttatcactgtgacaatcactcaccatgtccaagtttgcttcctctgttggacagtgaccttgttgcaacacggactgccttcttctttctttctgtgtctctagttccctcttcagggcctggcatacagcaggggctcaggaatgtggcctgagttcctgaagggcaagagccccgttttactcatccctgtacccccaccatccagggctgatcctggccctgaacatttgttggaccgagcagacccgccgggtaccgtgcatgaccggtgaggacagggccccagcagagggacagggaggaccgccgggaggaaggtgagggaggggaagaaactcggggaggtctcgggcttcaaatgagagaggcttgcccttgccccacctcaggtggatcccttccagggaaccagtcatggaactgggtctctgctatggataataaagctaaaacataaggaacacttcagacaagagtgagatgttagagccacctggagccaggctcctagcctctgaatcccagctctgccgcttcctggctgtggaatcctaggcaagtcactcatctctccatgccttggtttccccatctctaaaatggacatgatgataatagtgtctatcttgcagagggctcatggggcttaaatgagttaataaagctcttagaactggcacaaggtatgcaggatagggggctggtgatgattatgtgctaacattttctgaatacctgctgtgagccagatattgtgctgggctccagggagacagcagtgagcaattctgcctctggttacacagggctctccatctccacctggataaggattaatattgctcccattttacagatgagaaaactgaggcctagacctgccgagtgcttgcctgagtccacatacttagaaagcagaggagccagtatttagaactggcctgcactctgggccactgcgctctctcacctttcagatttgcagtgctgggacccagagccctggaactctgccctgaatctttctggaaaacttggaaacagttttgaagcagggggtcttttcctttattacagccgtctcaggaagacgtgaaaatttggctctgatcaaattaggcccatgttgtgatataactttctatatccaccataaagctaataaactaataaattagacagaatgaaaatatcattgggcaaggctgcacactgaagcattgctgtaattactctcacggccggggccaatttctcaaatttcgccttggccaagtttctcagctcaccgtgtccctaataaggcataactcactctataaacattaaattgacttatttattttaaattacagtggaactgaaaccaccttgataaacctattctcctgcatctgccttcctcataagcatagcccagtggtttttttttttttaaacaaagaaaatatctagtctgtctcaggactctttctccaacccagactagctacccctttcttaccacgattccagctttagagatttgactcactcccctgaggttagcggaggtcgcccattatagataaagatgattcatgcctaattaataatgataatggtgctactttaattgagtgggtttgactggtatcgtgggccgggccctctgctacggcctctacaggaactcacttaaacctcataataagcctgcaaggagcgccctctcatgatccctgctttgcaagtgaaggagccagggatcagggaaggcaagtgacttgcctgagaccacacagagtgacttgcagtgaagctgggacccagccagggaggtctcgtgccaaagccttcgtcttcatcactgtgctaccctacctctcagaaaacttgcaccagtggcctgctgggacttcaagctgccatgagacatatttatttcttgagcggtgggaggggctcaaaacctggttgcagggaggaggaggggaagagctggatgggcggatgacatccaggctcagcggcaggtacaatgatggggactcttgctgggggtcccaggaggccacaggtatcttcctggcccagctgatggaggtgcaggagggaaaggggtttgggaagttcatcagagatcatgattggtgcatgagttggggttgataagaggacagcatcccaggcagaggggagagcagggacaagggccaggcagtgcttccagagatctgtggctggagtgaagggaggagagtgtggcgatggggcggggataggagaggatctcagcagtggagagcatttccacggcccatctctgctctccagggcaggtctcatttggccgcatgcagataatgcaacagcgagctgagagttttgctcctcctcctgatctctgctttcatgtcccttcctaggtcagcttttcctgacgttctagtatagcctggtcagatctttctgttctcaggtctaccagcaccccagatgcctctgggaactcctcacactattaattaaacacatatttaggtggttaattccatccctgtctgcaacactagaaagtcaggtccatcagggcaggaatcatgctcatcttgctcactgttatcttcctagtaattaccccatctaccattgagtggcacatgctagacactcagtgtagaattgttggatgagtggatggatgatggatggatggatggatggatggatgggtggatgggtagagggtggatggacagatggtaggtggatgatggattggtagatggtaggatggatgggtggatgggtagatggatggagaatggatagatgatggatgggtagacagtgaatggatggatggtggataggtgtggatggatagatggctagataagtggatggtaagtgggtgaacggatagctggaaagatgagaagtgaatgaatggatggatgggtggtggataggtgtggatggctagataggtagatggggggtgagtggatggatagctggagagatgagaagtgagtggatggatggatgggtggatggatggatggacagatgtgctgaaggtttaatgagatgctgtgtagaagcctccagcatatgcttgacatagaaaagtcatttggtgttctttaggttggaaacacaaagccccggccatgctccagtgcaggtattcccgcttgactctcaagcttactttctggaaggcagagcccctgatgggaaaccaagacccagagccaacctcaagcagaggcatcacgaggccaactgaggtccttggcccatgccattcacagggcctgggctttgccaggcgatgatgcagagcggtggcggttaggtgccccagagactttgggccctgtcagagcagagctgtcatcctgtcccctcctccccagcatgaatctgaccactgctgaggccagagggaatgagtttttgagctgattattggagaatggaagtctcccctgctgttaagggagcagtcctcagggccttccagaaaccacagctgccctgccccttcctaacccttgcttgtggactcagagggtcctactcctgctcagggctctgcatggactctcctttgtatcatcctctatccaaccttgaactctggtgtgaacaattctcctactgtcttgtgtgcaagcccctgcccccgtatttcatagcaggtccctaatgcaacccctgtccctaggtcccagctgtagtctgtctctgggatgccaattcctcccggataagaccctgatttgattttacctcttggattgatagtgagatctccattctttttgtgtaactctgggcatcttattagacctctctgtgcctcagtttcctcaactgtaaaatgaggatgagagtaatagtacataatatagtcatactacctcataggcagcacagggttgcaagaggcataatgagctaatatgtgtaaagtgcttggaacagcgcctggtacataccaagtgctgtgtgttatctattattagtcaacaaataaacattgaacaccaatccatgcctagcaatgttctcaatgctggggctgcaagtagacagagtggctcatggaggtaacctcaaggacagagtccaccctttgttttattttgcagaattgatcgacatctctctctaacactccctgtttgtgtgaccttgggtgagtcacgtaatctgactgtaccctaggtttctcattgaccagtgcctgcccctctaggctttgggcagggctagagatagtgtggatcaagtgcttagaaccaaagccttctcagtaaatggtggttagttttgttcatgctaatttttccaggaccagtggtggttcctctactccaggtctgtggctagaaaaaaacacatttcatcttttcccatactaccacctcactcctcaccacaatcctgtgaggcaggcatcacaatactgaactttacagattaagagacattgcacagagaggttaagcaacctacccaaggtcacggtgttttcaagtggcagagctgaggtttgaccccaagtctgttggatgccactacctgtgctcctggctactaagccacactcctctccatgggaaccacacctgagagccaggacaaagccttgcacttccaggaatcatttgaaaatgtggattcttgaggcttggtctagagtgtttgtcaagagccgcatctatgcaccttctctctggtgcacccaatggctccacattcctgggacctcctggtccttttcttttcccccactcagtctatggccatgaatccacattcatacccaggcctctcaaaagacagcagaggagagctgagtgattggaagaaagcatgaacaccaatgccaatgcatggcatgatgacaaagcaaacacacatgtgctaactacggggcaggcaccgtcctaagtgccttctgtgtattatctcatttaatcctctcaacaacccatgagaaaagtactctcattaccccaaattgtaaggtgaggagatggagacacagagtggtagagtgacttactccaggtcacgcagcgagtcaggattcaaagctgggcagctaggctctagagtccatgccccactgtctttgtcatccacgctattcatgcaggccctagcagtgggggctgaagaatgcatgggaaaggttccctgcaaaatgaaagaccttcctagaagccagcaggtagtcatggtgactatagatggctcttcccaaaccaggattgtgggccacaccacacccagccattggcatttcctgagccagtgtaactgttaaatgatgcagctgtgggaatgaggaagaagccctggccccccgtcccaaatttgcaggtgggtagacagttatttccttccttattctcaccttgccctcactaccatcaaaaaacacgtctccttacattgttggcaattggcagaagggacagatactgagggctttggttgattgtgatgcatccattaaaatgtaccagcttgctgagccacagatcacttctgcaggccttgtctccactgatagggtgcatgcacgtgtgcgtgcgtgcgtgtgtgtgtgtgtgtgtgtgtgtgcgtgcgtttggcaaaatgggactgtttctgcttagaccttggtgagaatccaaggggctcactccaggaatttgaacccactgggcactcacccattcaggtggatgccaccccacttcttccatggcaggatcatccctgagcacctgacggccccagctcactcactgacttgcacactctctcctttggggccctttcctcaccagaccttgcttacaaaccagggactcacagcccagaatcggcctgtcaacacgctctatttgactaacactgaacgtttttaattaaaactatgtttttaattaaatcaatgacaaattattgaaaaccaggagattttacaaacaaatctatacgtttggctttgctttaaaaagctgaagatgtggcttttataccggttattcccaaattgtaggaaacagccaccataaataatggctggatttaaaccagggaatgacctcttccttccctcaccatccacaccactctgtattgtctgaaatgatatcggtgagaactacttttggctccatgcaacaaaaacccaaagtgagtatgtcttaaactagataagagtttatttttctttctcctaagagtcccaggtagcctgtctaaaggacagagggtgctccttggtgtcagggactcaagctccttccctcttgatgttccactgtgcatggcttccattctgaaggtcaccttaaagtttaagaaggctgcaccagctccagccattacatctacattccagctaggaggaagcaggaagaaaaaaaggacacaccccctcctataagaaccctttaggaatttgtgtgtaacacacctacttacatccctctgccagaacttagtcacatggccacctgctgcaatggtaactgggaagtgtagtctctattttgggcaaccatgtgtccaggaaactatcatagtaactattactatgaaaagaagcatagctgctgaattgtttaacttctttacacaggctgtaagcccgtgaagatgaaactttgtctttgactttggctctgagcttctgctacttcattaaaaatttatgtactgttgttcctctcattaagttgttccaaggaattcactaggagatgacgaatgtaagtatgtctagcaaagttttggtacttaatataagctcagcgattgtgcatttgtttcatctattctacaccagatgttacttgtctcccctttgtcaggactttgctcctcagtgaagcctccctgacctcccagcaatttcaaattttaaatagaagcgccccctccactcccagcactccctatccctgtcctgtctttctttttctaaatacacctgtaatcaccgacctgctatatttttcaaaggttactttgtttaccgtctgtgtccctcaactaaaatacgagttctatgaggtcagtggttttggtttctattgttcacagctgtatccctagcacctaggatagaccctggtacatagtaggtactcagtaacgatatgttggatgcatgaatgaccagatagctattgccttctcagagctgggtactgtgctcagtgtgagagacagaaccggaagcaagatatcttctagtttccatctccccatggcactgagcccagagcagaacacgctaagataaatacctattaccttggatcggatcttggtgccagcaggagtccaggcattttaattttgttttgacaaaggggctgataggagaagctggctggctcctctgtctctcatctgctggcagccctgggcaccctggcctgaccttccccgccttcagcaccacgtagcgcaggacagtcaaacataattggcctgccctactttttaagagaacccagattgaaggactgggcttttggtgggctgacctgtttaagagccttaagaggaagctcggagtttcaattttccactgccaaagcaaagctgtttttagctccgctttgatgaagcggcgggagtcaggtttggccccgggtcatccatcagctgacctggttgggaaaggcctcctgtgggggccccaggcctaaccacagcttcgcaaggaatgctcaggtttgctttgcccaactggagtcatcggtcctgctctgaagctgcccctggtccatcccaaaagacagacagtgagagagagatctccagccattctcaaatattttatcttgttgatgggcccctggacttgagttcctgcccaattcctccaggagttagctgcgtgacctcagacaaattgcttggcctccctgggcctcagtttcctaatctgttcagtgaggtttatcattctgatctcaatgggtggttgtaggtactaaatgatgtaatgccggttgactgctgtgtccatctcaggctttgaggatatttcacctggaccctctccctgcaggaaactgggctgattgacatccacgcgggtaggccaagtcagctcagagctttctctctgaattgcagtgctctggcatgctgcctgcttttctaggggtcaagcaccatctctttgaacctcttttctgatcgttttgtcaaactgtggtggaagagtttggcgtcgggggctctggccctatattggagggacccatatgatgcattcttgctggagtttgcttccagggaaaacatggtccctgcagacaaaagggtctgcccttggtcaccagaagcagaggcaggttgtgcaccaggcctccatgttgctgtagagccacagtctgatgcctcgatgaccccagagcctccactcactctgcctgccctttatgactctctctccagcctgaaagagtttgtttctgttctgccactgattgattgtgtgaccttgcagaagcctcggcctctctgtgtgctacacccacctcaaacagcaactagcctgtgagttaagggcactgtcttcatccatttggaaagctgtaataaaataccataaaccaggtggtttatgaacaatagacattcatttctcacagctctggagaccgggaagcccaaggtcaaggcagattccaggttggctgggggcccactacttggcacatggagccctctcaccccatgagccagaaagtggctgtgtcctcccatgctggaagagaccaggcagctctctggggcctcttttgtgggggtgctcatcccaccgtaatcgcctcccaaaagcccctccttctaatacaattccattggtaattaggtttcaatatctgaatttgaggaggacacagacatttggaccgtagcaggtatcagctctggagcctggctgcagggttcaggacccagctttgacactctctggttgagtaacttcagccaacaagttgtaagcaacatccctgtgactcagtttcctcctctgtgagggccgggtgacaataacaacacctacttcatgggagtgttgtgaaattgagttttacagatggggaaactgaggcattaacttgtcccagatcactcaactacagcatgttacagctgggtggttctggcccatgggaaggtctagagaggttattagctattattgttcttattgcaaaaggctttccctgagaattgaatgagatcagttttcagtgcctcgcacagggtctcgcacacaggaggtgctcagtgaacctctcactggtacactgatgaacgaggcctgcatcggctcctggaactcaagggcgagggacctgatgctgaccttgcccacagtaggggcacagccatgttcattgaaaaaagatcatagaaacaacaggttgaggaagtccgggaaacccagaggcagccaccttccacgcccgtcttccctcttctggtggaggcaggcttggttccaacaggcttggggccttcctgatgccagctctcacccaccaccaagtagagaggcagaggcagagattcctgttaaataaagcaatcacgaacgataggaaggaggcggcgagctcagccacgggcccagccttccaagtttgctcactgcccagcttctttggtctcatttccctttggccaaccacctggctcctggttccccaccacacggagtctttttctgaagagcacgtgccccacgccccctgcctgccagtcctgggatggcgtcgggtgaaggtaggaaaaacactctgaaccctgggccctcccgcccctgcccacccctgaacccagagcctgagtccaacaggctgaccagtgaggggctaagtggatcagtcaggacctggaggaggaagtggtttccatggcagcagccagagtctggaaaagaggcctggagaggaagccggtggagaagagcgggagatgtcggaatgggtgaaggggagcgggaagcgatgggccaggaagtcaggggaaggggtcagccagtgaaagatggagggtgggaatggggaagcgggttcagggcccaaggtgaacagcagtggctggacagggcaggaaagagcggtcgggaccagcgaccccatatctgtcaccacccaagggcctgtcactgacttcctggcttggatgatctaggatcccaagctaagctctctctggtttttcttggggtaattcaacattggaaaagaaaacctgatttctcagaggtgctttctcacattggaaaaaggttcctaccagtttgcccactggtaaatcatgactggcaggtctggggtgtccctctagtcaggagtaagggagctttccatggtgaccttgtcctgtcccagcttcaccacccagggcctcaggacaaagggcttgaggtgcagaagctgaagctgagagccgatgacctgcctgaggtcacacagtcctgggaggtagagcagagtgtggtgagccccacccgtccagcaccaaaagtccccttgcagtgtgaagatagaactgagaaagatgtggctcaaacatggcccagtgtgagtcaagagttgtcccctcgttctcacccttcaaggtcagcaggaggaaatggccaaggagctaaggcagctgggccgccaacgatcaggccaatttaagagacgtctatggcaggggtggagcctgagaggggtcccaggctccctgaagcgggtgaggggagggcttagggagggagctgggggcagggcggagagggcatcggctggagtattctggaacttctcccctctgtgcctactttctttggtacccctcctagccagccctgcattccagtggatgccacagatattttgtacccaatgagcaactgtatgacagaaaccattttcaggttggggggcggtgaaaatcatactaatggctttttaaaggccctgaagaaaaagatttcaggcagccttggaattggcgaaaacacataaggaggaaggtcataaaattcccagtgtccaggggctcagctcttaggtagtggggcttttccggaggctccaggccccctgtccagcgctgccccatccctgcctctctccccggtcccactcccccatcccactcccaggctgtacaacctgggagaccttccatctgtgctgagtgttctcagggaagcccaccacattaagaatggccgggctcctgactggctccccagccagaggaatggctggaaggtggcaggagaccccaggcagtgggctcccagccccatggaatgattcggccgtgtcttttccctgtttggctgggggagaagttggacccaaattctcctgcgttgtgtggtgaaaagagcaccatgtatttctggctcattgagataccttgactcattaagacttctggctcacagcagccacagctgcctatcactgagcacgtactccacatccgcctctggatggatgcataggctttgtaacaagatggccggatcgccaagcctccccaaccgcctgcagggggcggtcatgagcccccatttcccagaacctttgacggatcacctggtccaggtggcccggccgcttcttcccagatctgctgctgattgctgcctggccttgcataaatcacctccctgtctttagttttcttgactggacaaaccaggactagctggtcaccctggttaagaccagactcttctgggagagctattaaaggaatggagcttctccatgtacattctgtgctcacaagacaggtcccttagctcaagggagggtctcctgtgtccccctgcttttctgcttggtgctgtccaatggccccacccctcccggaggaagtgtgtccctactgtgtccctggaaagggcctgatggaggagaaaacccagggcttggccaaaaggagggtagggagtcatttcaggatttcgggttattccgtcttcggtatccttggagctgaaacttcgccttcacaggcaggtccccaggaatatattgacaccattgttaaggtgtccttagtcaagttcacagcagggaggatgagacaatttgctcttgagctaggcctggagtctgggtcccactttctgggctgagctcgagtgtagacccacctccaccaggcagggaaagacagagagtgcatcgccatctctttcagaagccggaggacaggaagcaggtacagagcaggggctgggagagcagagcaaggctcagcattcggttagtgcaggggccatgtctgtgtgtgtacagctttctggcagcccctggtgtttgaaagaacccctgtcctcaaggaatgtccattcaacgatattcattaggcagctgccctgtgtcaaaaacatccaagcactaggctctggtatttgaggtttggtgaagccaatggaaggagaccacccagtgtgtctgcggtggggcagggcaagggtaaacagatggatggactgagggggagggagaaggactgaggccctgagtcttcgagcgggcttgtctgaccagcagcagcggtacctggtggctggttagaaattctcagggccccggaatgattctgccatgcctctttcctatgtggctgggggaaaaattagaccacaactccccagcattgtttggtgaaaagaacatcagctatttttgattcattgagactccaactgtaggctcaccataatctgcgctggaaccaaatcctcaggggattcttgtacatcccagaacccccctggggtctcctgtaagggaccccaccccaccacaaggtctagggaggccctttcctgcctgtctccatctgttttcccaggtctgccagctaccacaaatgctacccccagtagctaatctattccccagtcctgggaggtttgtgctctcacccagggactgtgatggaaaagcaagatgccgtgagggcagccggggataggcagcagccagggctggctgagcaggtgcacacctgggtcactaggccaagctaactgacctgagccacccacagctcccagccacctctgccaattacacaggtgtgaggaggtggggggaagagcagagacctcttccccgcccatgccccccccttttttttccagggagtagcaaaccttttccatgtgtcttattagcaaacatccctctagtacccagagtggccagacactttatcgccagttttattagctctgcctcacggctctgtccaggtggagcaggcattctgcaaatgttgcccccatatcacagggcatgaccctgaacttggagaatgagcaggtgttggagggagtgagaaacaaggcccaggcctcagggaagaagcagcccatcagggatgcatggcaggcgcagaaacagtaaaacttcattacttcatgcttgggatctttccagcaggaatgagggagggcagagcccaggcaggcacttggctcataagattgcagggggtgtgtttaacctacttgcaggaacaactctgtccccagccctttagaagcttggtttccatgcaaacaatggttatacaaatgaaaagcctctctcatctcttcattaaagcacagcctcaaaggacccatcactacctgaatcttctctgttagcccagaatgagatactgtgtatataaatgaagacgtttgaattacaaaatgctttttaaatcgggtagattatgaaagtttggtcctgaagagtcttctccttcagttgctgaattttggcaaggatgcaaaaccacacaccacgttcctccctccatctgtccctcccttcctcctgtctgggtctgggccacatctgagtttgcagtcagactgaatttgggcttgctcccgtagtcgatggaagctgcaggaagggtttatgttgggaaaggacaggccagatcttcgctgtcataaggtcactctgacagcagggtgggggcctcaggcagggagatggtggcaagaatgaagacaaaaatggagaggttctgggccaagcaagacagtggggtggaggcgaggaaacatcgatgagcctcctgtgccacaacatcctctaatctgggcgaagattaaaagaaaagagggtcaggggcacccaggcaaatgtcatgcacccttttctcatagagaaatcctgtagctccccattcttcctctccaagccttttgatccacgttgcacacacaattccaacaggacttgttatttgaagctcactgcaaattgacagcaacacttagaaagtaggaataggttggcggggaggggcatgaggggcaacatggagtgagctgcttctagaagaaggcactgagcagtgtgggcaaaaagacaaaaactcatgaaaaaccaagaagccatcatgcagccactttagaagacatttgagcagtgtcttataaagttaggtataggaccagccgtgccatgtcctcatttgcacacacagcacctctccctgggctaacagagacgatccaggtagctgccaggcctttgaggctctgttttaatgaagagagagccatccaggtgtccatcaacaggaggatgggtaagtaaatggtgtgtagccacgaaatgcgatgctgttcagtaggaaaagggacgcaacaattggtgaaggcaacaacatgaatgaatctcaaaataatgacaaggagtggaagaaaccaagcaaaacatagtacacactttgtgattccatttatataaaatcctaggaatcatgatttatagtgacagaaagaggatcaatggctgcctgaggatgaggggcatagattataaaagggcacaaggagctttttgggagagatgagtatgttcattatcttgattgtggcaatggtctcaatacattgaaacttatcaaatgtggaaatgctgagtaggtacaatttattgtttgtcaattataccccaataaagcaattaataaaattgaaacaaacaaaggcaaggatcccaggagacatttagcatcaggataaactcacctaacacattgcaaaacccctaagactcgacaggatgagattgatgtttgttttaatgaccttgatcctgggacaggttaattaacgtccagcctcctccctctaagaagtagacggatgtagactggaggcagattccagagaaaaggtgtctttatagtgtggtcatttaaaagtatagatgttcccggacttatgatgggattacgtcccaataagtccatcgtaagttcaaaatatcttaggtcgaaaatgcacttaaaacatctgatctacagaacatcatggcttagcgcctaacctagcttaaatgtgcggaaaacactttcattagcctacactcgggcaaaataatccaacacaaagcccattttgtaataaagagctgagtatctcatggaatgtattaaataccatactgaaattgaaccatggaatggttgtatggctactcaaagtctggtttctactgagtgtgtatgactttcacgctgtcttaagtaaaaaaatcgtaagttgaaccattgtgagtcggggaccttctgtattgttttgtctgtcttgttcccttatatatactcaacaccacaagcggtgcatggtacatggtgggtgcttaacgatttgttttaaaattttcatcaattaacagtgtaaggagaagaatatgacaagcactcccagcatgccaggccctgttgtaagtgcactggtatgtgttcattcattcaggcttcagttctcagcaaaagtcaaatattggatcacttggttcttcaacagcacaggaaaagcaaatcaaactcatttcctgtgtcctcacagctccaccctcccctccagtgtctccattctatgaaaatctaggattcttcccagtggaaaggcaaaaccaggaaaggaaagctaagcagaggctgtaaactcgtgtggggcgtggagaatgtgcacaggacttgctcagcaaacctcagtcatcagaattaaggggcccgccagaagcttggagcaggaaatttaggaaaataaaaggccatcctgtttcttccagcagggagaaaacatatggctctcattacctagagaggtggcaagcctcagaatagagacacgctcaagagtgatggaggcaaattcagagaccagagagctcaaatcaatttgctgataaaggaagatctgggggcagtgggggagagcattcatgggctccagcctccatctggcttgaattcaaatcatgccacctactcactctatgtagcaaagattcagttagagagggtaaaatgctcagtgcagtgcctcctactgtaaatctttatacatattggcacctccccagatgctgtaatccacaagacaggtgtcatagcacccatgtatcagatggagaaaccgaagctcaaagaagccaaaggacctcatccaacatcacatgctagtcaggtgcagagccaagactagagcccagggctcttgactcctggtgcagactgtttccactaacctcattcatacaggtgatactccttgagcacctaccaagtgaccaggcttccctccttgcctgggagggaaaagaaacaagttatactgcagcatgacatggacaggtatgtgctcccagagacagatgcagccctggagaggtggagatgaattatgtctttggagggctgggcagtcaaggtagcctgcctggtggaggtggcatctgaatgtagagcctatagagcttaacattataggcacaagcatggaggcagggaccaaaacctctagcatccgtgtacccactcccaatccaagcctcagtttagggcatggcatacttctgttgaaggtggatggcccacagccctggctccagattcagcagaagctgcagtgcccagcgcttgcatggccttacctagtgaaggcatgcaggtcacggggcatgcagcatccgccctcgctgtgcctggcttttcaaaaacacaattactcacccttcagagatgccgtcggtgttggtaaactccagccgctaaactgcattacactgatctctccagaaacctttgcagttattaatagtttattgatcacagcccattgctgatgagagcaggcctcctcaccctcacccccctcgggtccctgctatctgtggaaagccttctattcatcatgcagatcaatgccactcaattctggggaaagggagtctctgggccacttaatccactttagaaagaaaacagaaaagaccaaattttagatgaggtgctgagaagagatggattggtcaaaatcaaagctgtgacctggcagctgtttggtctgccaatgagaactagaatctgccttggttggaagtggggggatcctggccatgtcagatggtaacaggggaaaccaggtgaggggtgtacagcgatctctgttatatttgcaaatcttctgtgattctaaacttatccaaaatacaaattttatttttttagaaaataacttggctcatgggaggaatggaaagaatgccactgtagctggaggaaggggcaggggcgagagagaagggaaggtgggagacatggctggaggaaggggcaggggcgtgggagaagggaaggtgggagacatggctggaggaaggggcaggggcgtgggagaagggaaggtgggagacatggctggaggaaggggcagggacatgggataagggaaggtggaagacatagctagagatgtagaaggaaaaagtgtgctgggccctgttggccaagatgatgattcttatctctctttttgccattttttattgataaactttattttttagagcagcttaaggttcacagcaaaactgagcagaaagtacagaaagttcccacctgcccctgtcccacacatgtacaacctctgccaccattgacttcctacacttcagtgacacatttgttaccatcaattaacctacatggatacatcgttaccacccgaaatccgtagttcacagtagggttcacttctggtgttctgcatttactaggttttggcacatgttactaccttttgaaatatttttatcgaattgatattgctgtttcatattttaagatttacagttttatttctatttaggagatttttatattctccattttattttattttatttccataggttattggggaacaggtagtgtttggttacataagttctttagtggtgatttgtgagatttaggtgcgcccatcacccgagcagtatgccctatcccaatttgtagtcttttatctctcaccccctcccaccttttcccccaaattcccaaagtttattgtatcattcttatgcctttgcatcctcctagcttagctcccacttatgcatgagaacatacaatgtttggttttccgttcttgagttacttcccttagaataggggtctccaattccatccaggttgctgtgaatgccattattttgttcctttttatggctgaatagtattccacggtatagatatataccacagttttttaatccactcattgattaatgggcatttgagctggttccgtatttttgcaattgcaaattgtgctgctataaacatgcgtgtgcaagtatccttttcatataatgtctttgtcataaaagcagagagagcctttgttgggacttaggtaagggagtaccattcatctcatttgcatttgaaaagatctagattctacctggagaatggatcaggagggagattaccagggatagaaagcccagtaaacctctgcctccatattccaggtgagaagagatgctgactgtggagatggagggaagtggatagttcaggatctattaggagtagaacacccaggacttggtcgctgtctgtatttggagggtgtggaagtgggagatgtcaaggagggtgcccaagagtgtgccttgggctaatggtggaggacaggtctggacattcaaggaactagggaacctgggcttgctccttcaatcgatggtagaaggagcatctggggctgtacacatagtcctcagtgagaagctgcctttttcataaagcagcaatcccggtgtaccccgagctgtcttctataccacctgtgagatgtcacctacatgtgtcacccaagcatattgcttacgttactatcacctgagcatgtcatcagggtagcagttgcctaaacatgacacctgtgtcgctatcctataaacacatcttctgcagccatcacctaggtggtggttacctgcacgtatctgcctgggtgtcaaccatgttattattatcttattacctcacctggagagctgccagctacacatgtctcctgagcctgtttctttacagagctgtcacctgaacctgccacctgaactcctttcacctacaaaagtcatttaagcaggttgtctttataaccaacacctatgagtgtcaccaagtgcaaattctgctcctactgtttgtaagccatggggtcttgggtaagtcatgccatctctctctgagtctcttttttttttttttatctaaaatatgtcactccaggtgactgtcactcagtaatggcgcctggtagagaggctattttttcagtctagctgagttacaaacaaagaaaatcattcccagaggggagactggtcccctgctgttcccatgtcactgcgctctttattctgagatcagggagtggagggggacggcgtcttctcaacaaagtccccctgatgaaaagcttcccattctttaagtccttccatgacagtcggtagaccagatgtcaacctctgtgtgttctatgtaaatgaaggtgtttgtttatgctaatgtgtgctgggtggtgggagggatgggctggctcagctcactaagacgacagtgatggaaaaagaggctggcagcccaggtgtggggggacagtgagtcacaggggaaaaggagccagaagacgaagatggagcaggtagctaaaaggagagaagaaaagagcgaagctgaggttatgttgctctgcaaaagcaggtgggagagcaaagtgggaagtgtgtccaggaggctgaagggaggataagaactggattgaaagaacctccattctcaggggtggcagatgggtcacacgcccaagagcctgagcgccaaccaactgctgctcttttgtgtccccagtggggtccttgtcaggcaggttagtcaggtaagtccatgggtatggatcccttcccatagttttctgctatgacttgagaacttctaagacttaaacagaaccccagtccctctaagttgtagccagaataggctggaactcgcatgaagacagacatatttccccaatgcagcaatgacatagcctctgcaactccaggccaaggctccttcccatccaagtgtccagattccacttgccaggaattcgctctccccacagagcttcgcaggacccaggaaaaacacaaaatggcccctctatccatttggtgcaatgttcctgcttacaaaagtcctgcagggacatcattgcatttaatcttcactgcagtcacaggaagtagcatctccactgtttaggaaagaaaatggagtctccaggagagatggactgacttagccaaggtcccatgatttacaaacagtaggagcagaattggaacctggttctctttgactccatgtcaaggctcttttcaatatagaagggaggaaagagcctccctgcttgcattttccatggggagacagagcaacataccaactcattttcacatggtctgaccctatagatgctatggaaagatccagaacaggagccatccaactacagcctgcaggccaaatctagctcatcgcctatttttttacaacttgtgaactgagaatgctttttatactttgaaatggttggagaaaaaaacagaagaaggatattgtatggcaaatgaaaattatgtgaaattcaaatttaaatgatcataagtaaagttttattggagcacagttgcaccaatttgtttacacaccgattgtagctgcttttgtgctgcaaggacagggttgaattgcaattgtaaagggcaagaaagcctaaaatatttactctctggacttttaggagaaaagactgaaagcaggtttgagggggtctctcccatccttagggatcacctcttctgagacaccctcccaactacctcagaggtggaagtggctgctccccaacctgagctcagataagctcacgcttttccatgtgagtgtggaacccagatcagcttctctacctccttgtctactgggatgggggctcctttgggacctgaattttattgtctttctcttccatgatctcaggactgggcatgaagtggcagcatggcggcatggagagagaaattcaaatttccatactggttcttattagcaattgagttccgtcctgagcctcagtttccttgtttatgaaatgggaatatggaccctatgtggaggccgtcatgaggaaagagggagccgatgcctccagtgacagttttggtcccatactgcatgcagcgacatactaaatgcccatacctcttcacctgtgccatcctcacggctccctggaagtgggcaccatcccaggctcatggaagccaacaggctaaataactgctccaggacccactgagcacaaattgggctctggctgaacacagtccacaccttcactgtctgagatgccgagcacagggtctgcatacagtcggtgttccataaatgctcccctcctcccagcccagcacacaggcctgtgtttgttagtggaggctgcaccagtgggcatcaggatgagtttccttgaacgctgcctcacccagccccacgatgaagggccctcaccctgtcttctgcctcccccaggctgcccgaggtccggatctcagacaatggtccctatgagtgccatgtgggcatctacgaccgcgccaccagggagaaggtggtcctggcatcaggcaacatcttcctcaacgtcatgggtgagtgcagggccactggcccctggtgtctcagtgaggaggacgagtatgcttgagtgtgtgaatgtgcgcacagagtggccatcctgggggccatccaccagaagttctgttgtgctggtgtcttccctttcctgctcttgttgtggaggggcaaccagaccaagctgagccaaggtgtgacccgtgaagtcttgccccccatgggcctcccctcaggaggtccccttctcagcacaggtaccccaacaggaccctccccagggagtgaaggatagcacctcagccgagatgcacacctgctgcagagggaactattctgcccctcagccaaaagattctcctgcacctcctgaggccttaatggagagggcataggatctggagatgaattagaaagcgctcatggctgggattcagagctcctgggttctcaccctctccccatgcctccatttatgcacatgtaaaatggaggtaataatactggtgtctgtctctagctggctgggtccttgggtaagtctatccccatcccagactcagttttcccatgtgtaaaacaagaatgctgctctgcacgttctcagaagcccccactggctctaatgttcttgtcagatacacacctttggattctggctctattgcaaggatgctggggacttggccttgactccagactctgtgttctccggttttcttatcaaataatacgtatcagggaaacaaagcttgcggtacacaggcaatcgatgaaagcataaaggccctgctgaaagccgccgcttctggggaaattgaaaacctccaaaggccagacctccagagggacattgattcctgcagcacacccgtggtggttctggcttcccgatggagccacaatgcaggaggtggcattgccaggaaaagcccctctctcgcagttactcatgcaccactcagctcctctgataaaggaactagcagcgtttgggtgcctggccctgggttggccacaccagggaacctaggagggacagaactcagtttgcaccatcaaggaactccaagtctgatgagagacatgtacttaaccaatcatttatgcatcacaatgtactgagcacctacctatgaggtggccgggaatggacccaaactttttataggaaaaatgcttatctgtagagattttgcaggagacaagcataaaacacatgcatagatgaatcaaaaagagcctgcaacatgctggaaggaaataaagcagagtaaagggataaagagtgactgcaggtgggtggctgctagcatagggaggggactcagggaaggcccctctgcagctattgggctgagtgctttacatgtgttatgtcatttagtcctcacaaccaatccaagggtacgtgctagcattaagtccattttgcagatgcagaaatggatcacagagaaagcaagcaacttgcctaaagtcacacagccaagatcacaaaatcctcctatgatatcaggcagctcagtgttgggccaggacccaggcatcttgactccaaggccagctctgtcgcattgctggaggcagtgaagacactgcgctaaggcctcaatctaaggtgccttcaagcaaggccagagtccttaaaaaccatccctccatgaggcccacacttcctattacttcaccaaagaaccctgagcaggttattctcctactgtggcctcaatttcccccatctgtactgtattagtccattttcatgttgctgataaagacatacccaagactgggcaatttgcaaaagaaagaggtttaatggaatcacagttccacgtggctagggaggcctcacaatcgcggtggaaggtgaaagacacatctcacatggtggaagacaagagaacttgtgcagggaaactcccctttatgaaatcatcagatcttgtgagacttattcactatcatgagaaatagcacaggaaagaccgacccctatgattcagttatctcccactaggtccctcctacaacacatgggaattgtgggagctacagtataagatgagatttgagttgggacacagccaaaccatatcatgtatcatcagagggttgaccagaccatcctacactccctcccagctctgacacttctgagtcccttactccatccactaggtgaggaaactgaggcacagagtgatctcgtgggactcactcaggttgcacaactggcctgatggtctctgctgagcaagggagtgtgctcctgtgggcctcaatttccccatctgtaaaacagggataaggatgcttccctcctagggtggctgtgaggcttaaagtagataaagtttgcagaacgcctacctcatcaagaatatcattgaagagctcagttacttggacactgttgtttttattatcactgtctctgatgtgcccactcctgggcacaactgtgtctgcctccctcttgcccctggttttggccccagcaaagagaagtcccccattcacagctccaaagagccctgcactagtctgaggaatgactgctctgggaacacagcttcacgcaccgtggcaacctggaagccagggtgtgtctctgggagtggcagagacaggggtctctccttactcaccttctctgggcttcttccccaaaggtctgcgtgtcctggcaccatgcacctatggaaggagccaggatatatcccaactgtcataatgatggcaatgccccacacttgcccaatctgagcaatttcagaggggctttcacattgaggacatcatccaatcctcactgcagatcggcgcgtgggggattactattatctctaactcacagatgaagagactgagacccagggaagggaatgaatttgctccaggccttatagggtgggggttatctctgtgccagaggagcgtggcttctgtagctcaccaaggtcctgaatggtgaggggagggccgggggaggcggcgtggctgagtgtttctcatacagcatctcctgtaacccatcgaccacatgggcctgggaggcaggcaccacaataagcccattgcacagacctggctcagaggggcatgggacttggccgaggttggagggttaaaggagataatctatagaacagaatgttctgggcctgaggcttggcacattctggatgatcaataaatagtatctcttaatgacaaatagtagtcgggtcagttacaaaccaggcacaattagaccaatctctgtgaacgtctccttcaaatatgtttcagggcaggtttcaaaaattaaaatcgactcattgctttggttcatctgtggcattgcattcacacacaaagaccctctcttcaaacgagcagaggtcactgaacattggggtctcttttgtgccacacgggaccctaagggccactgcagccaaactggggcaagacagaccctccccagtttggaggtcaatgggaagctcccaggacagtggggagaaggagagccgaggagctggggacggcccagggcccacctgcctcaaagcacagagcagttccaccagaaagcccagcaccccagtctaccatccacacgtccacatccagcacattctaacgcggccatttccagaggcctccgggtgaagatgaaaacgcgagtgcagctgtaatttcacgcctataacatcccactgtgtggtggggaaagacatttgggagtcccgtgggtgacaccaagggtgtatgctgcacacggtcattaaaatgtttttatccgagctgcagataaattgtaagccaatttgaaagttgcgtgctgggccccaggaacgcattatacacagtcatggaaggattttgaaggttcttctgggggtgcaggttaggggggagggagcgtgttaagggtgcgctgttacaatcaattagatgttgtgagagccaggcaccccactcccatccccaccgaagttaaaagactctgcacttctggctcctctggaatgccaaggggcagggtttctctgccaccgagtggggccctttcaacccaaagctaaaaagcaaggccaccctccgcgtgccagcattgagctcagtgttcaacccacagttaatacctcacaaaagcccttggatgtgggcctggtcatccccattttacggatgacggagcagaggctccgagagtttaaggggtacatccacgtgagtcacagagcagggtgggcaggagcggggcgtcccacctggtctgcctgagcccagagcacgtacttatacagcagccttaactcccaaaggaaatttccctccccttgacccaaaggccatgagtcacacaaacctcaaacaagcactggagtggagacagagtgcagggagtggggacttccttgagaccgagccctaactaggtggctcaaaaactccgatggtcctggcatggtggctcacatgtctaatcccagtacttccggaggctgaggtgggtggatctcttgagcccaggagttctagcccagcctgggcaacctggcgaaatcccgtttctacaaaacattagctgggctgtggtggtatgtgcctgtagtcccagctactcaggaggctgaggtgggaggattacttgagcctgggaggtaaaggctgcagtgagctgagatcacgccactgctttctagcctgggcaacagtgagaccctgtctccaaaaatgaaacaaaaccaaaccaataaaaccaaacaacaacaacgaattccgatggatgggtggggctgtttgcctttcggaacatgtaggagtctggaaggaacacagaatgtctgtgcccttgcctcccttcctgtccccatccccatttttggttctctcatccactgctatccagcacctcccccacttctcaaaccctctgaaaggagcactgaacttggagtccagcagacctgggtccaaatcccaattagtgtctacttttgacatggacggtctagtattgagtttcctttctggtaaaacagcatatcagaatgtcttttttgttcaaatatattataaggtgacttggatgcccacgtacatggacattctaatttgcatttattcatttgtgtgttcattcatttaacatatatttattgagcacctagtacattgcaggcactgttgtgtgcactggagtttccaatgaacaaggaggacaaaaaaaaaaccaaacaaacaaaaaactggtcctcacagacagtgcaataggggaggcagaagatgagcaagtgaagagatggggagacaaatgggatgtcagtgggtggtaaagcaatgtcaggaaaaacccatcagggatggggctgttctaggtcaacgtggcctctctgagaaggtaacattcaaaagaggtgagctatatggacttcattcattcatgtcagtgattcagtgacttactgagcattccccaggtgccaggcacaattctaggtgctgtggatacactgacaataagacaaggtccttgctccctggactcacattctctaagggaaatagcttcatggtacagaggacgaaactagtttctggggcttcccatagcaaattgctgcaaactgggtggcttaaaaccacagcaatgtattgtctcacagtgttagtcctagaagcctgaaatcaaggtgtcagtagggccatgctccccatgcaagggaaaaatccttccttgtccctctgcttgcctctggtgttgctggcaatccttggagttccctggcttatagatgcatcacaccgatctctgcctctctcatcatatggccttctctctctggctctgtgttcctgtccctgtgttcagatttgcttctgcttctgcccctgcttctgcttcttctccttctccttctccttctttcttctttcctcctcttctccgtcctcctccccctccccctccttcttctccttcttcttctccttcttcttctcctcctcctccttcttctcttcttcttcttcttcttcttcttcttcttcctcttcctcttcctcttcttcttcttcttcttctcctcctcctcctcctccttctcctcctccccctccttctccttcttcttctcttttttttttttgtgtgtgtgagacagtcttgctctgttgcccagggtggcctcaaatgcctgagttcaagcaatgcactcaccttggcctcccaaagtgctacaggcatgagacactgtgcccacctcaacagatttgctccttataaggacatcagtcattgaattaggactcaccctaatccagtgtgacctcatcttacctttagcacaattgcaaggaccctatttccaaataaggttacatttatacggactgtgggtcagaacttcaacacatcatcttcagggacataattcaacccacagcagtaactgagtcaggatgtagcacaccaagattccctgtctgactctgaagctgacactctctgctcccaaccccgtgggtcacccttcgttgggcactgactaatatgcaggcgctgtgctaaactcttcttgtgttaactcactgaacactcacaaaagctctgcaaggtgagtactatcactttctctttagcagatgaagaaattgagaggtaatgtcacttccctacatcacccagccagtgtgtggcagggcaggggtatatagccatcctgcatgttaacatctctgctcctccagaagtttaccaatgagtaggaagcccagactcataaagtattggtacacattaataaaatgttctatcttgggatccttgtctctcttctggaagcttccaagtgaggttggcagatgaagtagacttttggaacctgaggccagagtggcaacaaaccacaccatatgctttgcaagtctggagccaggaaacacagcttccaccccaaagaacagatgttaatgaactttacatgacgtttctggttggtttgtcttttttcagtatgttctactgatttttattaagtgtgcctggtgcattttccttgttttttttttttttgtttgtttgtttgtttgtttgctctgttttgttttgttttgtcttgagacagtcttgctctgtcccccaggctggagtgcagtggcatgatctcaactcactgcagcctctgcctccaaggctcaagagattctcctgcctcagcctcccaagtaactggggttacagacatacaccaccatgcctggctaatttttctagttttagtcgagacgaggtttctccatgttggctaggctggtcttgaactcctgacctcaagtgatcctcccgcctcggccccccaaagtgctgggattacaggcatgagccaccaagcccggccctttggtttttctaaaatatggttttattgagatacaattcctataacatgcaatccgctcatgtaaagtgtaaaaaacagtggttttaccatattcacagagttgtgcctctaccaccacaatcaattttagaacattttcatcgtcctccaaagaaaccctgtacccatcagcagttacacaccaccccacattgtccctcttctcctcagtcataggcagccacaaacaccctttctgtctctatagatttgctggttctggatatttaatatgaatgagattatacaatatgtggtcttttgtggctagtttctttcgctttgcataatgtcttcaaggttcatccatattgtagcaggtaccagtacttcattcattttcaatgctgaataatattccttcatatggatagatcgcgttttgtttatgcattcctcagtggatggaaatctgggttgtttccactttttggctattatgaacaatgctgctataaacattcacgtgcaagtttttgtgtgaatgtgtagtttcagttctcttgggtatgtatccttggagtagaactgctgagtcaaacaatgactctgcatttaaatttctgagaagcttccagacagttttccacagtggctgcactgtgttatattcccaccaactgcatatgagtcccaacttctccacatctttgtcgacacttgttactatctctctttttgaatatagccatcctagtggatcctagtgaatgtggagtgatgtctctttgtggctttgattggcatttccctcagggccaatgacactgtacgtcctttcctgtgcttcttggccatttggacatcttctttggagaaacatctactcagagcctttggtcattttcaatggccttatttttctttttatgattgagttgtaagagttctctatctgacctacatgtaagtcccttatcaggtgtatcatctgcatatttttctcccattgtgtagattgtctttttactttctccatggtgtcctttgaaggacaaaatgttttaatgtcaatgaaatccagtttatctattttttcttttgtcacttgtgcttttcgtgtctatttaaggaggctttgcctaactcaatctcacaacttactcctgtatttctcttctaggagtttgtatagttttagctcttacagttaagttgatgatgcatttcaagtttatttttatatatggtgtgagggaggggtccaacttcatcatttgcatgtggatgtctggttgtcccagcaccatttgtcgaacacactattctatccccattgaattatcttggcatccttgtcgaaaatcaattgactgtgaaagtgcgagtttatttccagactctccattctgtttcactgctctatatgtctatccctgtgcacgtctggtgcttttctaaccatctgccacctccagcctggctgttactctccagctatgtgactttaggcaatgagtttcacaggaagctctcctgttcagtttctcgacctttccccttaaaagaaacttaccctgggactggtgagggttcccagaggaaaagagggtacagaaggtcctgggggtaatgaaggctgagtctacttccaggaggcccagccagaaccttggatttctggagagctggattcttgctttctaagaccagattcttgaacgtgattctctggaatcccagcctggcactcccctctggaaaaagaagcaaatttccaggaccaataatcagagtgccaagaacttctctcttttcttttccactctgtcacccaggctggagtgcagtggtgcaaccatagctcactgcagcctcaacctcccaggctcaagcaatcctcctgcctcagcctccctagtagctgggactataggtgtgtgccaccatgcctggctaatttttaaaaatttttgtagacacagggtctcactctgttggtcaggctggaagaacctcttttgacttgggaagaagaatacactatacctccaagtgagctaaggagatctgagggctgagggcagacctcacccctctcagaggtctgctgatctcctgtaggcctgagcaaaacagaagtaacaccactctgcttctctgggggacagcaatgggaaagcagagttcagtttgcagaatcccctttcaagaaggctgtctgtgcacaggacagctgtgggggaagtggggcttcttccaagcaaagccgccatacaatggtgtgtatggtggtccaaggggcagggtaggtcagtggagggaggctgccagtctgagatccctgggaaatccccagaaaggcaagattcagagcctcagctacctcctttcccaggatgtctgctgggtggaaaatgatcagctccttcctctgtcttagagcctgagtggatgaaccacctgccagacttgggctaattacattaactggctccaggcgattactgtggccacagactccagggagccaggctgctgctccacaggggaagcgaggaggctgcagagggaggcatgggctggctgggatccaggccagagctgcagagaattcccagagcactgaaggggaggaggtatgaacacgagcttccacctcttaccccagaaacccccagggtctgaggaccaggctggggctactcttattccccaagcaaaagcctggacaagcccattcccaagccctctccctctgcctgcactccttcttaccagtctgggtgagtgacatgcagatgcccagcccctccaaactagaaaaggtggaggctagataatcccccactggagaatgatctctctagtaaattagcttgaccataaatggagtttaattccttagagagttgaggagtggctaagggtatgggctttggattcagacatgacttttctaccagcttctgcaactaatagtaataaaagtgtttaatgtttgcttgtttttttatttatttatttgagacagagtctcactctgtcgcctaggctggggtgcagtggtgcagtcttagctcaatgcaacctccgcctcctgagttcaagtcatccttgtgcctcagcctcctgagtagccaggattataggcgcgcactaccacgtccagctaatttttgtatttttagtagagacatgtttctccatgttggccaggctggtcttgaactcctgacctcagatgatccaactacttcggcctcccaagttgctaggattacaggtgtgagccaccgcacccggctatggttaatgtttattgagcatttactatataccagggactgttctgcttaacacctgctatatcatttataacagccttctaaggtcgattctgtgattactttatccattttacaaatgtgaaaactgaggggttataaaatgtgcccaaggacacagaactagaattcaaacccaggcaggctgcctgccaagcgcagggacccagccactatgctcccccacctctcactggaatgtggcttttgaaagtttatttcatttccctagacctcagtgtccctttttgctgaatgggggttacagtagcacctgttggggcatgaaatgtaacagacaagtgaagggctgtgtccatagctcacagtgagtgctctggaggaggaaagctgttcttacttcctacgtatttggcttcaaccctcaccctgtaaatgtcagtggagttgagggtagggtcagaactatgagaagtgacaatggccctgtgggagctctcaaagccaggcagtgacatctgtggcctcccaccctgggtgctggcaaaggtggtcaggaaagaggatgcagccagcagcccggagtccaatcacacgccctccactgtcttgctgtggcttttcctttccaagcctcagtttcctcttctggaaactgaaggtaatcatgctttttaccctatgggctgtctcaaggaatgaataagatggcacgtttgggcgtagaggaaatgcttggcccagatgctggcatcattgttaggacagggcaggaagttagaagaacagagacgataggagccaacttaggacaataaatgcagtggccggacataagaggcctttccaagcagaagccacaggacatggggaccaattggaaagatgggaacagatgtggagacacggcggacctggcactggatggagatggtcctctgagaaggttccaatgcaaccacgtgatctcactcagcagccagcgatcgcagaaaatgggccgttggggtggagaggccagggcctatggacctctacaggcctcctccctgccagccggagcttctgagaagggcagcagaatgagaagtggggggcctgagacagctggctgtgctgagctaccaaagctggctggagtgggggctgcagcccacaggactgaggcgggagtggtcaggggcccctgagctggatgtgagcatgttcagagacgggacactgtcgtcttgagtgcctggacctggtcagggagctggaggaaggacacccatgctgctcgcctgcctgccacggacctcccagccagctgaggtcaccggctgagcgccagttgagagaggggccagacagatgggtttggggctcggaggagcattttgaagctaactgggtcatctagcaagaacggtcacttcccagcatcagccccaaaggtccaagcctgctgactgcctcctggacaggcttctagaaccctccctccctccctctctgaacacagttctgcaaagaagtgcccttgaccatagcccaccctcacccaggaacaggcccagctcattccaccagctgtccctctaatccccctacagcctgcagggcagagcctgtggtgcctcagtgtgagtgcccacagaggtcaggagacatgcccactgtcccacagcagtgagtggcgctgagattggagctcaggtcttctgggaccagagcccttgacgttcccactccatgaagctgtcaggaaaacagagggacatccacctctctgagtgtgggacaatgtggtagccatatggacctctggatcaagggcctcccaacagtcctggaattcagtggggtggggatctgtatccccattttacagagaagaaaactgagtctgctaataaaaggaaggctagagtttgaatctaaatattctgattgccactctccttccgtggggatctgaggccctgagctcgggagggaagcgaggcctttgaaacctctgacccattattgtgactggatgaagcagacaacccagtcaagcagcacacagtttttggtgcatcttgtccctggggaatagagctagcagactgtcatcagcctctctccaagggaactcggagcctagagtggaaacagaccacttgctctttcgtttctcatgcttacaaatcctttgattcaagcaatatttgtgagcacctactgtgcacctgctgtggggggagcactgagagagtcccatctccctcaaggtagctatacaaattagaaattcattttgatataggacagccaggatacagtctaatagcaatgaatttttcagttataaggtaccaaatgttgctccaggcacttaaatatataaattcatttaatcctcacaatccttaggagatgggtatttctagtattcttattttaataaatgaagaaattgagacccagagaggttaagtaacttgcccaaggtcacacagtgagtaagtggcagcgtttgttttcaaaccctgattgcctagcttgggagcttctctacagcctctcaagagatggcccattgagccctcctgagccaactgaagggattcatctgcttctggaattatctaggcaggtgtctgaagccccctggggccctcaccaactccctggaccttctgtgtctcacataccagggctcccctcttgttccagagtcagatcagcttcagcctcccaggccccgccagagcaggcctgcaggtgcatcattaaaccttgacaagtgtgaggtcagtacgatgctttatcctctccacccctgggagctggatttagtggctccagcagaaggtaaacttcccctccctggaacaggccctttaattactagtgatatgtggctgttgaaactgcagtgcctcgggcccagtgatttaaggggcaggcaggaagtggaagttacaggtgttaacagctgtatcaggagctgggagagcagggatcacagcctgaggaggctatagctgcctctggaggaatgctgctcacaggcactcttagggagagagaggtgatcctactgcctcaggtacaggtacagaaagggagactgaggccaagatcacactgcaagtcggcttggtatgaagctcagcagccctgactttgctgccaacttgcagtgaatccctggactcagtttccccatctgcatatgagaagctcatgtgctgtagagaagctcccaagccaagcaatctgggtttgaaaaccaactctgaggcaggaagacttcactcactccctaggagcaataatcacaataattttcataacaaaagctagcactgattgagtgctcactgagtgccaggcattatactaagttctttaagagctttctttggtttaattctcataacagctactgaggtggtcattcttgttattcccatttttacagaagaggaaaccgaggctcagacagaagaagcaacttacccaagaccccgtgacttagggagtgaccaaatggagtgtccaagcccctctctctgaagccagagcttggcctctctgctctgggacttaaggtccagtgttggccctcaaggagtccatgaatgatgggtgagagagagaagggcacaggtttccagaattccagcagaagaaaaataaggatgatgggggaggactagggtgcaagctaagagatgaggaaggagggagtccttcctccagaggagggcatcaggaaggcttcatggaggaggtggcatggagctgggcctagcaggctggtgaagagataggacaggaggcgctgcaggcagaaggagctatataggcaacaatgaggggcagaaaagcatggcaagagggggcacccctgcatggcaggaacccaaggcatgagaaggggcagggagtaacatatcatccatcacaacagcactcaccacagcagcactcaccacagctgacatttattcatcacttggcaggtgccaggtgtgggtctacatactttacgtagtgctcacaagatccctagaaagtagatcttgtgatgatcccatttcactggtgaggaaactagccaagcgcagtgtgcctcattcctgtaatcctagcactttggaaggccgatatgggatgatctcttgagcccagaagttcaagaccagcttggacaacatagggagaccccatctcttaaaaaaaaaaccactaaattacaaatataacaaatcacacgacgaaaatgaggtgcagcagggataagtggcttgccaaggttacccagctggtaggtgtccgaagcacgatacaatcgtcagccctggccctgagcccatggaaggtccactgctgtgcccagtcctgaggaagcagtgggtggtgaggaaagggccctcgctcctccaggctgtcatggtccctgctcacccactgtccacttggcttggccacaggcagagagggaaggagagaccctgaatccagtgccatccatccattggatatggggagcccatggccaggatgcctcaagagccagatgggccaggggactctccctgcagtagcctgtgggtggggagcaggagtgagggtggagagagtacttcctagggaacaaaagtgcattcgaggtcccaatacctgggtcagggcaaggccaagggaagaggcctcaggcactgggtctctgagacaccctcactctcaatcaagccctgccaccctggccagaagttgtgttcctttgggaatgaggccttgatctgcctcaccaagctctttacaaagatgcaatccaagagatattcaatcaagcaaacgcagttcaatgttcattgcagaacctgagtgatgggtgcatgaatgttcattgtacaattacttgaactgtttggtaggtttggaaatttgcagagtccaatgtcaaggggaaaaaaaatgcatccccctcccacaaaaaaaaatacccctcccacaaaacgcccttctctacagctcctccccactcacccacctcatctcccctggaaattgctttatgaggagcaagcggcaagaatgatttacttgctctctgactcgggaaatcaatcctaaaacgctgataggacaggaaagacgtggccacagagccccccgggaaatctcccgcttgaaggaaagctctgagccaggccaggagtgcggtggggggtaggggctctgcagggagatcggcaggcgtggcccagtggtgctgggagtggtccagagactgggagtggctcagagcactgacctgtggaaacacgtgaggacttcttaccactgccacatttagaggacacgtgggcccttcgacaccttgttctgcacctctaactgtctggatgaggaaaccgagacccagggagggggaaatgacggccatgtcgcagagaaagtccacggcaacgctgagacggaatcttcagccccctgactctcggttgacaccttttcccctgacacaataataaactaaaaaagccgtaacaactagaattgcctttctgctcgctaagtggcagtacttcattccccaccctcgcatgagacagccacccgtgccatcttcattctatgggtgggggggtaggggtgggcaggaagccatcagtggactcaaggacacaccgcttctaagcagaagggctgtgacctcgagccaggtttcccaggccctaggccttcaaggccagggctaagctctgttctaagcctcagaaagccaaggcctgtacacggttttcctggaagggacagaggttttgcacgctgggggaagatgaagaggggtctccccagagcctccaagtccagcccactgctctctggggggaggacggacgagcaacagcttataaggagctggtgctctgctactggccagttcttgaatgtgcctccctacctgcctccccaagcttccgtgggcttccagaggcttctctcacaaagctgcaagtatggtacctggtgaaatcgcccgtgtgtgtaatactcacctctcagatatattgaaaacatcccccaaattggctagctttgctgctatttaaaacagattcacgttacaccccatagatttcatctctgcagacacggcacctgtcgtggggcttaaacacattctctctattgctacataaactacagagcggaggcagttgcaggcagcggccacccacaggctgcggggcaggctgcttccagccagcaaaactccaggagcagagaggatctgcatgggcctagaggcctagggggccaatcagaaaactggagacattgacaagtagccgatcaagccgtaagtggaaagttgcaccggttgtggggagtggagctttggggatttgaagtcctttgatccaatcagcgtatagggccagggaggctccagagggttctctcctgtgcccctctgctgaggcctggggtagcctggctaaggttctccaattcccccaagcctttcgttttctatcagtaatcatcttcactcctgttgactgatcacctactatgaaccaagcccttagttcacataatttagtggttcttaggaccctaatttagagatgcaccaactgaagcttacatagattaaagcagcggtccacatatttgaacttggattagaatctcaggacttgttaaaactcagggtggggactgccggaccccaccccatcccaggttgggcaggtctggaatggggatcaaggatttgcgtttctaataagctcccgggtgattcggatgctggtggtccagggaacacacttggagaaccaccaggttaagggactagtcttgaaaatagtgctataatacaaatctagatccaacacaagacgtctgtggccgcccaccacccctttctttacaggtgtgtggcattttatttctccaccagcaatagcctcagttgggtccgctctgcccggcttcactgattcactgcctagaaggctgccttccctgtctgcagcacccccagagcagccagccagagcctccagttggggctgttaattttatcttctaccactgcgaaagcacaacagctggcaggggaggggcaaggcaggtgagcgggtgcttccaggcacctccctgcagagcagaggcggtgtgggtggatgacgcccgcagccactgggatccttcatgaacccgctccactcagaacggcccccatctcagattccggcaatgacctggaccccgggccccccacccctcgccactgcaccaagcacaggagctcccatggccgctttcaagtttgggggtggggctagattcagctcagcagctgccacataaaagggcccattgcagcccatataagcacagacgcagcgtttatctctcctgtcactgatggcggctccatttgggggctttttgttgttgcttttttttttcccttggctgctgttactactcagttcaatatttaattttcccataaaccaaagagttgcacttttttttccctctctctttttcttgccggggactcccttccactggtgggatctgtctcttcgggtctctgctgggagagaggggcttaggatggggctggagatttcagcccttccaacttgggcagggattggagggaaggatgcctgggcccttccctccaatccattcactcattcacttggaaaatacgtattgagcaaatcctggtgtgccaggctcttgggtgcggccgcaggtaagaagccttccctgacctcgtgttgcttacattctagtgagggtatcggaggaaaagagatgtgtgtgaaccaatatgtgagataattatacactgtgaggtgctctgtgaagaaaatatacaaaatgctggggccccaaacaaaagagagcttagcttagattgaggggtgacatttgagctgagacttcttgaaagtcctgacaaggctcagccaggctaaaaagctgagtgaaagacttcaaacaggggaagctgcacatgcaaaggccctgtggctggaaagagctgagtgtgttcatagactcaaagagaaaaatgtctcagtgtgtttggcgcatggtgatgggagggtaagtattggtcaaggtgtaagggttggagaagggagcaaggtctacagcactgcagggtcttctggaattttcttccacagatgggctatgtgctttcctgtgctgggagaaatgaaggaaacaaacagacattgaaattgaactcctattgcatggctggtcgacactagctctgaggctaggtggaagaaagacaaagctccaacttccagggaacacgcactctagtggggagacagacgttgacccagaacagaataacaagtagcaatgagtatgaaaagcacagggtgctccaggcacccagaggacaggctctaaccctgtctggaaaaacctgggaaggctgcctggaggaggcaacatctgaggccagccttaaaggatgaggtggagttaattagcagaaggcccagtgtgtgcagggcacagaggagatgagcaaagtgaagagggaaccacaggcagctcagcattgctgaagcagggagggcttcccagaggaggtgctcttttgagcaggttcttgaaggagcagagagacaggctagtggagatgatggggaagaaactaagatgtgtggaaccaaaagaaaaaaaaaagaaagaaattaaagtagggaatatggagggacatttatattcatggacacttttatattaaaaaggtggttttcttcttttgtgaaatatggtgtaatgactaagagctgattgaaaaggaaggcagtcaatagagcaggcatgctgagaggaaagaatgggtttttttgcaaacaatataattttgaacttgtctctcccctcccccatccctcccccaagcctaattgattaccaccccatgatgaatgacactgggagccagagtgtgctaagcaccttcgtagagtggtacccaatgagctggagagattttcccttcctcgagacaatggttactcctgggagggaaagaaattcccctatacattgttctcagccaagagaggggcgtgggccattggagagataatataattaaagctttcctgtttgctcagcactttgctatccttacagaaggtttatgtttgctttcctgtttgctcagcactttgctatccttacagaaggtttatgtttattttccatttgcttctcatctcaaaaaccctggaagctgagaggctggcagggtatgtcttattgaactcatttgatagatgggaagactgatgaccacaggcatcaactgatttgcccaaagttctatgggatgttgggagcagagcctgggctagaaccttggtctgactctattagagccagcaccctgggagaagtgggagcggacctcatggaagagtatttaactctagtactcacagtttgacacaggtttggggcagatttccctctccaacaattctgagatttatatcagatcaggtttgtgttcccaaatttcaaaggccacggaatgatttacagagcaaagaggagctgctgcattgtctccgaagtgagttacaatgaccaaaataacgttctgctttcaagataaagacaggcaatatttcggagttaatttcataaaaccgatcatccaaccattacctccctgtgtcgatgttaactgttgagtctaaaataacttcaactcctgcctcccttggtggccatggaacaggagtgatggaggttggctgtgacatacagctgtgttagatgggaagccactttacctttcccgatgctagaaaaaattattcatggaaacttctagcagcaattctctccccttaaggcacagtaaaaaaaaaaactagaaagtcaactggtttgattgggggtaggggcagagatcagtggatttaagggagttttatggtggtatccttggttgatcatcatggtggacttatagaatagggtcggcctttcctactgcccaggtctggtgttacacaagtggaataatgtgtctgtaagtggtttgtaaattatgaaactctgcccatgtctagactctttttttttttttttttttttttgagacggagtttcgctcttgttacccaggctgcagtgcaatggcacagtctcggctcactgcaacctccgccttccgggttcaagcgattctcctgcctcatccttctgagtagctgggattataagcatgtgtcaccacacccagctaattgcgtatttttagtagagagacggtttctccatgttggccaggctggtcttgaactcccgacctcacgtgatccactttcctcagcctcccagagtcctgggattacgggcatcagcccctgcacctggcctagattcttactattactaatacaattacgactactgtttattcttccccaagcaaaatatgcctgcttggtgtctcttcaccttagaagggtcatttcagatgaatggtgctgatgagtgtgatgagtgtgtttactcacccacccccaccacacacaccccagagagcattgcactgccacaggcatttcagaaaacacagcctcaaagtccacaaaaatgaggcactgatggtgggagcactggacatcattgtctacaggtgataacagaagagtgggagggagattggtgagccaggggtcttcgttgatgattctttgccacctggatctcctgtgaatacagtgggacacaggcaggtggcctcaccttacactgctcattctgttacctgactttgtatttgggattattctggcccaggaagtcatgtagagttgatatctgtgttcacagctgatctcccacctttgattgaacacttcctggggcatgggatctatcccaggcataggacacataaaaagctgctggcttttgaccttggccagagactgtaacagtgatgggaatggcgatgagaatggagatggtattggggttggggatgggatggaaatagaaatgagaattgagttggagatgaggatagagatgtgatagagattaagtgtggggacaggaatagaagtggtgataggaatggaggtgggatagagatgggggaggagatggagttgaagttggtcgtgagatggagacagaaatgaggagagaataggggatggagattgaggatggggagggatggaaatggagctgaatgtgaggatagagacagagatgagaatggagatggagtggagatggggatagaaataggaatggagatgaggatggggaaggggatgtggatgaggatgggatggagatagagatagaggtggagatgggcatggggtaaagataagaatagagaaggagattgagatcgagatggggaggagattgagatggggatggggataaagatgggggaagagatggagatggagatgggagtggggttggggatgggggtagatatgggtttggagatgaagatggggttggggatggtgataaaaacagggaaggagatggagatgaagatggagtggggatgagggtggaaatggggataaagataaggaaggagatgaagatggagatggggatggggatatggatgaattggggaaagggatggggatgaggatgagggtagggatgaggatggggatgggaacggagatgagggatgaggtgggcatggggatgggaatggagatgggggatgaggtggggatggggatgggaatgaagtggaggagcaggtggagagggggagtggggtgggaataggaatataaaaagggaagcctaagtgaaggaaggcttttattgggctatgaaactggcttttattgggctatgcaggcaggaatgccgtacttggtcaagagaagggaaaaagaaaaatagaaaagaagagggcgatgctaatagtgactagaagagtgaagcatctgtcaggagccagggactcctggatggagacggctccctgactgccggcactcagagccctccaccaggagacaggaggtgagatgcagagtgacattttcctaggactcactgatgggagtatattgatggggagggtgtgggaagcctgagctgtccgtgctgatgttaacagctctgctatgtcatcgtccatacaactgaaatctgttattgtcttatgagcttgattaactgtacatattgctaatataacgagggatggaaacacagctccagtcagggtctgtgtgggtggtgcgtgtgacttaggtgcagatctccagagagagagagagagtgtgtgtgtgtgtgtgtgaatgtttaggggggtgaagggtgtaagcgccatgctgtgcaaagaatcctagccaggatttggaaggctaggggccattccaggctctgccactgacttagggtatgattgtagccaaacctgtgcttctctctgatctcagtttgcttacttataaaatggaaagtctagaccagagttgtccaagagaaatataatgtaaagtacatatgtcactgtaagttttctaataaccgcattaagataagtttaaaaaagaaaaggtgaaattgattctagtaatatatttattaaacccaatatatccaaaatattatcatgtcaatatgttatcaatatatcttacgctcttcttaaaaaattaagacttctgttttacacttacagcacatgtgaacttgaacaaaccacatttcaggtgctccccagccacatggggtgagtggctgctctacgggacagcccgaatctagggcattttctgatctcctcactaaactgtgaatgctccaaaggtacgaccatgttttattctcccagtccttagcaaggaggctcaaataagaatgttagtaaatcacactgacaataagcacagctgatatgtattgggtgcactttcaaaacactttgcaggcactacgttactgaatcttcacaagtaccttacaattccatttttcagatcaggaaaccaggctcagagaggttaagtaacttgcccaaggtcacacagccagtaagtggtacagctgatctttgaaatctggctagtctgatctagaacccacctccttagccattgtcctgtactacctcccttatttatagtcatacactaattaaaattgctaccctgcattgcaggtaacttacatgtgccatcacatttactcttcaaagcaaacctcttagaagccaggcatagtggctcacacctgtaatcccaacactttgggaggctaagttgggaggatcgtttgaggccaggaattcaagaccagcttggacaatatagcaagaccctagctctacaaaacataaaaacaaaaacaaaaacaaaacaggcgtggtggcacacaactgtggtcccagctacttgagaggccgaggcaggacaattgatcacttgagcccaggaggtcaaggctgctgtgagccatgattgtgccagttcactccagcctgggtaacagagcgagaccctgcctcaaaaaacacaaaaaaaaaagaaaaagaaaagaaagaaagagagagagagaaagagaaagaaaaagaaagaaagaaagaaagaaagaaagaaagaaagaaagaaagaaaggaaggaaggaaggaaggaaggaaggaaggaaggaaggaaggaaggaaggaaggaaaagagaaagaaagaaagaaagggaaggaaggaaggaaggaaggaaggaaggaaggaaggaaggaaggaaggaaaagcaatcctctcctctcaggaaggttctaggtgtctgatctctgtttgctcagtgaagataagaaagaatgaatgagtgattttaaaggagtcgcctgcctggttctgagcctctaggattcttggaatgtatcctgatacctattcacctgccatcacgagccatgccagagttttatgctaagctctaactgcagaggtcactgatctttggggtaactgagtaactagagccacccacagcatcagttcctgatggaatttgattataaggcatccatggaaggtaagtgaatgttcctggtggttcaaatgtgtacatacacctaaaggcaccaatagatacaagctccctttttcttcccaaaggtcgaggtggctcagcttcatgtcagaggctgggctctggagtcagactgcctgagttcaaatcctggctcttcctcatactggcaccgtgagtgagtctgagcaagttgcttcacctcttaattttccccatctgtaaaatgggaataaataaacccagcctgtagactgatggtgaagacagaaagaatgcacacatgttaagaactcagaacaggtcctgattcctaagagttagccgttgtggattcttgtgtgggatccaggttttcggttgagttttggaaaggttagattgcagaatctgcaatttctaggtaattgacgtgttctgctgtatttttcccttctcggaattcctatccggcttaccatctgttttatgcgatcttacgcttaattacaattctccaactattgttctcccattgttttctgtgtgctctgcttctcttgctgacagcatgggttggctccctgaatgaatgaatgactcatacctgatttcatttcactaggccttgaaatagagttgcccgtgtgtctgtcgcccccacctgactgtgaactttgcaatgcttcacctgtttcatcattgggcacctcctggcagcacctggcattgttcccggcacctagtaggtgtcaggaaatgtttgtcgaatttaattaaacttaactagagtgaaaaccccctgaaggaaggaaaggcccatacctctttattttctctgcttccctccctgtgcgtgtcccaaggctgggtaaatcagaactgacagcttttcccaagtgaggctctaagattctggttcctgtcctgctgattatgaggaggttagggaaataatagcagaaatcacaataatagcaaattcctaccatatgctaagcattttcatatgcattagctagttttgtcctgcaaaaatgtctgccaagtattaatattattcccatttagcaaattgggggactgaggctcacagttttggtgacttgcccaagcacgtggaggtggtggtgaccgagctgagattcagacccaggtgtgcctgatggcccagtccctgccccttgcgatgccccacggtgtctgggagcaagggttttgacaaaccagccaggggcagtgggtgaggagagaagagaggttgagtgggtgggaggggtggccaacaaaaataagccaacttccagaaaggatggaaggaaagactcctggccacaaatagctgtccagctgcccccatccaagtgtacggtaccatcctccccagctgaaattcccactctgttttcagtctcttccaaatgcaagtcagatgatgtcactgctctcactgaaaaccttcagtggctccccattgctctcaggataaagaagaaaaacccaaaacctgtgctttaaagataaatcagccctctgggggctagggcagaggaaggggggaaaaggccccaaagtatagcagttgctgttttttgtgatgtgaagatactcactgtgacaagttacaaacagttaaccgccggttcataaaattcctgaaaatgtcacaacctgctccagcatgccagttcaagtcataatccccctgacagcacaccacgtgctctgtgccctgctcatatgcccagccccgctgggcaccgcattccccctggcctgccccgctctgtcctggccaacctactgcgggctctggcacaaaaataatccaggcatggtggcacacacctgtggtcccagctacttgagaggctgggaatctcaggacttgttaaaactcaaggtgttaaaactcaaagctccttctacctgccacgctgtctcccacccactcttgtgacctcagatcacggcagcaatgtggctgcttcagcagcgtctgcccagaactcccaggctcgggcagagtcccctcaacacactgatgcctccggggatctgatgcacttcacactttgatctgtgctatctcttgattcctgtgtgtcttctacactaaactgtaagctccaggaggggagggctcttgtctatattcccagcaaggacgtgttcctcactgtagtggataccaatggcaccccctggagtttggcaacacctgccctcccccacccccggcacccagcatggacgtggcccatcttaggtcatcagtgaactcttcctgaatctcccagttgagcccttgtcttcctgtgcttccttttggggcagctcctcccacctccattgaagtggtggctgctgacacaccagcccccttcagccgctaccaagcccagaacttcacgctggtctgcatcgtgtctggaggaaaaccagcacccatggtgagtacccctggagtgcccagctccttcctatctgccggaccaccctgcttcggggctggtccagctgcaggtgtcgccactgtgcctggaaagggagtggttggccagggctgactctgtccccatctgccttggtctgatcccgtttacccattggactggtccaggcatccatgtgcccctgttgctacccatctccccatgctgagaacccccacttctcctggagacaaagtactagaacttcacagcaggagcagcctttcggggagcccaagacccagcatgcctgaccccagttattgagtcccacggagacaaatgaaagggggccccgagaggaaaaggggcttgtcccaagtcaccatggcactcctgacagagctgggtctcaagtccgtgtctcaagctccaggttcactggcattcccaggagcccacatgatcagcaggaagcccatctgaaaggagggacaggatggaagggcgagaaggaagggagaaagggagggaagagagaggaaattcctttttgaccaacttattagacccaacatagtttctttgatatttgtcagtgcagttcacgagattttttatgacctcttgaagggggtggggcaggaggtgcagcgtccagagagctggggtcctggccctgctgtactcactgaacaaccatgagcaggaaatgccccctccccacttctgcctctgtttctgcaaggaagtttagggggctggacaatatttgtttttcagcttttttagtagcacgaggacccttttggtctaaatgatatacagggaagcctcatatatatgacatttaaaagtgaagagaggccaagtcactctcattgcacctgaagcacctctgtagaacccgtaggcttccatgaaacccatttggagaaagtttgggctacgtaccctttcaattttgacattttataatactttgggtcttgatcctgtgagtttcgcacagtactaggatttagcaaggtgtggagctagagcaatgggtacataggattacagttcaagacgggagccaaatggttcccctcattccagacccaattgtctcccaggcatggtccaattgtgcggccttgggaatctaggccagccctgccttgcgacctggggcagggtggtaaatgggtctgtagaggtccaggacagggcagtaagcaggtgcacagagacacaggtggggcagctggcagggtcacagggatgcagagatacaggtgaggcagtgggcagggatgcagagacacaggtgggacagcgggcaagggcacagagacataggtgaggcagtgggcaggggagtagagacacaggtggggcagtgggcaggggcacagaggcacaggtggggcagtggacagaggtgcagaggcacagatggagcaatgggcaggggcacagaagcacaggtggggcagtgggcagaggtgccgagacacaggtggggtgatgggcaggggagtagagacacaggtgaggcggtgggtagaggtgcagaggcacaggtgggattgtgggcagaggagtagagacacaggtggggcactgggcaggggcacagagacacaggtggggtggtgggcaggggaacagagacaagcctcagtccctaggaagtggacccaaaaaggtagcttcaaagccagttgctgaaagcaggacatgaccccagattttcccctttggaggccatagacaggtccagtctccctaaaatcaggaaagctgtttttttctcacagagaaaaagtcctttcctgaaaggcacaaagaaaggcttttcacagcccaggggctgtaggaagacccctcctacccagcctgtctgcctgccccaacatttgcgacacggcaataaaatattcagatatagacatgcaaaagaacctcatctccccaaatcccaggcatcttatgtttgcctgagacatcagaactttaaagtaattctttgatataaattacaaacctgcatttaaagcacttttcaaaaagaaaaaaggaaagaagaaaataaatgggggaaaaaaaaccaacgcaggctatcatgtgcagaagagattctttgttggcattacaaactccgacaaaaatcctacatttcctacccccatcccctcccacctccttcacccccctgcagtccctccctccacacactttccttccgctcccccacctgtgtcccagagagctgcatcccactcttccctctcccgcccccctatcgatttatttatcagatttattaaaaatacatccaatcccctcaggaatctgggcacatgtaccaaaataaaaagacagcaaattaaattaaatgccgcctcacaaaacttgagttccccgttagcagagaaagtgaggagatgtttgctctcacctcatccccgcacctagcttcctcccacacatgcacctgttttctgccttccatctccaaaacgcacacgcacagagattctttcttccctcatcctctcccaacgtctcacttcatccccggtgccttccatttttccctcatccccaggacctccctgagtgggcatggaccacacccttgggccccaggtggttgccatggtgtaggccgaagtccccatttcccatgtggttccactgatgcacccaacagccccatgaagcaggtgtcttattcttctcttgacaagtgaagaaactgaggctcaaaaaacctcatcagttggtaaatgatgggattgggctaagcctctgccccaagggcctgcatgtgttcccattgtaccacactggctcatagttcttgggggtgttgaagggaaaagagtggggtgagggctactgtctagactactatgctctggaagaactggcatcctgtgcccagttcatcggagaacccactgggaggttgaagttagtagcacaaaatcattttcccacaccctccttacaatggcaggtttatttcaaacgagatggggaaccaatcgacgcagtgcccctatcagagccaccagctgcgagctccggccccctacaggacagcaggcccttccgcagccttctgcaccgtgacctggatgacaccaagatgcagaagtcactgtccctcctggacgccgagaaccggggtgggcgaccctacacggagcgcccctcccgtggcctgaccccagatcccaacatcctcctccagccaaccacagagaacataccagagacggtcgtgagccgtgagtttccccgctgggtccacagcgccgagcccacctacttcctgcgccacagccgcaccccgagcagtgacggcactgtggaagtacgtgccctgctcacctggaccctcaacccacagatcgacaacgaggccctcttcagctgcgaggtcaagcacccagctctgtcgatgcccatgcaggcagaggtcacgctgggtaagacttggtgggggcccttctgtagagcccttgcagacctgggtgtggggagagccttggaatagggttcctgggctgaggacagccatggaaagggggaggagatggagcaaactggagtcaggatgagcacaaatggtagagtcaggttcttagggaggtttgctgagctggattggagaagatgggaggtacccacaggccaaggtagtttgctgggttgagccaagaacatgagaggtcagaagagtttgctggatagggtcagggacacaggagatcaggggaggtcagaggagttcctggattagatcaggaacatgggaggtctaggaggtcttctggaagggtcagaaacaagagattgaggagatttgctgggttgggtcaggaacataagaggttggggaaaagcaagggagtcactgggctgggtcagcaacatgagaggtcagggagtttgtacagtccagataaaaaagatggaaagtcagagaaatatgctggattggtgttaaaaacaggggaggttttctaggtcaaaactggaaccaggatgtttgctgggtaaataaagtatacacaagagtcgggtttcttcaggaagggttgctgagtcaagtcagaagcataggtcagcgtgaagaccaggggaggtcaagatttttctagtcagcctcaggagcacaagagatcaggggacatttgtcggatcaaggagaggaaccttgaggtcatggcatgctcaggggagttttctacatcacaggtgggaacatgggaggtgacagggagattttctggattgcatatgagcccagtgagctcagaggacagttgctgcataagggttgcaaacctgggaggttgcaggctttgctggatcgggttcgagaattctgaaagtcataggaatttttgccaggttggggtcaggaacacataggacatggaaggatatcactccggcttacacttttaagtacaatgaaaaccctgtcatctgtgggtatgtgggaggcaggcaaagaggacactggctgcccagagacagctcagcccaagaatctaatccatgtccatgatctgcacctctccccacagagcaccaacccagggatccccaaagcagttccctggtaactcactctcttccccttatactggtcctccccactgactcagggcagggaaaggggagatgtggaatcttcgttgctgaaaatatacaagactcatctccagttgtttgtatggactgggtgggcgagggcaggggatgggcacgatgacctgtgcttgtcctttcccctatgtcctttgaaccttgatttgcagcccccagcagctcctccctgagcccgagatgcctgggctcatactccaaaactcctgtagtgtcaggggctgcctggagcagtccacagcctctaacccaggccactcatgaccaaggactgagagcagtaactgacaagaattgggactgcagcttgtgtcaggtgttctagagagcttctgtttcatctggaccatcagaaaacccaacacctcctcagtatcaaataccaaagaaaaggatttcttgtacggatagtatgtactatgtgccaggaacatctgcaaggattctcatccaatcctcacaagcacaagttggctgtgtagtctcattttgcatatgagcaaaactgaggctcaagttggtagagtactttgccaagtcgttaactttgtatgtagcggcgttgaaatttcaagccaagtttattggtgccttcttcactcactaccatgccaaccactgaactcaccagccccaggatgtggtgtcttgactggttatgggactggttccctgaagacccattacaatggacctttgatattctctctctctctcttttttttttttttttttttttgacagagtctggctctgtcacacccaggctggagtgcagtgggtgatcttggctcactgcaacctcagcctcccaggttcaagtgattctcctgcctcagtctctcaagtagctgggattacaggtgccttccaccacatcctgctaatttttttttttaatagaggtggggtttcaccatatcggccaggctggtctcaaactcccaacctcaggtgatccacctgcctcggcctccaaagtgctggggttacagacgtgagccaccgcacccagcagccttttgattttcacaggccacctgcccatacagaaactaaaaataaaggctaacatttagtgagcacctactatatgccacagactgtggcctctcttatattaacccagtgagacaggcaccattattatcccatgtcacagaggaggaagctgaggctcagggaagttaagttgcccaaggtgagtgggggagaattcaaaggctccagagtctgctctaagcctctcactctgcctcctcacggcgtccctctgtcacaggtgcccacttcctgggtactctttgttcatcattccataaagatatcacaagcagggccaggcacagtgtctcacgcctgtaatcctaacactttgggaggccaaggcgggtggatcatgaggtcaggagttcaagactagcctgactaatgtggtgaaaccccatctctactaaaaaaaaaaaatacaaaacttagctgggcttggtggtgtgtgcctataatcccagctactcaggaggctgagacaggagaatcacttgaacccaggaggcagaggctgcagtgagccgagattgcaccactgcactccagcctaggtgatagagtgagacttcatctcaaaaagaaaaaaaaaaagttggggggaaaaaagatattacaagcatcacaaggccaggccctgtactaagtgctgggatcttcccaacccagagcctgctccgacccctctcttggtcctcctgcttttccagcccttcactcctctctctggaccctccatccttccatggcctcttcctcccctgacagagcagcctccaccctttacctggttgcttcatttatgaaagccccctcctgcccctcttgtggaagctctggcttccagcggggtggcacccttgccccaccccaccaagaataaggaggagaaagatgaaaggccagatacagacttcaaggcagctggtgaaaagtgagcttgtagctgacatcttctagtgatgagagggggtgtgcctctgctggcctgtgtgacccctatcaacagcaccccaaaccacattaaagcacttgcctgctctgtcctggatcccaggccctcccttaactggagccgcctctgtgggcacccccactcatcatcagagcaagagaaagaagggcccactcataagcagtgggcctggacaggcaggtctgcacacaccgggggatttggggcatgggggacacagcagggccaccaagatgaagggccctaattgggtgggtgagtaaagagacacctgggctgacttcctagcctccctcgactgctgagtgagaattcagacttcttaacgtctctgagtctcagttttctgacctgatgaagggggagaatagtaactgcacaaatgttttgagcacctactcagagccaggctctctgcaagatgctttcctcaccaggtctcctttaaacctgcagtgaacctgtgaggccgctgagagttgctatcatattattcccatctgagaggtgagggactcaggtttagagtaacctttcttaggtcagccagccaaggctgtctggccccagatctcacattcttaaccactgtgctctacagcccacctgtcagggctgtggtgagacgtcactgagccaggggatatgaccagtggaatgtgccatgagccaaagagtcgtgagtgtatgcaccttgcaccatcagggcaccctgcactctgggtgagacagtgggacggattagatgacctcagagcacaaaatccaatcattcaacaaggattttgaagatcaggccaacgagggtgggatgtgtctccctgcaatgagccttcgctcctcctcttcccttgcagggatgccctccgcagctgaaatgccacccctccaggaagatttctctgactctcccccaaccctttgagctgtttgtgcctcttctcagttcttgtctcaccagatttgtacctttctcgtaatctggaccacagatgcctgagcgtcctggcacccatctcactaaatggcaaccatgtccttcccattgatcaaaccagaagccttgcagacccctcaccttttccactcttccctcctatcccacatgcaaaccatcattaagccctggcagctcaacttcagaatatatcccaaatctgccactcctcacggtctcctctccaaatacccaacccaagcaccatcagttcaagcctgggttattagagtagccttcaaactgatcgttctgcttccactttcaccctatcctatttcccaccccgattgatctacttaaaatataaatcagatcatgacacccgcccaaaaccttcctgtggtagacaaatagattgacaaaacaggatagagtccagaaatagatctacatacacagagttcattgatttttgccaaagacccccaaggcggttcaatcaggaaagagaagttctcttaaaaaatgaccctgaaacaaatgaataggcataaggaaaaattaaacctggacccctgcctcgcacacacacaaaaattaatttgaaatgaatcatagatttaaaagtagaagtcagcatcatgaagcctctagaacaaaacatagcctttgtgatatttgtgtaacaaaggtttcttaaagtggtcacaaaataaaaactaaataaaaactaaatgataaattgaatttggtaaattggacttaatcaaaaattaaatcttctgctcttacaaagatatccttgagaaaaaagaaaagcaaactatagaatgagagaaaatactctcaatacatatatctgacaaagcatttgtaaccagaatatataaagaactatgacaaatcaataatgaaagactacccaattttttaaaaaagaaaatatacaaatggctaataaacatgtaaaaacctacactacattattagttattagagaaatgaagattccaacctccatgagataccatttcacatctattagagtggctaaaattttaaaaactgacaataccagatgttgacaagaaggtagaacaatcagaattctcatgctttgctgactgcagaataaaatggtactactactttgaaaaactggcagtttcttacaaagataaaaatatttctgttcttatgacccaacgatttcactcctaggtatttacccaagagaaatgaaaacatatgtccacagcagctttattcatggcaacagcaaaaacaacagaactgtaaataatctaaatgtccataattagaaaaatgaataaacgtatttgtagtatattcatataacaaaatactttttatcaatacaaatgaatgaactcatgatacctgcattagcatggatggagctcaaaaacatgttgatcaggctgggcacggtggcttacacttgcaatctcagaactttgggaggccgaggcaggtggatcacttgcagccgggagtttgagaccagcctggccaacatggtgaaacctcggctctactgaaaatacaaaaattagctgggtatggtagctcatgcctgtaggcccaactacttgggaggctgaggcaggagaatcccttgaacctgggaggtggaggttgcagtgagctgagattgcgccactgcactccagcctaggcaatagagtaagactccatttcaaaaaaaaaaaaaaatgttgatcaaaagaagccagatgacagagtactcactgtgtgagtccatttatttgaaattctagaacaaaaaataaatatccattgatagaaatgggaacagtgttggcctatgaagaatggaaattgactggaaggaggcctctgctcgagtcctctactcagagggtccttccttgaacactctatctaaagcagcctcttcctcctggttccttccaccccttctcttgctttgttttcttacataactcatttccacctacaagtatattctatatttgcttattgtctgaatcgcccacaaggtaggaattgagatttggttttagatgtaatggcagtcaggtgaactggcttgaacaattcattcttcatatatgttttaactgtgataaaatttacatattgggaaatgcaggtccttcagtgcacaatttgacagattttaataaatgtgaatgctggtgtaaccaccacctcaaccaaactctgcgcattcccatcacccactagaatttaaatggcacatgggcagggtcttctttatccgcctagttcacagagtacagggctcagaacaaccccaacatagttcttaataaacaactgtttaatagttaattaattaatgcttttctaggttgttgagaagattaagtaaggcagtgcatacaaagtgcttatagtgacaggcagaggaaatattcaggaaatataagctactgttattattcatcatagtatccccaacagtgaccgggaatagtgaccaccacaaattaggtgtacaataaagaattagatggatagagcaaatgaagaaatggatgggtaagcaaattggtaggtttatgggtaggcacttggatggattgttggatgtttgaatagatgaatgaataaaatgaatgcttggatggatggaaggatggatggatggatggatggatggatggatggatggatgttttgatggatggatggatatttggatggatgtttggagggatggatgaatgggtggatgtttggatggatggatagatggatggatggatggatggatgtttggatgggtggatggagggatggatggatgagtgtttagatgggtggatggagggatggatggatgagtgtttagatggatgaatggatggatggatgaatggatgtttggatagatgtttggagggatggatgaatagatggatgtttggaaggatggatatttggatggatggatggatggatggatggatggatggatggatgggtggatggatggatggatggatggatgagtgggtgaatgggtgagtgattgtcttagaaagcatccagaattcctaggggaaacttagaggagcttttccttgagattccacagtactatccttgcatcaggatgctcaggacaggtaaggaaggcaacttatatgtccaggatctttttcattccctgagcagatagacatcactttacatttcacattgcagtcttatctccctcctccattgtcattttcagagtatttcctcaagcagggtggtagcctattctccccatttacaagttagaaaactgaagcccaacaagttgaaatgactcatccaagtcatgcagccagaaagtagagggctaggtgtcaatcctgggtctctggactcctgctctttctctacgtccagggcttgagaggcaggaaagtccggagactaagagcattcctttcgggcactctcagccattgtggtctagaagcaggcaagggggtgtaggttttgattgtctggagctgctaatgggccaggctcggagtgtcaggaggctgagggtggaaggagtgaggaggctgacagcagcaggcttggcttccagaagcaacatctcaacacagcagtaaaagagggagtcagggaccatcggctgcaaacgcacttgtctagtggcagctgccaggatagagcttgaaagcagcgagggaggaccagacccctcttctgcccaccctctgtgcccctcaggatcagatgcacacaggagcccaggagccggggtgccctgggtggaagaaggcacccatctctgccccacctccacccttgggctctgagactccctctgaagccctatgtgctatcacgtcttgttactggtacttcctatagcatgaccttggacaagccactgcccccctggagggccagttctatgacctgcacaatgggtttcgtgataacctgcctcgtaagtaccagaatggtgtgactgtcctaaaatgcctaaaatggagtctagcgcatgtttgacacctgagaaaagttggttccttcttcccttagaaccagcaggcccaggcccgggcctgaaggagtaaggcaagccctttagaaagcagggcagtgaggaatctaacctagaagggaaaggtgtctgcccctgccctccagggctctagccttctccaggaccgggatgcccttcagcgccctctcctggctgcagccaacaatgccgccccagcagcacctgaagaacgtaaagagcccccaagattacccaggggcagactgccctaggcctggtttcccatctgcaaaacgatgtctacagcacttgagggttcattttaaaacccagaaacttacttgggctccctgagccttcatttccttatggcgacaatctcaaaggctggaaggctaaatgagattatgcatatggcacttcatgtaggtcctggctcttaggactcgctaaacaaatgttagccatcaaacctgccactgcctgatgttcctaacggccccgcgtgttaggcaaggggtatcattgttcccatggtgcacttgggaatgcgaaggggagccactcatccaagggcgcaaagaacagattagaactcagctcgcaggtatcccaggccagtggcccttccacacgactggctggcagatgcagctgtagaaccagcccttcccttcccagcgattccctctccttggtgcaagccctgctcttcccacggatgcttccctagacccatgtggcatttcagatgtcttgcttatggtttaattaatagtcctttgatttcattctcagagaatgaaattggcagtgcctgggaggccacccacatctgccaactgctctgatttccgttctaagagctttgcgtcagaaagagaggtccggggaccagcaaggaaaggtgggggtaatcccagggcagccccagggcctcaggacaaaccttttccacccttagaagatgtttacacagagtagcacaaagcatagagtaccaaacaaaaccctcaccccttcctccggccctggaaactcaatgggatctgtctcccaacccccttccctccctgacctgcctctgtcccatgccctggctgttccctgtgcctggaatatgcctcgtgagcttcacagctcagcttaaatgtcacctccttggaagaggcaccctgaccactatctgaggatttcacccaccaattctgagccccctcccttggtctagtgatctgcatggagcactgtcactctcatcctgttttgcgtatgtgtttgtttgcttatgaactctcacccctactgaagtgggagctccatgtcagcaggcactgggtcttgttcaccaccatatcctcagctctgctccaaatggctggctccataattactgttgagtgagtgagtgagtgaatgaatgaatctgggggaaagagtgctggcgagaaggtcaggaaacatggttaactggctctgtgagtgaccttggataagcctctacattatccgtggagctctgtttgtcagctgaaatgaagggaacagacccaatgatcccgagtggctcctccatccctgatattctcaggtgtcgttcagaggatagccatgcctttgggcatcttggctttcaagctcagagatacaaagggactgaataagaggtgatacaagaaagtgaggaagagaggcagggaggctgtgcacaaggaaggaggtggtctttcttcccacaccatgtccacccctacccagaggttctagaaaaatcccactgggaagattaacctgttagaaagagcactgactcaggagtaggagacccgcaccttgatcttggctctcctcaaggtgtgacctttggcaaatcacttcatgaccctctgaggcccagttaactcaactggacaatggggctgatgacaccagaaacgcacctcccaagggggtagcgtgggtgggagttgggggtacctcaagtctggctgctggtgcaggctgctccccctcagcagcctagtagcacgtgccccaggtacgtttccctccctgaccccactgtccactgggcctctctgatcttgtccctcatggcactggcttgtacttgtctgttgtttgtctttcttccccactgatgtgtgaaccccccaagagcaggaatcatgtcctatatacacccttgactccccaggtcctagagagcatctgattcattgcatgggcttagggaatatgtctgaatgaatgcagctgtgaatgagtgaatgaatgaatgagcacactgagcttctcacagaagcagctgatcccaaggatgttgattgctagactagaactttctcttccatgtaccctgtccctcctttccttactctctctgacctggcctttctctccctacagttgcccccaaaggacccaaaattgtgatgacgcccagcagagcccgggtaggggacacagtgaggattctggtccatgggtttcaggtcagcctctctctgagcatctgggagggtggtgggaggtggtagaggcaccgacccagcaccagcattcctggcagtcctctctaacactcttcctttgatccccagccacatccagtgggtttcagtttcccaatgtgtaattgggagaatcagctcccatgaggaatggcaaagaggtgcatgcatgtttcacaccttctagaactcagagtaaacctagctcttcaacgagacattctcttaagtcccagactcctcctcctcctggagttcagggcagccactcctaacccgtcggatgagaatgctgtgccacccctggccaggcagcccctgaccccttgctgatctggcagaatgggccctcctgtgacccacctctcccctgatctggccaacagaacgaagtcttcccggagcccatgttcacgtggacgcgggttgggagccgcctcctggacggcagcgctgagttcgacgggaaggagctggtgctggagcgggttcccgccgagctcaatggctccatgtatcgctgcaccgcccagaacccactgggctccaccgacacgcacacccggctcatcgtgtttggtatggcgcgctcaactggggactgggagaacaaccacaggggcgggtcctgtctgggaggtttccccaggaggaagaagcagtaggggcccaaaattttgggcctaaatctcccaaatttgccctgagagggtgccccactgggaggcagggtcgctcagtggttacaactataaatcagcttcggactcagaaagaaccttaggcaaactgcttaacctctctcactttctccatctgcaaaatggggctgatactatccagctcccctgaaggttgtgtggctgcactgagacagtgcgtgtgatacctcacagcaggtgctgggtaaagggccattccttccctgagctctgaaggccatccaccctttggttctctttctgtttctttccaacagaaaacccaaatatcccaagaggaacggaggactctaatggtaagtctctaccctcaggattttttgcttaaaagggagtggcttttgaggcgccagaaagctctggtcccccaaacttcccatatgcacacccttgccactccctgacacctcaggcaggtcattgccctctagtagggcagagtcagggtccaaagtgggcagaggtgggtactgaggcaataaaaagggactcagcctgccaaagcagccagctgagatttccagggccaactctgccccatctcaccatccatggcatctctggccctcttagctcagagcttgatctcactgcccatggcatctctagctttcttagctcagagcttggctgccctgacctcagaagggtgtgtccagcctcgaccgtggggctgcgttctgagactccagaccactccgtagggtggttgggagcatcaacggatgtctcagtgcaggccctttatactgtcctccctgggcatcccccaacctgctctagcctgagcaccaccccagggggcccagacgctgctcccaggcctgccacaccccctccctacatggagccaatctcacagttcacaatggaggctcccactcttggtcctcactgcaccatcctcatggcctctaggaaatctgaccgtagcccagcaagcctagtggtaggggaggagatcatggacagttaggtggccaggtggcagagctgggcttcgaacccagtttgtcctgatgctgaaatccagcgtctttgttggggacctggaggctctgctgttctggaacggggttgggtctgcaggctctgaccctttccctgattcctggcacaggttccattggccccactggtgcccggctcaccttggtgctcgccctgacagtgattctggagctgacgtgaaggcacccgccccggccactccatcaggcactgacatctccacgaccggttttcatttcttttctaaactatttccagtcttgttcttagtctctttccatctgtgtcttggcttcttcagtcggtttaattaaaacaaacagaacaattttcccca

SEQ ID NO: 2442 - DNA, 154068 bp, Homo sapiens
ccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggtgagcgctccgggagggcagccggggggcgccgggcgggcgcgggggccggacggctgtcagggtctctccggcgtccgtctgtcccgctgtgcgtctgtgccactgcgcgtccggctccaggcgggtgggccgggcaggcgcgcgccggggcgctgatccccaggcgctgcgccccggccccgatctccgaggcctgcggaccccgcacccgttctccagccccgggcccagcccgcgacgctgcgcgccctcccccaccccggccaccgtcggccgctgcgccctcgggagaggagccgggcgccgccagcgcgcgaggtggcccgggctggccgggtgggggcgagcgccccgctttgttgtgcggcatgggaggaggcgggggcttaggcccgacctggaggcagtggacggtcgccggaggccacatggccctgctgaaatggccgagtcgctcaggtgaccatttgtcatccatccatcgatgtcactcaaggtgcagctcagagatgaacttggggatcactgtgatttttctttcaggactgagcctggaaacgggtccaggcacactgaaacgtcttcattaaagtttcctggacagagtttattgtaactaagatcatgtttggtgatgaactttacctgtgacaaattgaaggcgcactagaatgggtatttgtacaaatgcctttttttttttccttccgcaaggattctaccttaaggctaaagaatgtacatgacatccagaaagccgtacagggacagagagcagcagcttgggaaaaggggagccaataggttgcggccccagggggacaaaggaagcttaatttttgactgtgttccctttgtaccatttgaactgtgtgccaggtgggtgtatgaatgcaaagaaagtctctgccttgtaacccgccttacaggttcttttccgtgttggcttttccacatgtgattcttcccacaggaaacacctccaagccatttggactgtggtgtctggctgtatccgtcagatattctgggggatctactctgtaaccaatccttaggtgtttgtagttgtaaatacctgattttgctcttacggacatgtggcagtcactcagtatttgttgactactgagtgaataaagacttctgtttttctctgtatgatacagaaaagggctttccaggcaaacccttattcattcctggaagcccactgtgacctccaggagaccttccagactcagccctctcacatcgcaccaggcctaagtctccctggctccacggccctccatggcatgcccgcgcctggcatggcagtcaggataccttatcattatttgtccacctgtagaaggtgacacccagacaggaaatatcttacttttgtatcccaagagctcagcacagagccaggcacatactaggtgtttgtctatgtctgttacattaattaataaacaaaagaagtacaaggcatttaaaggacctttggctaaatatagacatttgctaaatatagtagcttgagtataactccctcctgtgaagacagtcacttatgtatgcatttgaccacagtgccttacaagtgttccctgcaagggccagaggtggccagtgaatcgcaagccttgtcttgatgtcagtggttatggggcagaagaatgagaagaatgaaaatttccagagtttgccttttatccactggtgtttctttcttcttttttttttttttttttttttttaacacagtctcactctgttgcccaggctggagtacagtggtatgatctcggctcactgcaacctccacctcccaggctcaagagatcctcctgcctcagcctcaccagtagctgggattacaggcacgcaccaccacacccggctaatttttgtatttttaatagagacggggtttcaccgtgttggccaggctggtctcaaactcctggcctcaagtgatcttcccgccttggcctctcaaagtgctgggattacaggcgtaagccactgcgcccagcctatctgctggtttttataaaatagattgaaaaggaaggcaagggaacactccttgggttgagagccctgaggtcctccctcccaccgagggagatgcagttggagttacagagatagacttgtgagtcagagctgggctttcaaatgacatagttcttagccagctgtgccatcctaggaaggtgagttactcactcttctctgggcctctgttttctcgtctctaaaatggagaagaagaaacctcccctggctgtcagaattaaagaaagtgggtagcaatgtaaagtatgtaactaggcggtgggtaaatatgagagcttcttacacgcccctcccggtaaaacccagccgtaggtgcagctgttactagtgctgagtagcacagattgatagggttggagggagcaggtgtgacatcttatgttttagtacaaattaacttctatttctcaactgtgaaaatgaaaatcactattcaaatggcaaatatctactccttgaattcatcagggttcttatagaaatcaacaaaatcgtcttgggttcagtactttcttattcactcattgactcaacagatacaagccatggtatccaaattcctgtcctggggagactggagagtcagggaggaacccggcgaggacctgcctgccctccaggagttgggtcagaaaggggttgacacctgtagatcaataatgctaaccgaagacaggaagggatctgatataaaaagggcgtagacagtgttctgaaggtttggacatgagagagaatcacagccggccagtggtctcagaagtggcttcctggaggaagtggcattttgagttcttgaaggctgtatgtaccagtcaagatgctttggctgctgggacagaaaccctgactggactgacattgacaaggggaagtatattggctggagcacagcaagcccggaggcagggcaggattccccgccagcctcaccagtggctccggcctctttttcccacagcacctgcgcagctggttgggctgggccatcctctgtgggtggcctcatcctcaggctgacttgcttcatggaggccagctggccttggctttcccgggctgccactgtggagcccacacaccgtctcttctggtggctctctccagagagctagcagtatctccctggtaaactttcatgagtctgtctggccactcctgcaccaagctctttgacaaggaccatggacttaggggctcagtgcctgtggcaaaggggggtgggtctaccctgtgacctgtcagactcatcctgggactggggagagccggcctccctgaaacacttgggaaggtgggggcctgaatggaaactggggaggcttcaaggaagtgggagggagtgggctgccacttgggcctggcacccaagaacatgccttctggagagtaagtggaaaattctgggctgaggtcattgggaagcctgagtcacctggcagggacgtgggttccagttcgctggagcgaggggaagagctaggctgccctgtgcaggcagggctttgcactcttctgggtagaagcaggactcgtggtgggggcagcctttggagggtgcatttctgcttctgcagccggtgtcctgcttccatgtgatggtttaaactctaggcaagcgtgtatagtaaagggagttatttgcaaatgctgtattatcgcaagtcaattatttctcactctcttgttgcagtggaattcaggcgggatgttatcaggagaaaggtttagtacgcacttgcagaagctcattagcaccaaaggcatgagctgcgcctcccacttctggggaggggtgtttccaacgcagatagattttcctctcctaccgcatttcacattctactggtgcattttggtagcatcccaaacttctcattcagcactctgcagctgagtaaagcgatactggtctcaccatgcaattcaaagtattgctctcaaatgaagaatgtttttcccaacaggaacagtcatttgcgcaggctgcattaggaactcaccgtggggccttgagacagtgcggtgagcttattatcccctggtggtgccataggtaccccttcctcacccagcaggacggaggccctccccccataactgtttctgcagcctcctctccaagctggcccctctgtggcctgcggcctcgggccctgatccatggcaggggcactgctgccccacccggctgcttcaccggccccaagttgactcgtgggcctgcgggtgctgttggttcaggcctcacagccaccgcctttcacttgagccacggccacacaggagtccagttgcggagaaggggtcgcactgcccccaaggagtccagttgtggagaaggggtcacactgcccccaaggagtccagttgtggagaaggggtcacacagcccccaaggactccagttgtggagaaggggttgcattgcccccaaggcagcctgcagccatcaagtaaccattttgtgaggtcacaaaatgtcccccaggcttgtttcaagatgcaaccaattctgtggtacgtttcctgctccggagctctctgcgggccaggctgaggccaactcctgccgagaccacctccctccccagcccttccctgactggcctgcccccctcatgcccctgctgggacagggctcacatccagtcctgccatgggctctgcttctggaacccaacataaagccatgccccttgtttcaggtagttcgtaaatatcgggtcttttcatcctaagtccccctttcattcatcttttctccctgtccttcccaaatagccctcctatatcaacctgtgcggagggagcctgtctctcttctcctcaaggctgttggagaaccaagctggggatggggtgcacgtgttcttttccagaacagcccagaagtggggttcagtgtggaaacttcgctctacctctctccagcactaacctgacctggctcctctggggtggagagtccaggactgagcccagctgcaaagatgcaaatctgggtccccaatgcagtcccttgccctctggtgaggtgaccctggggccagaattcacctgcacgcaaccaagatgtcagacttgtccctaggcctatttcacttgatttgaaagtgaatttcatgacttttttctctatgaatttgcttttctgaggctggccagcagattgcacaccaactgagtgctgctggacactggtttgccattggggctgggccctgcccctttgttccacaggagttgggagaggtgaggggcgttcagtgcccggcaggacacaggactgtccagcctgaacaacatcctgcctccagttggaacccagccgcagtggagtcactgagggctgttctgcagctgattctcctaagccaaacacccatcttggcagatcgtctacaaggttttaggaatgtgacaagactggtgttccagacggatttttaccaacagtctgagctgttggagggcgtgaacaatgtgcctgtgaccttgggctgtttgtgcgattcccaaaagatgcttctgggtttctgagtccacagaaaactcagctgtggacaggcctgctggtccccaacggccctgggccccaccccacagctatttctgtcagagggccagctgtctcccttcttccttttctgggtgactcttgagccactcgttggcctggtactcagggttgggatgtgtgtgtggagaacatgacctggcttctagccctgcctgtcccccgtgagccctgcccgtccccagtgagtgtgagacgggaaaggagagaggggcgaatggaggttgcttctaagacccaaggtgtgccaggtactctggaagctttactcccatagtttgtttaaatcctgtgaaaagagttccgagtctctctgtttgacagagagaaaacagactcagagacaccatgggacatggctgaggccacctattaattaggggctgccagttcatggcccaggctgcttcctggatcagcccctcagctccctccaagaccccattcaggctatgtcctgcaggcaagccaccttcttcctatccctggcacatgtcgtcccccactgacctgtgaaccaccaggggtgacatttcaggagagagagtcccatatctgtctctgccttactgtatctctcatcttctttttccatcctttcatctttaaaaaattgatttttatttcatcagagtaatatatgtttttacccatattctcaggccgttccccacacagtaggctgggcagtccttttaaaatatgtcagatcatgccacttctctgataaaaactttccaagggtgtcttgtatcactccgtaaaacccaagtccttaaacaagctacaagaccctcaatgatctggtaatgatctccttgtttataaataacatacatatgtattacacattagtttatcaattgcagatgctgtcagctggctcctgcattgaaggacgggacttggtgtgcatgggcccagttcaggccagctccctactttccttctctgcatcacactatagttcattgtagtgtggggctaaatgaatattcactggcaggacagactgcttaagaatatgggtgctagaatcagatttcctgggttcaaatcctgattctgtcccttataccatgacttagggcaagttacttatcaactttgtgcctcagttcccccataggtaagatgggaaagttttaggagtatacttcacccagggcagttatgagggtaaatgagatctttcacaaaaagacctctgaacaatgactgtcacatagtaaatgctcagtaaatgctggtgatgatgatgatcttgccagctgtgtaaataatgtcaattgcagagccaagcagtgtactataatctttctttccttatacaactttctgcttcttctagagttaatgatttattttctttttcattgctcatctgcctacatatctagcttatctatctatatatctacatatctccataaagttttcaatagaacccatcaaaatgctatgttctatatgattaaacaaagcagataatctatcaattccattttattctcccatggaaatctacccactagagacctctgtcctctagatccagtctggtctggatgttctcctcagggtttcctgcacctgccattccctctgccaccattctgagaatttcttttaccccctttttattgttgttgttaggtccctattttctggattccatattatctgccttcttggattgctgtcttattttgctggaacacatccttcagtagctttcggagcaagaatgccttttctaagtattcacatgtctgaaaatgtctttattctacattcatacttgattgatactttggttgtgtatagagttctaggttaaaaataattttccaaaaaatgatgaactctgtgtcttctttgacataatttccagtaagtattgttaattggaaaaagtaatatacagaaaataaagatagcatgctgttccttgtgtgagaaaggctgcaattttcctgcatttgaataaaaatcactggcagaacacaatgaaaggagtgtggggatggaggtggaagcaggttgtcaagtgccactcttcatgctcttgatatttgaaccatgtgactgtattaactagtcaataaaataaactaataaatatcaaaaaagtaaaattaggagccaggcattatggctcacacctgtaattccagcaactcaggaggctaaggtgaaagaatagcttaggaccaagagttcaagtccagcttgggcaacaaagtaggacccttcctttaaaaatatattttttttatttagctgggcatggtgatgcatgcctgtagtcctagctatttgggaatctgaggcaggagcatcgcttaagcccaggagttcaagaccagcctgggcaacatagtgagacccccatctccacaaaaaagaaaagaaaaagtgagtgggtgtggtggctcatacctgtaattccaacaatttgggagggcagtgagtggatcacttgagctcaggagtttgagaccagtctgggcaacatggtgaaatcccttctgtactaaaaatacaaaaattagccaagcatgatggcttgtgcctatggtcccagctagttgggaggctgaggtgggaggatcacttgagcccaggggacagaggttgcagtgagctgagatcacacccctgcactccagcctgggttgacagagcaaaactctgtctcaaaaaaaaaaaaaaaaaatttaaaagaaaaagtttggaaacttttaggatcttctctttattctcagaattctggatttttcccccacttattgagcattcattgggttcattcaatctggaaacttgtatcctaaaattctgggaaattttcttgaattttttcctagccccatcattttttctgttctgtcttacagtaatttctgtaagacagaacagaaaaagaagtaatttttcattttcctttcttttcttttttttttttttttgtcttttggtaatacttcaaggaagattcttcaactttaccatccactccctctactaagtttacctgttttatattgaattgctaagtttttttattgttctttatctctatagcatcctttcttgactcactaatgcagtaccttttcttactactctaaggatattaagcaaattcacttaatttgggggttttcctgaaaatttttttgttccctgcatcctggtctgtttcttttcctcctttgtgtgttttggcctctgtcatcttggagcctttctcagatgtgtggtgatcctcagctaccctttcatattttagagggaggcactaaacatggtgactacaatttgagcaaaggccaggaagagagatgtcacaaagtgtgaacaggaagccacacagggcggctgaagtgttggtaccagacagtggttcctcaggcaggggcaagcagctctgatttgaacccagtctcttgcctttgaggccagtgcccttgaccaccatgtcagtgttaggaggaaacattgcttaatgttaaccagtcagacttctctaatttggtgcctgcaggtggagttttgtttttgattaagggactagtaaggctggaaaagaaagttgaaaattaatctgagacatacaccagggaagaacggctaacctctagtgtctacacagctcaaacaaaggaacccatcattatggtattcttttactgagagcgaaataaaatgtcaaattagctgagcaaataaagatagtaaaacaaaaaaatatgagattttcatagcttcaggcatcaagaattgggctgggcatggtgtcttgtgcctgtaatcccagcactttgggagaccaaggcgggtggatcacctgaggtcagatgtttgagaccagcctaaccaatatggtgaaaccccatctctactaaaaatacagaaattagccagatgtggtggcttgcacctgtagtctcagctactcggggggctgaggcaggagaattgcttgaacccaggaggcagaggttgcagtgagccaagatcacaccactgcacgccatcctgggcagcagagcgagactccatctcaaaaagagaaaaagaagaagacaaaaagcaaaggaataattcatttatttgcttggaaagttctctaagatctgagatatactttccataaaacaaataaaatacctggagagtttaggtaggcagaatgtgatatggccttggcagcaggtaaactcttggatcagcaagtctctgagagccagatctgttcagagcctccactggcatattatattacaaactctccatccactcttggcttggggagtgaatgaaaaatcacatagtggtcatgatcatatttaaacataaagaaatcaggagatctaaagttgttcatgtatttttaacctccatcatgtaggtttatcaattttgccctcattgtccttgatttctttcatttttatttttcactttctttgatgacattccttaggcatctgggaagatgtggggttttccaggttgacactcatcgtggtttccatgctgaccaaacagctagcatggctctaccctgtcttccctaagacagcagcccccaatctttttggcaccagggaccagttttgtggaagacaacttttccacagaccagggtgtggggatggttttgagatgattccagcacattacatttattgtgcactttgtttctattattgttacactgtaatatataatgaaataattatacaattcaccataatgtagaatcagtgggagccaagagcttattttcctgcaactacacggtcccatctgggggtgatgggagacagtgacagatcatcaggaattagattctcataaggagcgcacaacctagatccctcatatgcgcagttcacaataggtttcgcactcttaagagaatctaatgctgctgctcatctgacaagaggtggagctcaagtgggaatgcgagtgatagggagtggctgtaaatacagatgaagcttcgctcactcacccgcctgccgctcacctcctgctgtgtgtcccagttcctaacaggccatggactggtaccagtctgtgccccaggggtaggggacctctgccctaagatattgctttaaattacccccagcatatttttaaatcacccaaagctgtgctgtctataggactctgtgctctgtgtctgtgcagtgcactgtggtagccactagccctctgtaattactgagcacttgaaatgcggttagtacagttgaggatctgcatgtcaaattaactttaccacagtgcatttaaaggtaaatagccatggaagtcttggggctgccgtgtcgaccagtgtagctccagagcaattcccttgtggaaatacattgcaatagaggtatgttctgcaatgtgggatatttattgactgcttacacatggggctgcataccactcatgaccaatgcaggtagactggactgatcgatggactgatctattgcaggttggaacctttgtggggctgtggcctcagagacctgtgggtcagcctttttaagttgtgtgaccgtaggcaagtgaatgcagcccagtcttcttttttttatccgagaaagaggaatgctatcgtgtggggcagtcatggtaaagagctagagcccacaggctgcagggcgtgctgcctggcacctggtaggtggcaattaaatggtggtggtcgtttgctaccttcaggtggctgtggttagctctagaaggaggcagttgtgcttcttgactggttgggatgtgccccagggctgagatgggggttgggtggagcttgtgagaaaaatataggaaagatgatctcccatgcccaagagggacacagacggcccttgggactgatgaaatgaactcagaataaaagcgcgaatggctgtcgctgtaaatatgtgtgtctttagtgtcagcgtccctggggacttcttataagtttgaagcatgttaccattcttggcattgagacagccagtgtcacttttacttcttggtcttgaattcaagcatcaacagtaaggtaccatcagatttttcaagctgcttcaccatcaagcaacctagccttggtgcccaggtctttggttggcttcccagaaataatgggccacttcaccccagccttgttctgcacggtttatctttgggcttatctgacctcttagaagctactaaattacccgcctatttttaaccaatgcctggagccggctccagaggaattgccacatgagttgagatgaggtgatgaccacatggtcttccaactcttcatttcaacatctgaagttttttctttcttttgtcttgtgttagggtttctcaatctgggcactactggcatttagggctgggtaattctctgtcctggggggcgctgtcctatgcattataggattttgaacggcatccctggcttctgcccagtaggcgccaggagctcctcgctattcccagctgtgaccaccaaacatgcttccagacattgtcaaatggcccatggggaacaagatacccaactgaggatctctgtgtcaggtttcccctgccacactgctgggtttgtaccttgagctctgaaccactcccctcagctagagaactctgagtctgacagtgactacgactgtttgccctcctgcaaggagggtaaaaagccctagctgaccacattacattcttggcgtttcctgcatttaaacctcctggaaattagtacagagggggccacataccctggaagctgagatggggccattttagaagtcggctgcaggctcagggaatggagacacgagctgccaatgtgattacactttgctggctttggaagtgtgcttgagctgacagtggggctggggaccgtctataacaagataccacagactgggggctttagcatggaagttgatctctccctgttctggaggcaggaagtccaagatctaggtgccggcacattcagcgcacacctcttgtctgcatcttcagattactcaaaatccaggtgtggctgcaggagaagggacagggaagaccctcaactttagtctcacctgtggaggtggggctggagacccagtcgtccttcaccccccaggaccaccccccagatgagaagggggactggatgttggacaacagaaaggtcagtgactgccacatttccacaggattaaaaccgtccccatatctcccgtaaaagcacattgccgaacttcttaaaatagatgaccagatcattgtcttgttcggaatccctgctgcctcagccctgggcctccgcagctctctgcacgatactctcctcatcacctctcaactgatctccagaaagtactgtgtggcccccgcccctccactcctgttcccagcgagagaagcccgagaacctgcagtctctatccaaagactcccccttccaacccctggcctctcttttcgcttggccaaaaggcgtgcatctcagcctgctgggatgggacaggaagggaccattaaccatgtgaatgttccagcatattcacctctgtggtttctacctcttgcttctgtttttatgtacaatttgcaaaggaaaacacccacatacactgtccctctcactaattgaaaattcagctttaatattctgtttggtttcatcaataatattcttttaaaaaatggtattcctcccagcactttgggaggctgaggcaggaggattgcttgaacctaggagtttgagaacagcctgggcaacataacaagaacccatctctattaaaaaaaaaaaaaaaaggccaggtgcagtggcttacaactgtaatcccagcactttgggaggccaaggcaaccgagtcacctgaggttaggagttcaagactagcctggccaacatggtgaaaccccatctctactaaaagtacaaaaattagccaggcatgttggcaggtgcctcaggaggctgaggcaggagaatcgcttgaacccaggaggtagaggttgcaatgagctgagattgtgccattgcactccagcctgggcaacagagtaagactctgtctcaaaaaaaaaaaaaaaaaaattgtgttccttttggtttaagacttagtcaatcttttctccttggatttctgtttttgtgattggtgttaaaatttcaatctatttttctttcctaaatatcttttccaatttttccctatatagaacatgatagttaataaattatactgaatatacgtgtggtgggaggactgccttgcagatccacaggttgcactctgtattaccaatagcttgtttttttaaatatgatttttaaaaatatgttaaagtataccaggtgaaaataacatataacatgcacaatatattgtacagttttgtgtcttgcttttaaattttttgagttatttcagataaggatactcctgacacttgggaggacttccagggcgtcgtcttagatggctgtgtgcttcctttcttgggcccttgcagagttcaggtttctgttggtgtgaagttttcctcctaactcccatgactggagacacttcgcacacccatgagagaatctttggggtacccagggagagtgtggtgtagagggtcagcattgggtgctgcggccaggcgacctcctcagacaagcgacaagcatctctgagtctcagtgtttccacctggcaaggggaggcgatactgggtggctgtgaggagtctatgaggcaatgcagacacgaggcttaggatgggccttcagggaatcatgctggccaaggaccgcgtgtgtgcagttgctgctgtctgccacctgtgctcaaagactttcagactcagaggccgaggcctggcttctgtccccagcttcactccaggttctaggctgcacgcctggttccaggctctaggcctcaggttcccagtcccaggttctaggctgagggttttggttctgggttccaggctccaggttccaggctaagggtttcagcttccgggttccaggctccaggctccaggttccaggctgagggtttcaggttccgggttccaggctaagggtttcaggttccgggttccaggctaagggtttcaggttccaggttccaggctccaggctccaggttctaggttaagggttcccagttccaggtttcaggctctgggataaggcctcccagttctaggttccagactccaggcttcaggttctaggttccatgtttcaggtactaggctaagggttttggttccaggttccaggctccaggcttccagttccaggttccaggctaggggtttcaggttccaggtcccaggctaagggtttcagttgccaggccccaggttttaggctaagggttcctatttcctggttctaggctccaggcttcaggttctgaactctaggttttcgattctaggctccaggttgcagggtctggactcatacaccagctccaggctacctggagagggaaggaagggctgcagggccaagtccgcccccgttttaccacctcctctataaggtgggataaatccgcctgctaacctcacagagttcacatgaggtcccgatgaggcaacatttgagatgatgcacataaagcctaaagggctttgcagctgtgagatggtggtgatattattgtcagaaaggtttaaaataaattcttaaacactcagatgtttcaggctagtttgtagctgcttctgaacatgcagcagtgtgctcatgggccacagggccgccgcgcactcgctacacctcttttggcaacgctgttgctttcctctccaattggaggagagctacaccacccagaatttgctagaaatgctgggtcttgagccccacctgtgctactgactcagaacctctgggggtggagccgggcatttgggcttctgacacacccccggacgattctggcgcaccctcgccttcagaagttctgccttcggtagacggatgccgttggtgtatctggctatacagatgggagaatccatttactctgatgttcctgattagcagagggtggctttttcctgctcagacggctgaggagtgaatgacttcggtcataaccgttaccattgctgtgaccttcccgctgggcgaagctgctagttgaggatctgctccctctcataggcctccctcccttctcccaggggagagcctggccagggcccccagcccggtgggtctgcacttggcacacagcagaccctggatcactagcgtttagtggcagaaaagtgagtgagtgaatgaatacaggaacagatgaatgaatgaatgaatgaatgaatgaatggacttagcttgacttcacataacatttggaaattctgattgttttcaaactagaacaagatttgaaaaggcttgtcagaaatcgcttacatataagtgaaggtttaaggaagcgggatttaatttggccaggtgtgggttctcagaaatgttctttttgattccccttcactctggccagggtggtttgcgaccttacccctccttcatgtaataagatatagaggggaaaattaaagcaagaaaccaaatccttttcctgtttactcctacagtttttccctctttccagttccttgtttttatggtttttcctgccttgtgtttctccgttggcttttgttgcaatgtatgcacttggaaaaaatcttctgaatgatcctagtgatggggctttggcctcattgggcgttgtgtgcacgatcgggttgcattgcacactgccggcgcgatgagctcgcactccctaaaaaggcaatcattgtgtccaggaaaactctgctaggttaatggcacatgcccaggggctgaagtcacttggaccaaggtttgtagaacatgctccgtgtggctttcctgttggggcagggggattgggccagaggaatttaggtgtattaacacagcctgccaggtgcaataaatagccacctttgcctgaccttaacctcacctaagcgccatgctcctcaagagccctgggcaccccaggagtaactgaaaacctttggaggagagttacgctggtgttcttgggttagaggcgggtggcaggctggagaattaggttggaaataaaaatgagtcagtgttggtgatgcgttttgtgaaaccggaaagcttagttagaatgatagagaatacataacctgttctcagcaactttgttttaactgacaacaggattttcccagttttcccactaatgtctcttttctgttctaggatccatctgggatccacattgcattttgtcatcagttcaccttggactcctccaatccatgacgatttctcagtatttacttgtcttcccgacctggtgcttttgaagagtagctcttaggtatcttgtagaatttggatttgtctgattagactgaagtcttggatttgggggaagaatcgcacaaaggtgaagcgccctttccctcacatcctacagggacacacggcaccaatgtggcttcttactgaggatgctgacctcgatcaccaggctgaggtggtgtctgcaggtttctcctctataaagttactgcttctccctctccctgctctggaagcaagtcactaggtccagcccacatccagggaagtggacttaggctgcccatcctggcaggaggaggatcaaagaattagtgggcctgaggttagaaccatcaccatcattagtaaatttggagagagatactcagaggctatgcagatatcctgtgtcaccctgacgtattcatccatggataggtcattcttcttttagtgtgagtatcaaaagcaggttattcggtgcaaccagtgaacttgagagcagggactgggaagccctggagttgtcgtggctcagccccgtgcccctggctgtgttccttccctcctcactgccaagatgctgctgagccctggtctcacaaacacctttgagtggtctgctcactgctggggacatggactccgacaccttcctacccctcaccgttcccctctcctccgacttgccaccgccaaagccagcagtgacaaaggaggtgccaggggcagctgctccagcaggagctctctctgtactccggaccctgacatggatgaaaacaagatatgcttgggagataattctgttaactttgtcttcttttgggaggtgtggtggctaaatacttgaatgaaggttttatgatgggtggaaagagtaacaactttcttcatcctaactcaatgtcactcttcatgatgtactcagttattcccttttagaaattatcttaaacaagggtgagcaatggaatgtgagaaagatcaaagaaatgcagagcagactaagaaagatgaaacatctggattgcagagaagggtgacctttccctagaaaatatcaacactaaatctttacaaagccctgtccactgggttctagggagcgctgcaaatggactggtccctaagctctggcctgcttctccactcctgtgagacagttaacttttttcttttccttagctctgttcctcgccgtggggactctggataacaacagacaacaacagagcccgtggtagcagcagcgaaggagttaatatgcaccatgtgtctaagcccttttcattttacttctttgtaaatttttaacatatttatttaaaacataaacatcgatattctgattagttcgcaggaacaattattgtcattagggaagatggaaatttactagctattttcctcctttcatttttaaaaaaaaatatatatgtattacatttttttcttcaacttttattttaagttcaggcatacatatgcaggctgtgcaggtttgttgcacaggtaaatgtgtgccaaggggatttgctgcacagatcatcctatcttccaggtattaagcccagcatccattagctattcttcctgatgctctccctccccaccccaccctccgacaagccccactgtgtgtgagaacatgcggtgtttggttttcctattctgcgttagtttgctgaggataatggaagccctttccttaactcattaaatgggtaaatgtttgcccccacaagcccgcattcgtattttgaagccctaacccccagtgtagctgtatttggagatggggtctctaagaaagtaattaaggttaaatgaggtcataagggtggggccctgatccaatagaattattgcccttgtaagaagagacaccagagagctcactctgcctccgcatgcacacacagtgtgggccgtgtgtgcacacagcgagaaggtggccgtctgcaagccaggaacttgctggcactttgatctggaatgttccagtctccaaagctctgagaagatacatttctgttgtttaagccacccagtctgtggtgttttgttacagcagcctaagcagactgagacaggcagatactatcattcccatatgaaaattgaagagactgaatcatagaaaggggtcgcttgctgtattgctctgttgatttttccttctaatagttttgctttctacatttactgtaatgttcagttcatcaaggctcctgaccatgatggtttgttgtaaacttccccacttaacagtatcctctgcttcctttttcctcatttgacgtttttcactttgaattctcctttctccaatgttagcatctgaaaccctttgtgttgggcaggataggccaagtctgatgctgttacaaacattctgaagacccataggcctacagtgaccacagcttctctcttgggcacactggaggccattggcggtgtgcagggcctctgcttactgtagtctcagtccctgcccaatgggacgtggctctcatggcttctgctgtcagcacagactcattcactggctcttaacacttctgcccagaagtggcacagatggtggaaaggtgccaggtgggctcctctagccaatgtgagggcctttgtacaaaggagaaaaggggaaaaagagcccacccactggtgcagggctaggagagtagagggtgtcccttccctcagatgggtgcccccccaccctgcagcagggttgagggagcagaagcggggtcctgccctgttgcctggtggccgggcactcgctgcatgcagggcggagggataaggagcagagtcctgccctgttgcccagtggccgggcaatcactgcacgcagggtggagggagcaggagcagggtcacgccctgtcaccccgtggccggccactcactgcaggcaggtggagggagcaggagcagggtcacgccctgtcaccccgtggccggccactcactgcaggcaggtggagggagcaggggcagggtcacgccctgtcgccctgtggccggccactcactgcacgcagggttttgctgtctttatgtcttcagggcatttccatgagaagtggaggctgctgccaagacagcatttcaaaccattcttgaagcaggaaccacatctgcgtgtgaatttttccagaatctgggggaagaacttacttgtttcttcgatattctaaataatcagtacagcttccgacagcagtggcctccaaacctgaaatagaggcagtgtatgagtccacgagtctttttgcttggttttgccttgcttgctttacttggattctgacactccactcgcgtgtttccacattcaattccatttgaatgactttggtgcttctcagccagctgtggacccggcagccctgagccctagcccttcccctagcagccaactcagcacccgtgttctaaggacgcaggagtctagaaatagctgcgattcagagcatgttttcccgacaactgctgattctctcctgacaccctaatgctgctctttccctattttagggattgttctttgctgaaattatgtggcacacatcaaaagtgttctacaagtgtccggggtgttcattgtaatctggtataacaagatgcctcacggccaggtgccgttggctcctgcttgtaatcccagtgctttgggaggccaaggtgggaggatcccttgaggccaggagtttgagaccagcctggtcaacgtaatgagacccccatctctacaagaaaaaaaaaaaagataccgcagttcacgcagttcaggtatttgttccgtgaacttgggggagtcatataaactcaacttttctttgtctctcttgcctgtgatgagtaacagaaaccatcttcccagaaactatccccacccacccccagcccagcccgagcagcccagacccaggaaggaggtcagagcctgcgtgactgtgtggcaaggatccccctcaaagcaggcagtgatccccctcaaagcaggcagtgatgaccaggctccccaggggaaggaaaaatggttgattaccccacctcactttctcaagttcctgaaagcctcccatcttttcaggatgttttccttctgcttcctttctggggtgatattgcaatgcatgtgtcagtcccattgttctagctgccttgaaggagttccagaaacaggcatggctggtgtgagaggaggcgtccttgtcaccatcctttgttgcctcccatctgtggtcagcacggaggctgccctgggtcttggccggcccctggagctggaggaggtgctgggccatggtttggaagctcgcatggtcccagcctcagagccccgttctctgtgacctggctgggtcaaagcctggccccagaacagcccctccctccccacccacagctgtgcccagctacgaacactgtaggccgggcgcgatggctcacacctgtaatcccagcactttgggaggccagggcgggcagataacttgaggtcaggagttcaagaccaacctggccaacatagtgaaaccccatctctactaaaaacacaaaaaattagccaggcatagtggtgggtgcctgtaatcccagctactggggaggctgaggcgggagaattgcttgagcccaggacgtggaggctgcagtgagccaagattgtgccattgcactccagcctgggcaaccaagagagattctgtctcaaaaaaaaagaacactgtggtgtgagaggcaattgtgggtcagcctgagggcacacccaatataactttcacaggtgttttgtttttctgagaagaaggtgacttttcccggttgctgtccatgcagactgtgagggatgttcacatgtcacatttctcaccggagtcctcgtcccatcgcctcctctctccctgccgcggttcggaagctccacgggggccagtgttgttcaggcctcaccagtccttggtcatgccacccgggctgagttcatttacctgctcattcatgtattcacttttcctccgattcaacaaaaaaaaaaattgattaccccccggcatgtcctaatatactgcagccttcgaaagagatgtagtcctcatctgaaaggtcatcctttcaagtgtccatccatccactgggcagatttttacttagcacattccctgtgctggggacttccccgggcactggggacactgtagtgcacaaaccgaagtccccacgctctgtgaccctgaagataaactgctgagcagacagctctgtaacatgccaagtgttggaaagggctccagaggaaatagggtggagagaggaacaagaagggcaagtggggaggttgctgttttctgtggggtgccagaggagggctcctgggaaaggtgatgttcatggcagtgggaaagacagcaggtgcaacagtggagaaggatgccagcctgacctgtctgactctcagcatgggggctgttgtggctgagcagagagatccgaaggaagagtggggagaaatgagggaggggagacagctgggggcgagactccctggggctgtgtaggcagcagtaagacttggattttccccctagcaagaggggtggctattggacagctcagacagaaacctggctgctctggcctgtgttaagaggattcctcctcgcactgtgtggaggacagccctggatggccgggcaggttacgcactgcagaagccctgggagcacccttcacactgactcctgtgtgaatgaccatcacagcctgggcggggctggctgtaggagcagcagaccagcaggggcaagagcagaagccagagaccaggctggacgttggcacagtgaccgcaggagagaagaatgttgccagaccagagtggagccatgggctgcagaggtggagaagtatttgcattctgtatgccttctgcaagtagagcctgtggggtttgctgatggattgaatatgggatgggagagagagggagatcaaagatggtcccggggttttcccctgcatgaccaaagtggatgttgaggtttgacctgtgccagtgtgggaagctgggtaaatgtcgggttctggggggaaacctggttgcctctgctgggcactcggccctcaggcctccacatcctccttgaaatgcgtatcgggtcactctggggtatgggtttctgattaggggagttcagaggcttattcacagcccctaaggtatagactaaaattaatttatgtaacatgtatcatactctttaagttggaggttttaaaaatgaattttaatttaaaaattgtcaaacataccccaaattagagaggctagtacgaagaacacctatacatctgtcacccagattcaacaaggttttaccatattgctttacctggctctttctttctttttctgggtgtctttgctcacagtattttgaagcacattccaggtgcagggtcacctcgcttttcagtgtgcacatctaaagcagcactgtgttctcacacaaccacaatgctttcacatctaatcaaattcacttgaattccttggtatcatctaatatctaaaacataataaacttttttccaattatgtcaaaaagtgtcatattacaattggttggtttgaatcaggatctagagagtccacgcatcatgtctgggtgttctgcctcctacacctccttccatctgggaagctccctccctgccatgttgctgtggaaaccaaggcactggatcagtagagcaccctacagtctggctgcttgcttccctccagtgtcatttcacttgttcctctctcctctgtatttcctgtaagtgaaaattagctctaggacagtgctgttagaaatgtaatatgagccacatatgtaatttaaaattttatattagccacatttttaaaaagcgaaatgcataaaatctattttaataatatattttatgtaaattgatacatcaaaagagcatttcagcatgtaatcaatataaaaaattgttaatgagagatgttacactctttttattgcattaagcctttggaatctggcatgtactttgcacgggtagcctctcagctttagttcacaggctcgggcgctgcccgtggctgcattgggctgtgcagctccagcgtctccaccagattctggcgtaccttttgctcctaggtggtgctgtgtgcttcctgttgtgtggcactgggaggccctcagtggtcgtcccatgtttagtgaaaagtaggtgcaggtggtgacggcggatctttccatcataaacttgtccatcatgaaagcagtggcgcccccactctctggatggagaagactggagagaagtcagggaattaaaagccccaacttgcaccttacctttcaagttcctatttgacatccacagggaaaaataaactacacagttggatctgagtctggaattcaagatctgagctggagatataaatttgggagttgtcagtgtgtcaatgatgtgaacacggctggatgagatcaccaagggcaccagtgccagtgccgagaggtcacagagatgcagaaccagcaaagggagttggacattgtcccagaggccaagtgagatgagaagtgccaaatggatataaaggttacagcaaccttgatgagagctggttcagtggagtaatgcggtgagcacctggttgatgtaggttcaagagaggagattcctcaaaaaagtgaaatagaattaccatataatttggcagttgtacttctgagtgttcaccgaaaagacctaaaagcagtgtctcaaagaggtacttgtacagcagtgttcatagcagcatatacactagcaacaaactatccaaaaaagaaatcaagaaaacaatcttggctgggcacagtggctcacacctgtaatcccagcatttggggaggccaaggagagaggactgcctgatctcaggttgagaatgttgtgagccatgatcgtgccactgcactccagcctgggctacagagtgagaccctgttatgtggtttggccctgtgtccccacccaaatctcatgttgaattatgatctttgtgttgggggaggagcctgatgggaggtaattggatcatgggggcagatttctccctttctgttcttgtgatagtgagttctcccgagatctggttgtttaaaagtgtgtagcacttcccccttcactctctctctcctgccgccatgtgaaagtgcttgcttcccctttacccttccaccatgattgtaagtttcctgagacctccccagccatgcttcctgtatagcctgtggaactgtgaatcaattaaatctcttttcttcataaattacccagtcccaggtaactgtttatatcagtgtgagaacagagtaatacaccctgtctcaaaaaagaaaaataaagaaaagaatcccatttacaatagctacaaaaaaagcactttaggattaaatgtaaacaaggaggtgaaggatctgtacattaagaactacaaaacatgatgaaaaaaattgaaagagacacaaataaatgtgaagatatcccatgttcatggactggaagaattaatattgttaaaatgcccatgctacccaaagcaatctacagattcaatgcagtccctatcaaaactccaatgacattgctcacaaaaatagaaaaaataaaataaaatttgtaccaaatcagaaaagactcctaatagtcaaagcaatcttgagcaataagaacaaagctggagacatcacactacctgattccaaaatctaatgcaaagctgtaaccatcaaaacagcatggtactggcataaacagaaacaggtggaccagtggaagaatagcgagcccagaaataaatccacgcatttccagtcgattgttttttgacacagttgccaagatcacactatggggaaaggataatctcctcaataagtgatgttggggaaaactgtccacctgcagaagaatgaaattagaccctcatctcattccatataaaaaaatcaactcaaaatgtattaaagacttaaatgtaagacctgaaactataaaactagtaggagaaaacataaggcgaaagctccatgatattgttccaaaaacaatgatttttttggatatgactcaagagcacaggcaacaaaagaaaaaacagacaaacgggattgcactaaactaaaaagcctctgcacagcaatggaaacaacagagtaaaatgacaaactaacctacggaatgggagaaaatatttgtaaactgtgcatctgttaaggggttaatatccaaaataaacagtaaatataaacaaattaatagcaagaaaacaaataacctggttttaaaatggacaaaggacccaaataggcatttttcaaaagaagacatacaaatggccaatagatacgtgaaaaaaaaatgcttgacatcattaatcatcagggaaatgcaaattaaaaccacaataagatatcatctcacacctgttagaatggctatgatcaaaatgaaaagagataacaagtgtcacaggaaatgtggagaaaagggaaccatcgtacactgttggtgggaatgtaaatcagtacagccattgtagaaaacagtatggaaattcctcagaaaattaagaagaaaactactatatgatacagtgatcccacttctgggtatgtctccaaaggatatgaaatcagtatgttgaaaatattccttttttttttttttgagacagaatctcactctgtcactcaggctggagtgcaatggcgcaatctctgctcactgcaacctccgcctcacgggttcaagtgattctcctgcctcagcctcccgagtagctgggattacaggcacctgccagcacgcctggctactttttgtatttttagtagagatgggttttcaccatgttggccaggctggtttcgaactcctgacctccagtgatcccctgccttggcctcccaaagtgctgggattacaggcgtgagccaccactcccggcctgttgaaaatatatctacactcccacattccctgcagcactattcacaataaccaagatatggaatcaacctaagtgtctaacaacagatgaatagataaagaaaatgtggtatcgagacacaatggagtactcttcagccttcaacatgaaggagatcctgtcattttcaacagcatggaggaatctggaagacactatgatatgtcaaataaaccaggcacagaaagacgaataccacgtgatctcacttcttttttttttttttttttttttttttgagacggagtctcgctctgtcgcccaggctggagtgcagtggcgggatctaggctcactgtaagcttcgcctcccaggttcccaccattctcctgcctcagcctcccgagtagctgggactacaggcatgcatcaccatgcccagctaatttttgtattttttgtaaagttgggtttcaccgtgtttgccaggctggtctcaaattcctgacctcaaatgatctgcccacctcagcctcccaaagtgctgggattacagacatgagccactgcacccagccgtcactcatcttctaatggaaagaatttgcatttataaaagaaggattgacatttgtaatttttctaagaaatggaatttacagtgccaatatagatgactctcaaatctcacatcgctgagtgctaagtgaacttcctgttgctgtgaaagttagctacaaatctgtcatatttgaagtgagttagaaagcatgtggggaagattgactacatctcctgaatccactaaagctgatttgggtgctcgttttgtgattggatatatataggacatctttttaactccctaatatgatataaccaaaaccagttctctgtattctctgtagaaaacaacacgacaggccagtgttgactgaaacccaaccacatgaacaaaaagggcaaagcccaacgctgttaaccctcaatggagataattaaagacaaaacaagagaaatactgctttatttcttactaggctgctaatgaaaaagactcacaattccacaaacagggtggacatcgctttccagtttactcttatcttttgaaatgtgagttattggttcccagtttgagatttattcactgaatcaactgtcagtcttttcattggggttattttcattttgtttcattttgattttgaccttaacttctggaaactataattggggaataaaaggtaaggggtgtctcctgataggaattacatatgtaacgtaaatatatagatacatctatctatctatatgtaaggtggcaatgcatatatgtatttaaaaaactaaataaaacaaaaccaagattgtctaggcaaatcagtgctatgtatagaatttctctttggttatttgggattgtaatcttgtctttatgcaattcaggattacactgagaaaaattaaagaaaatgtcaaaagctattatactgggcaggggtagggcatgagtttaaagatatttgagtattttcaatatatccaaatcatatgtatgcatttgtttctgcccaatttgtgaaatatatggtttatcatgtctatctaaatacttgctgaggaaggtaagttaactagtatttactgagcaactgtataggtaggattttgtctcaatttccaagcagtggttcttggctgtggccctgagctctctcaagaacatggtgcctggtattcctgcgtgcacactgagcattgtctaggacagagcaccaaatattttatggaatatccatgtgactcacgtatgattattcataaattacacattaactaccacaatagaagttaattcattgtacaatataaacaaaagtaaatttaaagaggcaaaaaatataatcagaagagcatgcattttacttcagagaactagacaaaaattaaatgtgccttgtgtcagtatgtatttttactttttaaacatttgtaagtactatttgtgattaataaaatgcaactgctcctaaaaacattactgaatttatatgtcaatggaagttcactaatataatgtgacattctgtggaattttacaatgttacgaagataacataattcatgatagaaaaccactattctaagattttcatcttcatcaaagtaaacttacccatgaaggggcattttctgaagaagagcccccaaacccttgtttgcagtggtgggaaaaggctggcggtggtagggggcatccttgcaccattttggtttcagttacagtggagctgaggttggatgaagaatcacagaaacaggtcaagtgtgaggatgcacgtaccagccaggcaggggagcgaagacagaaatgggaaacaggagcaaaatgaaacagaaataaagagaggaaaataatttaacagtgagtagacaggcaaaggcaacatatgtaaaattggagtattctaagaggaaaacctaaataaatggaacaatgaatattttcacatatgaattaataaggcattccataaagaagagtcgaatctccaccatgccccagaaaacatagagatagtacagtcactactgaaacagtctaatcgtgttttcagatggccatgataaagaggttcttgagaagacaggcaaaaaacaacaacaacaacaacaaatcaagatcaaatgggaaaatatccaacctggcctcaatttctccgtggcaacattcactattagaagaaagttatggcaatgtctacaaagccttaaggaaagaaagcgtgacagaattgttcacgcttcaaactgtcattcaaaaataaaagaggagaaaaatatatttgtttatataggcatataattccctagaaggatatgtaaaaaaatgaaattccatttttaaaaaatgcaaggattcaggaatatcgtccccataattccttcttgaataaactattgaagacaatgtcttccacctgacattgttccatggaatcactgagatcctttatgaacctgtaggctcaagccacagcccatatgaattaaattagaagctcggtgatagcactgaattatcaatacttttttaaaccccaaggttcagaacgagtgcaaccaagagataagtgaaagaagtacacaagagaactggcaatgagcgttatttaactgtgggactaagacaagcatggaaatcctaaaaccaaggagaaccacctaaaaaactgtgacaaacagtacaaggatttaggaaggcagctgggtataagctactgcccagaaatcaatagcctccatatattcatgcaataaccagttagaagacagaatggaagaaaaggcttcatatcaatagctataaaatatataaaataccaaggaataaggttggcatgagtgcaatttatataaagaaatctttaaaacactactgagaaaccaaaactttcaacagcagaaatggcataccatgttcttggataagatgacttaacactataaaaatatcaaacctcaccaagtttatctacataatgcaggtcccaataaaaatattaatagaatttcttttggtaccagatagcctggttctaaaacttgtatggaaaaattaacaagcaataataaccaagaaattttttcaaaaagattagtagggggctgtgcattaatctgttttcatactactgtaaagaactgcccaagactgggtaatttataaaggaaagaggtttaattgactcacagttcagcatagctggagaggcctcaggaaacttaaaatcatggcagaagatgaaggggaaccaaggcaccttcttcacaaggcggcaggaaggaggagtgccgagtgaaggaggaagaaccccttataaaaccatcagatcttatgagaactcactcactatcaccagaacagcatgcggggaactgccctcctgtttcaattaccaccacctggtctctcctttgacatgcggagattatggggattatggagattacaatccaagatgagatttgggtggggacacaaagcctaaccatatcagtgtggttagcctgaaggtatgaaaatattataagtctgtaattaataaaactatatggtactagcacatctcatgaacaggcaggtcaatggtacaaaacggaaaatgcagaagtagatccaaataaatgatgaacttttctatacagtaaaaggggcatttcaaaccagtgggaaaagataagttattattattattattatatctttttttaatgagacagggtctcgttccctcacccaggctaaagtgcagtggtgccatcacagcttactgcagcctcagattcctgggctcaagcaatcctcctgccacagcctcccaagtagctggtgctacaggaacacaccactacactcggcaaatttttttttatttttagtagagatgatgtctccctatgttgcccaggcttgtctcaaactcctggcctcaagcaatcctcctgccccgacctcccaaagtgctgggattacaggcaagagccactgtgccaggcagaaaaggatatgttattaaagaacagtttggggacagagagcaaaccatgtggaatacactaagttaatgcttcatacctcataccaaaataaattacaagaaagtcaaaagctggcaaatggaaccacaaaacaacaagaagaaatcaatttttaccaaaaaaactatatataattttatatatatttatattatatatgtttataatatatttatataatgtatattatatatttttatatacatataaatatatatattttagagacagagtcttgctctgttgcctaggctagagtacagcggtgcgatcattgctcatcgctgcctcgctcctgggctcaaggggtccagccacctcagcttcccaagtagctgggactgcaggcatgtgccaccacgcccagctaattttccttttttgtagagatggggtctcactatcttacccagcctggtgtcaaactcctggcctcaagcaatcctctcccctcagcctcccaaagtgttggtattacaggcgtgagccaccgcaagtggccgagaagtttaagataatattggaaaatatttcgtgtaagttacaaatcccataagttaccccagaaaagatgtttagctttgtcttacatagacattaaaatatttataaaggcaaaagccaatgttaaggtcaaaaggcagcaaacagggaaaaaatataatatttgcaacttgtgtcactaaaactaattttcacaagaggaactctaaaaagttattaagaaggccaatgatacgcgagaaggcaaaagaaataaaatagtttgttaaaaacaaaaggaactacacatggctctaaaacagaaagaagtccaaacttcacacatattagaagtattcattaaaactactctaggttaccatctgcccaccccacgccccagcacactagcagggattaggagatggcttggcaactcactgcgtagtgtagatatggggacatagggacccctgtgctgatgagagagtccacagcagctatctccacagagtacagctggccagtgtaggtttggggacatagggacccccacagtgctgatgagagagtccacagcagctatctctgcagagtacagctggccagcatctgtccacttcaaaaggcacatgctgtttaacccggaagttctacctctgggaatttatcttgcacctctactcccatgatatgaaattccaagtcatttgctgcagtcttgcttgtagcagaaaaatgtggaaacaaacaaatttgtctgccataaaggactggtcaaacctgttgccatccatacaaggagtgccacgagctcctgtgcacctgtggaaggagctctgagctagattgtttagcaagaaaagcttcaacacacaagttcagtgaaaaaagcaagggcagaacagcgcacggtgctacatgtctgtggcagaaaaagggagaaaagcatgcgtttttgagtttatatattccatcaccttcaatatacagcgtcgggacacctgaccacctgcaggacccactgtcatcctgggagagggaggaggaagctctcggatctcctcttgtgaaagaggcgagattattgctcagcctggctccagaggcacgcagtccctgtgccccgagaaactaacatgccatctctgctctcccaccgcttcctgggttgggctgcggggagaggccttgctacagtgggtgcctcatcagcactgtgaacaaacagggaaggatatctggggccacgcagggagaccctgggggatcctgggcagaagcccctgaagtgattgagctgtttcctgggccctctgatgattctccctctgccttggaggcttggcttcccctggctgctgctaattctggaggacacagtggggtgggccacataatggaggctggactgtgtgtccagtccacccagatgccaccatgcctgccagtccctctcctccttagagcacaagccctctgatgctcccagacagtggaaactttttgttccccaaagccctccagctggccgggctgccctccccagactccctccttccttccagatgtgagcaaatccctttccttccacctcgctctcggcccctggttcaccttctgttcctgcccagggcaaactgccctatgtgcatctctgtcctcatccatgaaaccatccttgtcctcactgtcgatggaatttttcagtgatacctaacatctgtcccagagccatgcacgttccgaaagcacattccagggggacagttgtgtccctggtgcaacacgggagtgggcacacattctctgtgctgtgcatggggacagctccaggaagagagagggcactgttttcctgtttcctgagtcaatccgctgtagttctgtggcccagctgagtggcataggctctcctgacccaggtacctatcagcccccaaaataggtgttgccatgattcctttggacaaaatgtaaaatctggctgaagactgagtcctcgtgcacctagcgtgacccatgacagcatgcaggtgttggtctgtagggatgccataacaaagtgccacaaactgggtgacttaaaataacagaactgtattctctcacagttccggagaccggaagtccaaagtcgaggtattgggccaggtgggttccttctggaggctctgaggggaaggtgttccaggcgtctctccagcttctggtgctgctggcagccctcggccctctggcttgtagacacatcacaccaggctctgcctccgtctccacgtggccccctccctgggtatttgtgtctctgtgtgcaaatttctgtttccttataagaaagtcattgaatgagggcccaccctaatctagtacgacctcatcttaacttgattgtacacgcaaaaagcctatgtccaaataaggccccatccacgggttctgggtggacatgaacttttgggggatgttactgaacgcagtgcagggttcttacattctcaccatcacgtatatgattttattcttcagggtgctaaggtgtggtgtgtgccatgtgctcttaaccccttagaaaagataaggacaatttttttttcaggtccaatgtctgaatgtattttttttctttctcttaggatttgaagatatataacaatatgtcataaactgacctgaaatccttgtttgttccgcagcgaaatccattaataatccctataactgggacagttttatgttcccattctcggtgtggctatttatagtgaaacctcactttccctgtgttggttaacattaaaaactggaactgcttctgaggtaggaggcgggacttgactccagaggcggggcttggacactgggccagattgaggactagctaaaacaggcccggtggggaaagcagtcttcaatcagacacgcccaccagcgctatgtcaatttaccgttgccatgacggcacccaggcattaccgctcctttccacggcaatgacccagtgattactacctcttccttgcataaaccgctccttaatctgcatgcaattacaagtgagtataaacaggactgcaaaactgccctgaggtgctgctctctgcctgcggggtagccctgccctgcgggagccggcagggagctggaacactgacacttcagtaaagctgttttcttctacctatgacttgcccttgaattctttcctgagcaaggccaagaacccagatgggctaagctccactttagggctcgcctgccctgcatcagtttaactaaactattagaatttttagtttaaaagaaatgagtaagattgtgagcattctgtgagatgcggagtgaaagaaggtgctgtagtctgaacgtttgtgtctcccctaaattcatgtatagaaatcctaaccaccaagctgactgtattaggaggtgggagcttttaggaggtgattagggcatgagagtaaatgagattagtgcccttataaaacaaacccggggagttctttccccccccatcccgccatgtgaggacacaatgggaagggggccctcaccccttctatgaacaagaaagggggccctccccagacactgaatctgctggcaccttgatcttgggcttcacagcctctggaactgggggaagttaatttctgttgtttataagccacctagtctatgcccttctgctacagcagcctaaacagctcagccttaatggacgaggcacatggaatgacttccgggcctctgacagggtgcttggggaggatggtgtgatgttgcgttatcactcacagacactgtggaactgactgggttggtggagcggggacccggggaagagttcagttctgttctgggaatgttgccttgaggcagctgagcactacccacagggaaaggtctggcaaaggttcacgtgcattcgcctgggccataggggagaggggagccgtcagcggtcagggtggtcaaagccacatagttgcatgaggtctcctaagtaggtcagtggagcagagtacccagggtggagccccgggaacctcagaaacaaggaaggggtgagcagaggaagggtcgccctcagggcactgggagggaggagcagggtgaagggtgggggcagaggggaaacagccatgtccatgctgcagagagacccaagggagacccggggaagaatgtcacttgcaccttgcaaaagggagggtcctggcggcctcagccagagccgttttagtgaagtcatggggagaaggaccacagaggcttagtcctggctggggccgcagtgggactggcagtggagaggagggggcccaagccagggagattgagttcttggcaaagaggccggcggcgttctccactgcgtttccatccgcaggtgcgcctgccgcctggcctgtccacagtgtgctggttgctggtattcagttctggattgtacctctgactggactgaggtccatcagcaaatgacggggcctcggcggtgtggcagtgtgttcagctgctggcatgccgcctcgggaacagaaaagtcacgttgttgtgtatgcgggtaacagctccagggaggcgtgaagagaacttcctggcaaggagtgctgctccaagactgaatggactttttttgaagtgcaagggtctggcctctggaagggtgtttttgctgccacctttgaacttctctgtgagtttttaaattttgagcaaatcgccttttataatcattctatatgtactttttctacccaacggctgcatagtgttctcttcccacagctgatgtacttaagccccatccttctctggtataaagaacgttgcgatgaacatccactggcaatcatcttcctactcatctttgattgttgctagaagggaaattgctgggttcaaaggatgctgaccacttgttaagactcctggagcacccagatttccatccttcttaatctcgtgttccattacattgcagaatgtagtgacagccaagaatttccattcataaaactcaatgtagggttttctttggaagctaacaaatgacttcaggcttgtcatcagaccattgcactgtgctgactctgaagaatttgtaagttcttcacatcactttaagaatacttataattttacttattcatgaaagcatttaaataagcttcttactattaaataatttcttattgtgaaataaaccatttacttcattaacttatgttttttaaaatcaatgaaactaaaattctaaggttaaagaaaaaattctaaggttaaagtaaaatacaatagtaatttagcttaaaaaaagaaaaaatgctgattttcttatttactgatgtgaattctcaagatgtttttgtattacttattgaaataatgttaatttctgagcctgtgattttgaacaaaacatgtataattgaagtaatctataatctgtgaaacaggtatctcaatttttctcaaaggttttaattagaaagtcagggttggaatccactcttcacgtaagaatgagatggtttccagagataccaacaagccaacacatcttaatttgatgcctttttattatcagcaaaatatttaaaattggggttttattctgagtaacttatttcatgctatgaaactgccaaaaacaactacaaaaataaaatgaatttatgttctttataaaatgttattaatatgaaaaccggacactatgtgaaagcgatattgtgtttatgtagggagagtgtgttaacatttttttcagcatggctgagttggctgtttttgaatttgaaacttctgcagtctgggtagacagtgccacctccctgcagcaaacatgggcatcccttactgttctgaagaccctcaagctgcagtcaacactggggtcgtttgtggaaggattctttcttgctgtcttgatttgcaagaacacctctgaaggtctttgaatagtaaatgctgtttccatggcaactgcagtctggcttcagtgatcccttaacctgtgtgcctttggctcaaagcacccaggagctcacggccttccccaggggcgtccccctcggtcctgttcacaagcatggactctggcatggacggccccaccctggctgcaccaccgattgtccacatgacctcaagcaggttatttggcctttctgtgccttccttggaaaaatgggtctaatacgtgggcttgttttaagaattaataagagaactggcacacagcactcggcacagtgcctggcacatggaaagctcttgagtcgggctccatcccccaaatcgagcacctcagttgtctgtaaatgggcgcattggcagtcctgtgcagcaatgcaagatattcttggtttttggtttcttttaaattctttttaggtttcttttaaaatgatcagcagtctttgatgatttatgagcctgtgattttgaacaaaacatgtataactgaagtaatctataactgtgaaacacagggatcccaatttttctcaaaggttttaattagagtcagggttggaatccactcttcacctaagaatgagttgcttcccagaggtaccaacaagccaacatgtctttggtatgttattcttcttgctcctcttcttgggtgtggggattttcatctcttcctggagacagggaggccctgagaggtctcggtggtgacgggttgcaggcaagaggagtgaagcaaaccctgctggtactgcagaagccacacggagtgaagagacatgtccttgacgtcatagagtggagtgcgctttctttcttttgttctttcgttctttcattctttctctttctttctctctttctctctgtctctttctttctctttctctttctttctctttctttctttccctccctgccttcctgccttcttttttctttctttctttctttcttctctttctctcgctctgttcctttcttttttccctccctgccttcctgctttctttctttctttctttctttctttctttttctttctttctttctttcttgttaaatccatatcacaaagcattttcacagatagcttgtttctagttgttttttttttcactttaagttctgggataggtgtgaagaacatgcaggtttgttacataggtctacacgtgccacggtggtttgctgcacctgtcaacccatcatctagattttcagccccgcatgctttaggtatttgtcctaatgctctcccttcccttccccctgacctcctgacaggccctggtaagtgttgttcccctccctgtgaccatgtgctttcactgttcacctcccacttatgagtgagaacatgtggtgttctgttcaccattcactcagagaacatgttggttttctgttcgtgtgttagtttgctgagaattgtggcttccggcttcatccatgtccctgcaaaggacattaactcattcttttttatggttgcatagtattccatggtgtctatgtgccacattttctttatccagtctatcattgatgggcatttgggttgattccaagtctttgctattgtaaatagtgctgcagtaaacatacgtgtgcacatgtctttacagtagaatgatttataatcctttgggtatatacccagtaatgggattggtgggtcaaacggtatttctggttctagatccctgaggaatccccacactgtcttccacaatggttgaactaatttacactcccaccaacagtgtcaaagcatggagcacacgtttgttcattcattgaccgttccctgtgtgtggctttcatagtattcatttgggatcctgacgtgaaatggcctaaccagggtggagtggcagttgtgttcccggcacaggactggcccagcccccgagccctgtagcttccctaacaccattcactcaggctccgtcagcctctcccgggttcctgggcttctctgcttgttttcatgaggtttgcgcctttctcctatgccaatttacagtacaccctttagcagctgcagccacatttggctttacaacccctggatgccctcatgtcctgcccagacccttcttttgaactccacctgacaacttgacacccccctttccccaacactcttcatcaccctgccagcagctgctcctcctgcatttctcatccccccacctcagagctgcctgagccggggctcccccgagcttgttcccctcccctcctcggtgaaatcgtgaagctggctgaggcccctcccctcacatagtgacctcggcagcctcccagtccatctgcttccaagattggccccaccacacctgcatcttcatcttggtgtcctagtgatcctaggacatgccagccttgggattgaaaacagcagcctctctccccaggacaaggccccgtcacagctgtccctgtgcctgtcatcatggccccctgaaataaagtctgccttaccatcttcacaaaaggagaaagaaaacacaaccctcatgctatggttccccgccttaccatccttaatgactcccatagcttccgggatacattttaaagccatatgatggcaccaggggcctcttagccccctccttcctgcctctctcccatgggggtcttacactccagttgtaccgagctactgaagagcgtttcccatcattttccatccttccagcctcagttccccctcctccaggaagccctccctgacttcctcggctggggtaggaacattcacactagctgcttattatcctcacagcatttttcctgaggtttagcttacaagaagtctttctgttgaataaatgaagaaatcagcaacaagggtaattgttgctgaaagaaaatatttattatattaaacgtaatacatgtttattatagaaaaataataaggaaaattcaggcaatagtagaaaataaaaattatgcctcatacttgaccaagcacaatacctgttaacattttgtttatttttctccattcttttatctgtgacttttttttaacatagtctcaattatgtgtctctaaatagcgcatttttaaaatctcctttttttaaggaaagaaataagcgtaactcttgtatcaaatgctctgtaaaaatgttttaatggccacaaaatatggctttgaggatgcaccatcacgtcctcacttccgtattgctggacactgaggcttttgtgtttgtttactgcggtgaatagcattgcagtgaacatctttaagagtgaggtttttctacttcaaattatttccttaaattagaatattagaagtgcaatttaaaccccaaacctacaaacacggttaaggacctggagctttgctttcctgaaagggtgtatcagtttacacttgcatttgtgttgtctgagagtgtcttgttcatcacaggattaagtactgtgattatctcagctttgtaaatttgacagctaaaaactggcagctaactgattcttaggtatctcaagttctttttcaaatcgtcaaaacgtgtcttagagtgagtgttgatattttcttgctgatttgtggattgcttattaacctttttcatagttgttgcaaatattttttttcagtttagattaggaactgaatatcttcctcatgtctttaaagaaatatgcctgaccaggtgcttgataaccctaaacggagtttcctgccgggctttctcttgtatgatgttgaggccgtcacggtttgttgagcagaggagtgagtgctaaaagctggagttcagcagaaccacagtgatgcctccaccccgggtaaatgcttaaccacactcctccctgtaaaaataacggtgtcattaaacatggaccggctgttccatgagctcattcctaggaaacagtggctgagtagcagaagcctgaccggtctccatttccgcccaaatgtgggatgtgtgcacgtggcatagagcctcgcacgttgcttttgggagaatcagcttgagtcaacttctggcaaaagattggggccgtctttggacagatttgaatattagacaccatatcatctaatgaaaaccagctgggaagagtcagttttcctgtgttcttgggcatttgacaaatggtgggagatagttctaattttagaaaggaaaacgtaatgcatattctcatgatgatttgtcaactggatattttgcagagaggaaaacgtctgaaatgtcccaaataaagctatctgctgtcatgagaacacagctggcagggcagaaagcagtgtcgatcaacaggaggtcgtcctgcaccgggacgtcagtgccccgacacctcggtgtgtcccttggctgtgtggccttgggcaggtcactggtcaagcctgagataatgacattggtctgctggggagcagcggccctaggccagatgtactaggaggccccttcctggctgtgattttaagatggaggggaaaatgtttatttgttctgtgaaagccaggggtggggtaggacagagccagcaacaccgacagcccatcatgctgagccagaggtctgctgagctgaattgaagctgtgtcaactacagtacgtgcctcaccgagcctcagtttccacattggtgctgtgcagatgataatacagactttgcaaggctgttgagacttacctgcactaagacatagaaagtgcccaacacagcgcctgcagggccagcactcggtggcagtctaaggaatgtctgtcacagcgctcccagatggcaggtcctgcctgcctgggcccagctctggctgtgtggctcaggactatgggacctctgcaggctgcgtcccctgcctgcctcagtttctgcgtctaagctagaaagcatgattgttcctccccgtggggccgttacgagaagcaagcacatggaagcgtgccaggcattttccgaacgtctggaacatcctcagcggcagggtctcctcctccctctcctcctcctcacttagaaatattttccctgggagtcccacggaggtcgtgaagatgacagaggctgctggcactaacagctgtgtggggcagcccaagcccctactttgaaagttccattccatccctcgcatttcatctgaagagcgctatgttctccctggggagaactggcctgttgcatatgaagagtccagagattttgaacaagggaaccccttcagcttcgaatgaccattaccgttgatgatcccagaagttccctttccaagcagtgacccatggacttgtgtccctcgtgtgataacctgcactacacacatatcctacaagtgtccatagtggttataagctgccacagccatacagatctgagagccagaggccttcaaaccagctaaggctctgaaacacttcaactccacttaagaaaacaaatcggagcacatccgtgatcccacaaatgctaatttgcttgtcacacatcagaaacccaggaaggcacagaatagatgctctcttactggcttataggttgggtactttaaagttggagacgtttaaatcagagataaacctattgtaacaatacatttcatgtcatgtgagccttttgtcttccagcaactaaagggaactgtggtaggatgagctggggtcacagggacaaggaagacaggtaaggggacggaagccggggcagcaaggagtggctcaggagctctcaccctgcagtgggcagctcatcacccctgctccccgtgtctgtgtcccttcaggagaagctggccagggacagggccaccactcatagacagctcctcagcctactcagcactgctttatgtgtctgtgtgcacacacgtgtgcatgcctgtgtgtgtgcaggtgtgtgtgtgcctgcatgtgtgtgtgcacatgtgtgtgtgtgcctgcatgcatgtgtgtgtctgtgtattccttttgaaacatactagatgccctctctaagtaaatcacatttaactgctgtaactaacccgtctggcaacatcttttcttaatgctttttcactgttcaccgggttgagggtttcttttccttatttccacttctgcttctttaacgaaattatatgacttgatacagtatcattcttttcaaattcagtgtttcagtaaatagttcttttcagcagacaattacttaggcagaagtagtttaacatagcatttgtctctgaaaaaaatgttttttttcctttctgtctagatcctttaaaatatataatattgcatcatatacaatattggcctgtaccaagcacctgtatccagaaaagtaaaaaagctaactggcttaaaccacagcagaacctgccttgctgggtcaccttccttcagttccttctcatggtttctagaattccttgagcgcacacagcaagctagctctacaatcactttagagagtgaggatcgatgccccagcttcttgttttcttagtggctttttaaaaaatagtagacagtatatagctatctactggcaataggaatctcttaaaatcaaggtgagaaatgtagttcttttgcaagagagtcagagttttgtgttcaatgaaaatttaatatttgaaaaataaaagatcttaaaactattagttttccattatgatcagatggctctgtcaaaatggaaagaaagcagggaattttctgtactcctcaacacaaagtttatcttgttcctgaaaaaatattgaaccattttttcaatatttgtccttgccaggatttcaccctggcacccgctgttggtgtgttttaaatttggtttccttctgattcttctaagagaatatctactttatcatattttgaaataagactttacagtatccaaatgtggatgatatatccttttaactatgtccctgatattgaagctctgaacataacctctcaatttgagtcatctgtgtttccaggtattgctatagctaagccacaaaatactgaattttggcgtcttatatagatggttgcagtgtttccattcttcacgaagcatgagaaattcttttacaatacgatgaccgtgctccgtcgttttaggcgaagaacagacttaccacacactgtgctttctctcactttgtgagacagtgaaggagggaccttctcttcaggtgaaatgaaacccccacacggattagcctaacttcttcagctaagggctgggccttcttttattacaaataccgttgcatctttatacactgtttcagtgaaaaaaaaataaacatggcaattccctttccaaggctctaagtcaccaccaggcggcataacagacctctgtgtccctggtctgtaggagatgggacaatgcggggacagcgctgggagggcccgcaggcagcaggatgccagggcctcgccaggaagccatggtaggcgcccggggggagtctggacgtcaccccattctcaaggtgaagcctcgccagggtctcgccaagagagctgaggggtcagattcaccttctccctgcacctctgcacttccctctgggtttcctgtctgtacatccagtgccgcgcgtggcgtggggcgtggcgtggggtggttcctcacagttaccctcgctgggtgtgcggttgtctgacatcagtcctccccagaaagtgcggctgcccccggtcggtcgttctgtctgtagctggcgtggtatctggcacggcggaggccctgggtccgtgtttgtggatggaatgaatcaatgtgtgaatgaaggaagtcacattggcagcagtggcggggagggtaccgtttggggacaattcagatcattctgaggagacatgctgaggcctgctctaagacagcagctgtgggagggcacggagtggcattaagagaggaagctgactcgatgacgggcggagaggtgggcggaggctgtctcaggagcgccagcagctggcagtgagtggtgggcgtttcctgacactaaggctctgtgcagagcgcgtctacaaacactgtctattgtctcgtttcatcctcacaacaaccacccctatgaagttgtcactattattgtctctcctttacacatgagtctgggcacagggacttcaagtgaagcctgctaggaggcactgctgctgcccccgcgggaaggaaatgcagggaagggactcagggggcagcaggaattctgctttggatctgtcacatttgaggtgcctttggggcttccaggaagaggtgtccagacggcaggggctgaggcttggaggagtcaggattggaaatatgaactgggtgcccatcaacatctaggtcgtggtcaaagtgggtggtggggtattacaggaaagagctctgcagccccccagaatcctagcctgcgcccgcagatgagcaggggcaaggacgcaagggcagttgtgcattttccttcttttctgtggcattcagaaataggcaaaatgtgatacactgcaaaagtgactgtttgctatctgcaggagtggccatcagtgttagttaaatgagagctgtgcagaatggcatgtgtttgtcctcttattatttttgctttaaaaacctgttttaaaaccctggtatcaatggtcaattatgtgactttcaaaagcaaaaattaaggaagacaaaagaactgcatttgacaccttgaaaggcccagagggattcttaaccttgggtccaagaattcccccaggggcctttggatagatttccagagatccccgaaactgaataggaataaaagggtagcattaccttccattatgaatgcgggcaaaaaccttcggtagtattagaagtgtgacctcagcaccaatagaaaccacaggtatttctccgtcactttcgggttgttgctgagagctggggaaatggtttcatgcatcactgtcagtatttggtggaataaggacgtgcacgcacgtgctggctgttgaactgttgcctctccactgcaaaccctcccttccttgctgcagggccagagctgtgccctatcgggccctgcccccagagagagcctgggcagtgggaggagggagcccggagcacgctgcttcctgcctgcttcctgtttctgtgagcgtcaccccagcaacgggatttcaccctggctgcagttgttggttctgtttctagtgtttttcacacgcccagacaccaccctcaccagtccctcctgagcccccgctctgaggtccgggtccccactccaagccttctgggaccatcaccccggtctttgtctccagccctagctgttcctgagatgacgcctctgtggtatgaggcctcctttgctttttcggccaagcaacacctgtttaggggctgcctgtattgcttctattgaaatcactgctgtaatttctttttctcctgacttggctctgattgatacactatatcaggatttaaaaatattttttgacaatgtgtttcagaataatcagtttccttcgtaaccctatgtttcgttacatgcgtttaaaaatattattccaagaatgctccacaggcttcaccagcctgccagggggatccactataccaaaaaacagagagctgagagcagttgccagcctgattaattgccgtttcctgggctgggtttaaatgcctctaggaacacaaaacataaagggttttctttctgttcttcctccctttcttttcgaatgaagttatggaaggaaatgaactttgttattttccccctttaaaagtagtacctgctcatggaagaaaaaagaacactggaaaagaaaagtaaagaaaaaaatatctctatcttccttgtgacataaaaacacccatggctccattttgatgtatttccttagggccttaggtgttgtttatttttgcagagatataattgtcataatctttgtcataagcatttccaattctacttcatacttgtcttaaacactatttttatagctggacaggatgctgtaaagcagtaggttgacctggcccttttcttataatgtaaaactttgaccataattttattgtgataaaatatttctaagatttaccattttaaccatttttaggtgtaaagttcagtggttttaagtgcgctagtgtgtagccatcaccatcatccacttccaaaactttttcatcttcccaaactgaaattctgtacacattaaacactgactccccaaattcacagagctgaaggtggagtgggcattgctttccccagcccttggcaactcccatgcaactttctgtctccatgaatttgattaacgtaaatttttactactgagcttcgcttttccaataaaagttcaaggtacatagtttaaatgtacatactttaatgcaagcagtattgcatgacaccagcctgccttctttcgtcctttttaaaaaattagaccagaaactgttgttgaatcccatgttgccggtcctgatggttatctttctagtgagacccgaaaattcacgtggggacatgacagctttccattttcatgaattgcaaatgtggagggctcatggtagggagatggttttatttttgtgggttttgtttcgttttgttttttgagacagagactcgctctgtcacacaggctggagttcagtgacacgatctcggctcattgcaacctccgcctctccggttcaagggattcccgtgcctcagcctcctgagtagctggaattatagatgggcaacatacctggctaatttttgtatttttagtagagattgggtttcaccctgttggccaggctggtctcaaactcctggcctcaagtgatctgcccatctcagcctcccaaagtgctgggattacaggcgtgagccacagtgcccggcccaggagatggttttaaaacagagatgtgccctggttgccttctctgaaagtttctctccacacagatctcctgacctttggtgtggctgatttcacgtggagtctgttggattcgcaccatctggctcctgttttctggggaaactctgcgctggctttcgtcttcctccttttgtgattacataaacaaaagggtaaattgttttcttaaacgttagttttaaattgtgctaaaatacacataacaaagtttgccatcttaactatttttaagtgtacatttcagtgacatcaagtatactcaccctcttgtgcagccagcaccaccagccatccccagaacttcttcatcttgcagaactgaaactctgcccccattaaacgctgactccccattctcttctccatccagccctggcacccatcattctactttgtcttgatgaatagtatgaggtacctcatctagttggaatcatacagcatttgtccttttgtgactagctgatttcacttagcatgatgtcctcaaggttttctcacattttagcagatgacagcatttccttcctttttaattctgagttaaattccactatgtatctatactacattgtgtttctccattcagccatcagtggacacttgggttgcttctacctacaaaagaccaaattattttgtccatttaatataagttatttgaaggccaggcacagtagctcatatctataaccctagcactttgagaggtcaaggcaggaggatcgcttaaggccaggggtttgagaccagcctaggcaacatagcaagaatccaatctctacccaaaaaactaaaaactacataattaataaaatgtgaattatttgaagtttcagtgcagatcccttcttatcactgtattatctgatattatcgagccaccatgaaacctctagcacagcctacctgtggtaccgggaggccaccctcccagccacatcggggtctgcctgatttctgctttcctcactgcctgggtccctctgccttcccccagagacgaagatgctgcaagttagacttggagctctaatattgtattctaaatgtagggcatatattttaaataatcgtagagtgttagagctaaaaaggtttaatatgctttatattaaaaacatatttatcttgttaatactctgagtccattgcgtcacctcgggcggaccatttcccctttttctaaaacctacaccatgggagggtctctttgccaaaaaggagaagttcatgagcttccattgcctaatatcattctttggaggcacagtcatagctccttatctggctctcgaagttcaagtccagctgtctagatcataactttcaactaggaaatcaccgggtgccttaaaaaaataaccagcgcaaagttcaggcctcttgttctagaaaagtagtaaggttactcctactagagccacgggatgtagaattccagttactgttggggttgtgtgtgttttaacaggcacacctctttccctgcagcagggggtacacagcaggctgtgcagagtagggcaaggtagaagccctggggtatgcaggaaggtgggtggggaggggctggtgtgtcagggacaaatgtcagctcccacatcccttggtaaagtgtgactgggtacatcagatttagattaaattatcctgaaactatttttttttctttttttgagacagagtctcactctgtcacccaggctggaatgcagtggagtgaggtcagctcactgcaacttctgcttcccaggttcaagcaattctcctgcctcagcctcctgagtagctgggattataggcacctgccaccaagcccagctaatttttggatttttttagtagagacaaggtttcaccatgctggccaggctggtctcaaactcctgacctcaagtgatctgcctgccgtagcctccaaaagtgctgggattacaggtgtgagccacagcaccccgcccctcaaactattttgtagcttgcattatatagatcaaacaccttcattgcacttacatctctagtattgtatttacttaaataatgattatcaatagcaactcatttaatccttataaaccctgggaactgggtaccattatccctcccattttacagatgaggaaactgaaacacaaagagaggatatgtaacttgcccagcgctgaagactcccaccaggcacagcgcgcctagaatctgtgctccctgtcaccacagtagacaattgtactccagcatcaacaatgaaaatcacttttcactgacttaagtattattccttctccaagttgatcttccactggtctaacttagattctagcctttaggcaagagtatcttgttatgagacgtgtaatttgtttcctttcaggtgccttgcaacacaactctgtttatctcataagcagttttaaatgctatttaaattctgacaaggctgagtcctgtactgtgtgattacagagcaagcactaactcacaaagctactgtgtcctgattatttctctaattgtagagtaatttaaggaagaaggaatatatcagcaataaccgtaaaatgatgatgataatggcagttctgatgttcatacccaacaaagaaatcagcaatataactactgaaagggtgtagataaaatttgtaaatacttgcggattatgtgtatgtctaatccaaaaagtcagtctcaaactgagagttcagtaagatagtttgtaataacagaaacaaaaaaccaaagcattcctatatcctaccgtaatgatttttttttgagacggtgtatcgctcttgttgcccaggctagagtgcaatggcatgatctcggctcactgcaacctctgccaactgagttcaagtgattctcctgcctcagcctcccgagtagctgggattgcaggtatgcaccaccacgcccagctaattttgtatttttagtagagacagggtttcaccatgttggtcaggctggtctcaaactcctgacctcgggtgatccacccgcctcggcctcccaaagtgctgggattacaggcatgagccaccgcgcccagcctgattttttaaataatggaaaaaatgataaaatcccactcaatgttgcatgtaggaataaagaaaaatgcagggcctatatgaagaccataataatttactgaaggacatagtcagttgaaaaatgcagagagcaataccttgtctctgaacaagaaaactccacattaaaaagacacggatccatccccaaataaatgataaatacagttggccctttgtgtctgtgggttccacattcatggattcaacccatctcaaatcaaaaatatttgggaaaaaaaaaggctgggtgcagtggctggccaggcacagtggctcaggcctgcaatcccagcacttgggaaggccaagatgggagggtcgcttgaggccaggagttcaagaccagcctggtcaacacagtgaggccccattgcaataaataaataagaaaatatttggaaaaaaaatggatggttgcctctgtactgaacatgtacagacgtttttcttgtcattattctctaaacaatacagtctaacaactatttacatagcatttacattgtattaggtatgaacaggaacctagagatgattcaagtacacaggaggatatgcacaggttatgtgcaaatactccaccatttatgctcagagacttgagcatctccaattttggtatcccagtggttggaaggggtcctagaaccaatgccccttgaataccgagggacaactgcataatgcatttcaaataaaatctcagtttagaggggaaggttggttgaaagcttaacaaatagactctaggccagcgtggtgacacatgcctgtaatcccagcgctttgggagattgaggtgggcccatcacttgagcccaggagttggagaccaacctgggcaacatggtgaaaccccatctctataaaaatacaaaaattagccaggcaaggtggcacaggcctgtggtcccagctactccagaggctgagatgggaggatcacttgagcccaagaggtggaggctgtagtgagccatgatcacgccactgcactccaggctgggtagcacagtgagaccctgtgtcaaaaacaacaacaacaatgacaaaaagaaaaaaaacaaatagactcctgagttaatctggaagaataaatggagaggctggccaagaaatttttgaaaaaacataacaggggtagttttcaacttttttgtagcccacagcttctttattcaaacacaatctcacctccctgttcaaatactttcagtgggtcctttactgcttcctgaataaagtccaagttccttaacctgcgtactgtaaaaagagcattctgacaatatccaagggtgttcaaaaagcaatgtttacaactcccacagttctaccacttcggcagagcagccctgtgtttattctgcatgtccttctggtctttgcatgcctatgtcttttacacagtcctattcttttttttcttttttgagatggagtctcgttctgtgacccaggctggagtacagtggtgtgatcttggctcactgcaacctccgcctcctgggttcaagcgattctcccacctctgcctcctgagtagctggcattacaggcccatgctaccatgcctgtctaatttttgcatttttagtagagacggggtttcaccacattggccaggctgatcttgaactagtgaccgcaggtgatctgcctgcctcagcctcccaaagtactgggattacaggtgtgagccaccgtgcccggccgcagtcctattctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtcctattcttaattgtgttcatctgaggactaagaactccacaagcttggctttgggaatagcagtaaagcaacaacacagtgctgggctcgaagacggacagctgcctgaaagacggcagaagctccctgagtgtgccaaaagcactgatgaagttttaaacctagtccaagctaactgagtgatgctagaccttcccgcaacttctctaacctggatgtaaattgtaattctagagccccttgttttgcgggaaaaaaataatctgtgtatggtcaaatagcagatggaatgagctgccagacggaatcttttgccagtgcaacggaacaaagtacttgttcatgccaggctcaggtcccctgttacttgcagtcctccgggcagtcctgtctgctggctgtctctctccctgctttacgtaggaagctggaagaggtcaggggatttccttgaaattacaggctagtgaatggcagaacaggagctcgagcctgattatctgctaaacctctgctttggagctttgaggccttctgcacaggtcacttgcattctctgtgtaggggtgcagggttgttttctctcccatcggcttactcttggattgggccttcccagaggtgccgagaagcaaaacccagttctttgatcttctcacttcagctgttctttcttccagccaacttccaggattacatcccttggtgtgaccacaccacatctgaaatctcaactccccacttcccacccagtgacctgcacctcctgtctttcaatgctcctggcgctgactttcttgccgtccctgacaagcagccctgccttcaagttctcactggatgaaagaagaaggcaacagatgttagatgccgtgtgcacatattcccatcttgaccattctttctgtgcatgctttgctgtggaactgttggggccccatccagctgtataagctgagacatgaatgtgcttccacagtgtgggcacctcggatgcaggtacaggcccctctagatccagggccacttggcaatgtctgagatatttttggttgtaacagctggggtggagagcgctgccagcatctggtgggtggagccaggaacgcggctagccatcctgcaatgcacaggacagccgcccacgacaaggaactgtgcaaccccaaacgtcaggggaccctgctctttatcaatcctagggtttcccaaaaagcccgacagcacatttgatacagatgccaccaacggggtggagacaaggggcgagggcttcagtggaatctcagcaactaaaatcaagccgacggtcaggtcagagaagcatttggaaagcctccagtgcgtttaggggaccacgccctctcatcatgccaaggcagctgcccagtgaggtacagggtataaaggtgacgtggtcaggagtggctatttgatctccagttattccagaatttccactctcgtgccaagcatgtctctccaaatggctgctctctggcgttcctcacactccccctgaagttcatctaagatcttcattcttcaaaggtgaggcttgtatgttctatgtccaagtcttctctaaagatatccaatttgtacacatggagaacattttttgtactcgaatagttgatgactttgctttgagctatctctcaagggccaaagtgcaaaagggcaaacccttctattagagtgtgggtctatgtttttagtgttatgccgaagtgtgttttagcctttattttcctttatggaaattcattttcttggaaagatcattttggggatgctgttttaggatttctgtaccttcagctggaaggatgctcaccgttcctgatgttcatgtctgcccttcagtcagggagcctggaagccaagttgcttagtggcagtgctttacttttaagccttcgaatacatcttgagtaccttaaacttctctgtatgctatgggtactgtttaaattcagattatggagtcctattctccccacacttcttttttttgtgaatgacatttatcaatgacatttgtagcgtggtggattctgaagttttcagctagtagcgtaaagatttatttcatggctctgactgtcaggaatattctcttttctagaatgttaaactcataggcaggattactgaggcaaagccacataaatgagggaatctctggaaaaaatacattgcttttattttgtactaaaattgccattttttttttttttttggccaagtatagtggctcacacctgtaatcccagcactttgggaggccgaggcgggtagatctctcgaggccaggaattcaagaccagcctggccaacatggtgaaaccccatctctattaaaaatacaaaaaaaaagtagttgggtgtggtggcacacacctgtagtcccagctacttgggaggctgaagcaggagaatcacttgaacccaggaggcggaggctgcagtgagccgagatcacaccactgcacaccagcctaggctacagagcaagactatctcaaaaaaaacaaattgccattttctattcctaagtatatattgaagcatttgatttatttcttctcagtggggtatactgttagctggtgaatgcagttgttgaggatgaagcttatttccccatgtcagcatctattctgaacattttaaatgaactattctgagagcatgtatagattttttttttcttcacaggagagctgccttaggaggacttttcagagtttgtgcctgtaagactgagaaatacataatggattttagctgtcgtgtttttagaaggtaattggtagatatttgcagtgcattgtcttcatgaaaaacaaaattgggcctggtgcggtggctcagacctgtaattccaacactttgggaggccaaggttagtggattgcttgagcccaggagttcaagatcaccctgggcaacatgctgaaaccctgtctctgaaaaaaaaaaaaaaattagccaggcgtggtggtgcacacctgcaggcctagctacttgggaggctgagttgggaggatagcttgagacaaggttgcagtgagccaaggttgtatgtagtgagccaagattgtgccattgcactccaacctgacactcaacagtgtgagaccttgtctccctaccctcccccccccacacaaaaaaaccccaaaaatcagaagtggttttcttagagatgctttactggaggtgtttgtggccatttccttggctactgtgtatagaggaggttactgtggtcactctggtatggacttaaaaagcatcaattctgtggaacacactgggaaagcggatacatttaggattgctatagacttattcctagacactttttgagatgagtttaattccagagtaaaatacattagaaattattttaagtatgcctcagagtgtatcacaaaacaacatttaatggtgtaatgtaacgccatggaagggctctgagctcaggtacagtgcaccttgactgggacacatacagctctgaggcaggtccttcaatattgggtcctcctgctccttatcctccctcaactctgccatccactcttcctgcacaggaagctctgcatctagttatctgccctctcctggccactttggtgtcctcattcccatggagctcacaatcggatcaaatcctgagtcagtacaagatgccagtgcctgcagctcccctccccgctccccacacccagcctttggtcggcagcccctcaggccttgccccacccactccatcttttctcactgtcctttcagcctccagacaggctcacatctcttccatccttaaaaaccgacaaaccatgaataaatctcccccatgcaaagccttttccttggtcccgccttccttcaaggctgccgtctaccatttattacacatgcacaaatcacagaaaatgtttaattgccaaattttaatggcagaatgtaatgaccagtgtttttctagttgcaaattaaagtctttcctgaccttgctctcttcactctgtggcttccaggagatgtctctattttctgactctctaactaccccttctctgtcttgacttgttcttacacacctcttatccttcccatgtaagtgtctcaaggttccttccttcaggctcctttctgttctgtgcatgctgcctgattttatcatcacctttaactaatcggtagtgtgtgctgaggtgcctgttagactcctccactgaggctttctgcctccaattcaaattcagttcaatcaataatcaaacccatcaccttccttagaaaatctaaagagatttaaaaagcaaaaacaataaaagacctattagatgaaaaataagtgtgatgaattgctgggtgctaggtagttatgaaaaaatatcctaaagacatgtcatttttaaaagagtttctattcccaattgctacagaagtataaaatactgaagatcaatgagaattaatgacaattcatcaaagtcctccattttgttaggaaaaccattcatccatctatccatctacccacccatcatttataaggcacctaccatgttccaagcagtgagaacatgcttttaatcgggagagcccattcataacctgggggtgggggctgagggaggtggtgggagaggttcagtacccaggtcacagggcagctgtgggaaggctgcatgctgccatatgtaagcccggcactggagctgttgtggatgctggagacaagctcactgttgctttccagacgctcttgctcttctgtccaccggaggcagtcaggaccctggcctgagggccaagaatactttgtgcctgagctggaccagctggccgtggggtaccaccttctttgcagacagcaggcagggtctggatcccctgcttgatgctcctaccagtgcccctagtcttactgggagatccggctcctggcattgacctgggtgtgtgccctgctttgccagtgcccctggagtgggaggtgtggtcactggtccaccaggaagacagctaagggcattcgttgagtccacgtgatgactttctgctctgagtgaggcccctggatggctgggaggaaggaagcagctctgcgtcaggcggcgtgccgctggtgcattccatcatgatgtgctaagggctgaggagacctgggttgaaaacctagcttcgctcttccaatgtgcatctgtggacaagtgctataacctctgtgagcctcagtgtgtggataaagtctgttgtaaactgaaaggtgctgtgtaaatttcaagtgatcatttcatgagccacacgtataacagatgtgtttttagatattagtcaaagggatccaaataggccaggtgtggtggcttacacctgtaatcccagcactttgggagggtgaggcgggtggttcacttgaggtcaggagttcgagaccagcctggccaacatggtgaaaccccatctctactaaaaatacaaaactagctgggcgtggtggcgcacacctgtaatcccagctactcaggaggctaaggcaggagaattgcttgagcctgggaggcggaggctgcagtaagccaagatcatgccactgcactccagcatgggtaacagagcgagactccatctcaaaaaaaaaaaaaaaaaaaaagaggtgatccaaataaagcaataacatgaatgtaagctcatggtttgtagaagtaatttactgacatttattctgctgtcatgagtatggctagtgattcacgttcatgaaaaacagatgttagggctctgatttagaaaaatgacttcatgttagttatctgactaatggggaggctgagagccactgtgtcctccccgtctgccctcagccttgtgttgtcatccctgtaagggtttgtctctgtagccccaaaccacagtgggaggcgcagctagtgaaccttgcaacagactaacaccatggagacaaagtaaaccatgtttgggtgtggccccaaattggctaactgttctggcattttctggttagctatgattctgatgttcctagaacaaaattagaccatgctactggcctttcgttcttttctcaggagtctcctatacttctgagaatggatttttagatttcagacatgtaattttcattgagagggcacagaggaagacaaagttatatcacaggcctggcaacttttaaggatgccctctgaggcagtcagacaaaacccaaagtaccctctcagtgcagagattctgggcttaaccagtgatgtcgggaggtcagttctgtgtgtctacaggccattaactgcagtttggaaggggccataaattccaaggcacttgttagaaggggctgtccctggatcatccttaccaaaagaaggaggaagtcaagccctggtcactgacctctcagctctttagttaagaccctgggccccatgctggtatggtccagatggacccccttttttttttttttctttttttttttttttttgagacagagtctcactctgttgtccaggctagtagaatgcagtggcatgatctcagcttactgcaacctccacctcctgtgttcaagtgattctcatgcctctgcctcccaaatagctgagattacagatgtgcaccaccacacccagctaacttttgtatttttagtagagatggggttttgtcatgttggccaggctggtctcgaactcctgggctcaggtgatccaccctcctcggcctccccaagtgctgggattacaggtgtgggtcactgtgcctggccccagatgcaccctcttccgaggaaaccccccacccccctgctcagacctttccaaggtgccctcggggttttagttttgtcttcgaggtgtatgatttaacgttactctgccaagccatctttagagctgtgagtactgggatgaacattttgtgtatctccatgtttctataaaatgccacctttcagagccacacccacaccctgacttctgacccggccttcccatgcgtcaagtttgtgggttccagtcacccattcaccaccctcacaattgaccttgctctacgttgaaaaaaaaaaaaaagactgggggtgggagaggggactacctcagaagggggcttcaagaaggggactttaaagttacctgtattatttaggttggcgtaaaagtattgcatttttcgctgttaattttaatggaaaaactgcaattacttttgcaccatcctaataaaactgggaggcaactgtggatcctctgcattttattcctggggctctgggatctaaaaacaccaagaaagatgtattagcattcaacttacagtatagactttgctcttgagctggggatggttctgagacttccacctcacaggactggctgggctgaaacccaagtcagaatgtagcatcctctcatctagaagggtgtcaggatggcagttttctttaatatgctactacttagcagaatcagaaaccagccattattttattgctggtaatgttcatttgttcctgggactaagactcatcagctcgctgcttcttactctgtgagtgtcctggcatggtcccctccctgccacctacatcctctgcagcagccccttcccacagctgttgtggcaggcagtgggtttgttctctttcctgggctgcccacagtcttgctgcctggcccatcccagttcttggtctggtgcccagcttccttcctgctatggaggaggaggaggaggcctgggcaccttgagtcagggcacctaccaaggggactctatctggaaaagaggggactccagaggcagcaaggcaggtgctggtttgcttttactggactcccaggacactaggcagcaggctagcagggcagctcaccctgactgtgcccagcgggatccccgtgttagagcctttggtcctcaccctcacagcgggcactgtcattatcaccggcatgttttgggtaagactccaggcacagaagctaagtaacttgctcaatatcccttagtgagtggcagggccaggaactgaacgaggtggcttaattccagagcccacttcttaatcccttccctgtatggttttcagaagctggtaactagcaattgactggcagcctgggggttaggaaaatgtgtcttgtggcaattacaggtgtcttcaagcattgcctcagggacatgccaagggaacggaaaccagtcccagtaccctgctctgggagatgtggtcacagggttcggggtgttgagtagctttagaatctgcctatctagatcagaatattcaaaatcaagtctcagaagaagagggctgttttattaatgggttatcattctcatcagtgaagttgtgaccactggtaaaagtctaactgctttctacaataaattcccagagaacatttaaaattattttctccaaataattgcactttaaacaatcaagaattgtgataggccaggcgcggtggctcacacctgtaatcccagcactttcggaggccaaggcaggcagatcatttgaggtcaggagttcgaaaccaggctggctaacatggtgaaaccccgactctactaaaaatacaaaaatgagccgggcatggtggcaggtgcctgtaatcccacctactcgggaggctgaggcaggagaatcgctggaacccgggaggcagaggtcgcggtgagccgagatcgcgccattgcactccagcctgggcgacagagcgagactccatctcaaaaaaaaaaaaaagaaagaaagaaagaattgttataacaacatttaaataagcgttacagggagaaaacaagctattgaaaggtaggcatttcattatctttgaaagttgcttttgtgagcctgagatgctgtcaatcaaagacagcttggcctctgttcatcttaagttcaacgtttcttccccagcggttctctaggcctttgctcggcccctcttttccttctcccctatccctcccaagtcgtccttcggctcctcagcacccattttccctgctgcacaccctcctgacaactcctgccctgaagccctgggcccgggtcacggcgggaaggtgagtgctcacaggcgcgagctcacgttaccaagttgggtcagcgtgcagagaaaagggaattgggaattggagggctgtaaaatgtaaatgtgctttaaattttacatttcctggcgtggccaggacaggctgaccttccgattacaatccgcgtcatcccgtcgcttctgcccccagcctggcgaggtcgggaaccgtttcccgcaggactttcattgggagttacgagggcgccctgtgcctggaggtggcgcgggctggagccctcccggaggagaccggcgcctggcagggggtcgtcgcggccgcagcctggacggtgtggaccccgggttctgcgacgccagatcggccccagcggcccgcacccgcaccctgcaagctcgttctcccctgcgggccgccgcaccgggccaaggggggctgtgtgcacgcagctgcgtcgtcctggaagtcggcccttctcgggatgccgcgttagtggggtgcccggccggcaggtgcagcggtgctggggcctaggcttccgcgtccaggaagctcagcgtggcctgagggtgatggatgtgggggagccgggaactcataccctcgcccagccccgggcaggtccccccccggaggggaccccctcttcgggtcgacccctactgggcgcggcatcctccccggagcgcccgcttcccacggcccctgcgggtggagctgcggccggagcctgaggggtcttttcctccaggtcctctttccggcgggggccggaggggtggtgatggacagcccgggaggggcggggcaggaccaggaagatccttccgagacggagcgcggggggcggggcggggctcgcgttaagggagcgcggaagggcgggacaggccgtggggcggggcctgggtggggcggagccggtgggggtggggaaaggggcgtaaccgggagggaccctccgaggcggagcggcgcaggggggcggggaaggcgggtcatggggcgggggcggtggggcgagtcatggggcggggacggggcggggcgtagccgggagggcccctccgaggcggaactgcgtggggggcggggcgggccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggtaagaggaaagcgcttccgaaactttctttcgtgactgcggcggggtttcaggggcttccagctcgttccgaggtcaatggcaggcgcaggtgcccgggaggcgtggggtgggctctggcgggaccccagcgcggtgggagcgggcgcagtgggcgcgggtccgtgagtggcccggcgagcggcgtccctcatgcgctaggaagcacgctttattgtgggacgccacctccaaggacgaaaaggcacatggtctctccccgcccgaggtgatgggctgcagacaggctctgaccaggtctgcgcctggcctggagtcacagggagctgctagtttgctattttacaaaatacagcatcaaggaccgggtggccagagccggtgccctcacccgctgttggaaccaccggggagcggctggggtgctttggagcactcaacccgctcagcacctggggaccacctccgccgaggactccagacgccaaatccactttggctagtctcccgggtccgcccagcgcggacaggatcctgcctctaggattttgccgttgtccagctcaatatgcagtcgtggggctacggctgtagtttggcattaaaattgggcaggggatgaggcggagagggtttgcaaatacacattttcatgcagcttgtggttgaacatgaatgggaataaaagtgaaagggtgcactttggaaaagaaatataaaaccctagctttccacttaatcaggtgttcgtgggatcttggtaaaagtatgagccccaaacaatcactctttcatcaggtagaaattaatcatctactgggtgtgtgtgtaagatttaagatgaatcagactgccttgaccttgggagagcttattaggaaatgccagagagaggtgtagaagtagagtctgatgaactcatactgaaaagccagttctttgcttgtcagatggttgctgttttttaaatgtccattttagtgtggtttttctgtgacttcgtttaaaactctggcagtgggccagccctctggagccggtttttaccccttcaactaattagttcctaggggcctgggaagagagacccttgaatcaccatcagggaagggttcttgaaagaaggaagggtgggaatgtggttgagcggtgccagtgttctgaggagcagcctgggacaccatagatggcaggaggaggatggaggtgaagagctgcctgctggacttagagtccttggagaagggaagagtaaacattgagaacaggatgtgaggaaactagggacaggctaatcagaggagtaggtagaggcacacctggagcagctaaggcactggctacagggtctattacttaaggctgggagcctcctgggcgggtctgggttcagatgacttcgagatgctgccgggaggaagggagaggaaagtctggactgtgtccaactgagtagttatgtgatcagcccaggcccactgtccctcacccccagttccagaacccaataagctttgaagaccggaaggtttgtgttttgttttgtttttataagtttgtggcagaattttggcagtgagacttgccctgtccaatggggggctagttttggtcttcactgatccctctgagtgtgaattttcttacgtttctctgcagtcttgttgatgtctttgattaagggctgctactctgggttgtaccagaatatatggtgtatgcatcttactacgtttctaatgtccaaaaatgctgaattctgaatcatggccccaagggttttcagagagaagttgtgaacctgtaggagcttttcttggtaaatggtagcaaaaactgtatcagagtgagacatggtgaacaaaagcaaaatgcagttcctgttaagaggctaatgttcaggtagggaaggaaatgtgctgagtggtgatgggaattgggggtcatcatgggtggggggtagggcgtcacccagcggctgccctgggccatgggctgggtataggcacaggaaagtggttgtgggtgtttcacactggtttgtgccagttcttgctctgcattgtgtccgtgggttcagggatgggtctcctgcggaaaggagggactgggggccgcacccatgcagaggagagccgggttggtcagaggaagtagatttggcaagctccacctcaactagaagacaaaagcaggatctgagtgggagcctgggcttcttcagcaagtgggcaccagccctggagctgtaggagagggtccgatgcggacagtggagacactgtgcatttctgcagcttttgtaacttccctgtgtttgcgatggcttgtgtcaccccgctctctttccacatactgattagcattcagcccttctaaatgaccagcactgtcccaagaaagggctgttaggggagagcgtggacacacagtctcccaagtcccatctcattataggtacctgggccagggtccccaggtgtgggagagtggagtcttgaccaatatggggatgaatcagttggcacgaggcgggctggccctgctctagctcagtctgagatggtggagcgtggaatcatatggtgtgtgttttaggcatgtcatttccccgggcaggtaagacataaatatagtaaggtaggtcttttctagtagtattgagagtgtcctactggggcaaagatggagactaaatttccctttttctttaagagtcagtttctgttcagcctgagttaatatcccacagcggaagcctccttagcaaatttcaaaaaaccctgcagtctcaactgccacttatgctgagcacaggaaatcaagttatttatagttgcagaacggtgtttcagcgaagttgattggagagttacctgattatagtgagattcttatccaatccctacagaattgtgagactaaatgttggtgcagcatgtttggtcctcaaaaggcaatgtccaagaggaacttcttatccccgaaaaatcaggctgtgtgactcagcaaaggaattgtttatgactggttactcatatgccagtgcttccagaatatctgctcgtatttaaaggagtgatcttgaagccccagaggccataatgtttagattaccaacctcttcaccaatcagtaagtccattacatctcactacgtgttagacatgggacaggagaagaggatttttattacctcactgttattactggaggccgcccaaatttgttttttgttttttttttttaaataaagaagcttgttttcatggaatggacttactagaacttttattattcagactacctagataaaattaagtaaattcgtttctttctcccaaattaaatattttgactacatgcaagatttaatcattcaaaattgccatgtatttgattatagaccagtagtataatccccctgccccaggccagattccaaaacaataaaccaaaacacacacacacctggcaacagaaattatatgtattccgagactcattcattcattttggaaagggccagtgtttccagtggtttctccttgggattgtaactttacaactttaaaactaggtaagtagttttcccttgaatctaaagtataactactttgtagtagagaagtaatttatcttaaatcactataatgaagatttactcttaattttaaccaaaatgtttcatttatttgtgtaatgaagatgatcaaagcaacgccacctgtgatccttctgtcttttttactgtatgtggcacgtggctgtgtgattttcctagggaaaggagtgggctttccctgtgggttgagaacctctgtccccctcctctgaagtttccccagtttttcctgcttctctgctaggtgggtgccttagcatgcttgtcttctcatcgtgcttctaaacttctctgaaccggatttatactcttaggtcagtagctgtcaaagaagacactaagtagtgaaagtagctaatatttaccaaacccctgctgcgcccacctggtgttttatgtgaaggtcttctctaacccttgctgtaacctcatggggagcagatcgttttctctcagtttttcagataaagaggaaactgaggctcagaaaggtcagggactttccaagccctcacagctagtcagcagtggagccagttcagacccaggcctgctgactcggaactggtactgataactgtcaccactgtatgcaatgctgcaggcaggggctggcaggtagtaaatgtgcaagatatagctgtggctgccacggctgctgctgctgcttttgtcgctgttgtcagcttttcttggcagccctgctgtctcataccccagtattggggctgaaggatttctttttaccaaagctgcctcttaggacagaagtccttgtcttgaatgcatactgggaagtcttcactctgtcaaacttttctgttctctgcctggtaatttccagacagaagagaacattcaaagaacgaacttactttccttctttttttttattgagacagtcgtgcttgattgcccaggctggaatgcaatggcacaatctcagctcactgcaacctccgtttcccaggtgcaaccgattctcctgcctcagacctctgaagcagctgggactacaggtgcctgccacctcacccggctaatttttgtatttttagtagagatggggtttcaccacattggccggggtggtctcaaactcctgacctcaagtgatcctcccatctcggcctcccaaagtgctgggattacaggcatgagccaccacacccggcccaatgagctttacttttctacataaggaaaataatggtagaaatgaaatagctgtgaaacttgttttgctatttttgtaccatgctaaaatgttaactactgcttatgtcggcatacacctgagagctgctgtgatttaagcctttttatttttctgggtatgatgtaactcctcccctacctcatccaagtagataagttcatggaggataaacatgacagctgctgtttcttttatagctggttccagggaatatccactgaatataggaaagattgtcagttgctgtgtgctgccctggtgctggtggagctttcagccttcttctcagaggaaacaatttaaatgtttttgtgaaaccctagaggtctggggtttgtaggacagtcttgagcagagcaggcaaaggtgaagggagtggagcccagacgtgctgcctggagggaaacctgtcacctggagaggaaacggcacaggggaggcccagccgccctcgcctctcagtcccgcacgtctctgttagtggtagtcatggttcttgtatttccatcatgttgaggcaattgaaggaaatatgaagattcattcatctcaggaaaagcaagaaatgtattaacagcaagagtagaagttcacttgcatggaagatactgtatagcgtatttatttcttagcgccagtgggagtagctgctaagcccaagattgtgttgtgaggtttgaataggtcaatgtgtgagtcatcaataaagtaacatcaatcattttgttcccgattaatacgtttgctattttaggatgcgaaggactttaaagaagcttattattctgaaaagcaaagcctggagatttccagtagcaaaacagacacagtctgtggacaatctcagtgtacaaataattcacctctggcatgaacccaaagaatttcagaggggaaggaagctcttaaagattacgtcccctcctacttctttaatgagggctggggttcaaaaaccgagtaacttatccaggctcacataactgtaggtgacagagcccaagctggaggctgtggctgggtcttcagactcctttcttgacagtctgcacctgcataaactcagacctttactgagaacagtgcagccatagctgagagaagcagtcggcacccagcatttcttggacttgtctgccaggtcccccgagtgcagaggacagtgtgctggctcctggggcctgtgggcccggccaggagcagccttgtaagctaaagccttctttgaaggtggccgtcttaccgtaaactttcatggtaatttcagtctactccataatttgtctgagttaattttgatggaaacatagtgttttaagtaatcagttaggctttgatctctaactttatgccatccaaatcttcatgatggcctgagcaccaggcacccagacctgtgctctgaattgtgccggggctggttcatacagtgtgatggagagacgagagatccacactggagttctgaagctgtggttctcaaccctgtctttttacaagttccttaacttccttactagcctgaaatgaaatgcataggtgagaaagtcaaccagcgcacataatttcgagtcaatataacatttccttaaaaaataaaatacaggtagtttatagtaacataataagaattttgatatagaaatactcaagaccaagtacaccagcagttgaatgcagtgatgagacctgcacacacctgtgcctggcgtcacagggaggctgacacaggtgtgttgcactgagacccacacaccacccctcatgttgctgtctatgacgtgacattctacaaagttgactaactctcaggaaagttctgaacaaagccaagtatcatcatcttccttcaatttccatgtcgattgcattcctggaatagttcatgtatatttgaactgtgtaaaacatattttgagtttatatgtaagttgcaatcagtttgtaaatccaaaaattaaaaatagtggtttttcttttcttttttttttttttctttttttttgagatggaatttcgctctgtcgcccaggctggagtgcaatggtgagatctcggctcactacaacctccgcctcccgggttcaagtgattctcctgcctcagcctcctgagtagctgggattataggcatgcgccaccatgcccggctaattttgtatttttagtagagatgggatttcactatgttggtcagactggtcttgaactcctgacctcagatgatccgcctgcctcggcctcccaaagtgctgggattacaggcgtgagccaccgcacccggccaaaacagtggtttttctatcttcctgagcagtcaagggaaaagttcttcccatcgcaggcgtgtctgaatgcgggatggttggccgacctggccctgcccccccgccccaatacccttagcttcttcccaatctttttgacatcccagtccccccaacatttccaaaatgccctctaagtcaacacttccgccactgccagctgccaccccagagtgccctgtgcctggtaacgatcgttctcacagtcatggccgtagggaaggctctttgtggttcctgggggacttcgtgagattgcccacatgagcatttcttttggaactgagatacagtgcacatcgcctctgggggacatggggtggtgggtacacggaaccgaggtgagcctcccttgcgttgcggaggtgctagccttgtgccgtccgttcttgtccacgtctgtgcaggagaacatcacccggcccacttggttgctgtgaatagcaaactttagaggccactgcatctgagggttggggggtttgcagagaaaacaaaagttggtggctgtggctacttcctatagcaaagtggctcaggaaagggatcccgtgtcacagcctgggtacaccacggcccctccaggagcttgattccttcttagctcaggggaagaatcgcacaaggaccgaggcccctgcttgtctgtgaacaaactggcctttgtggccacttcaggcttcggctgcatcatattcctgtcacattcacgtgagtgaacttgaattacatccttaacacttttccaaaaaggttataaactagactggtgatgtatcatggggcctagaaaaataatgctgctgctttttcacttctctgcttgacgctaaaacctggaggcgaaaatgaatgtgtgtaattaataggagaacttcctcctgtttgcagagtgctttacagctggcaaacggcttctctccctgaacagccccgtggggcgtcatttccatctgacatctgaggagagctgctgttcatggtccagtcctctgtccattggcccactgggtgtccctaatatgcgctaacaggctcctggcaaacggcgggcatggcagccacgaatctgcacatgagctgtatgccctgggtctcccctgggctctgcggggggaggtgggagccgcctctggttcacatgcggtgctttccaggctgcagggccttctcagcctgggtggaaggagtgacgtcagagtatttctcaggaactgcctgccctaaagttgtggctcataaaccccttccagcttctgtgtagaattctggacccctagggtatcaccacagagtttaaaagcagagtaagaacatttcctgtgactgtagggtgagaggccctgggatctgtaattctacactaggctggaatcccagaaaagcttcaatgctcaggaaatgtatgagcagtgccaggatcccctgaaggagtgtggggcttttgaagcaagctgcccagcgagcctcccgcagcacctgctgtccctttgccagcagtcagggcccctgccccaccagtgttggttgtgtttctgttctttgaggagaccacatgatgatcttctggtaggagccacaagaaggatacaaatgccattagagctgctagagccccagacgtcactggaattggggttcagggtgttgggctgtccccacccttaggcagtactcccactgcctacaacacctccagcgcaggctgaggccatgcgaggatggaagcacatgtgggctaggccaggagggcgtgcgggagggctctccactctgcgctccgctggggtttctccttgtgtcctggtcaataacttcttctctctctggttctccttggcctgagcccccagcctgagccgggctgtccctgagttccctgacccggaagaagggacggccattatctttgggtgactgtcttcttatagctgggaatctctggggctctgagcgggaggcccatggggagccctggaagaacaggcatgggttagactgtttacctcactgccctgtgtgccctgccccggtagaagccgtttctgctgtgtggttctgtctagaactagagcccctcagggccctctgcatgccgtggggtccctttgcaaagcacctcctaacatgtgcttttatctgtggctcgggatggggatggtgacttcttcacgcagtcttctgcaggcctctccagcctggctcccgagatgtcacgcatgggtccatgcagcccagaaaagaccctgcagggggagaagggtcactttggtgcctatctccccagctggcctgtgggctgggtgcctggcagatggggctcccagggaggtgcccccatagacttgggctccacagcaggctgtggggctggcattaatgtggctgggagagcctggctgtctttttagccatttgtttcggaggccctgggggtcatacttgtgcttcctcgtgtatttttagatctcttatcaccgtacacaccacctccctatcagagggctgtcatattcacatatggtaaaataagacgcaacaatagaactcgagtcgtggttcggctttctaggattaggacaaggaggcaactttgatagtaaatggaatctttttttcccagccatccccaccctcaaagagtatcttgctgtaagacctagttcctgtaaaactctgtctgtggggtccctggccaggatgggtgggatcccagggaaagggccaggctgtgtgttctgaacaggaatggttctggaccaaccattgtgggcattcctgagaagccagggagcctggatcttgtcagaggagctcctccctctgctccatcctaaccccgcgggcagcagcaggaactgagagaggacacggtgggggcagcgctgcaaaacccagcagcgggccaccttccagcagcagaaagcatgagttttggttttggggctcttccatttccttccttcttttctttctttttaaatttttgctctttgttatgaaacagcagccagaccgagctatgcatgtcctgctgcacggcaggggcccttatcttgaacgactccacatactgggcaaggaggtggcagggggaggggcttgtgggaacccagatctgggatgggactcagccaacagtttaaagagccctgtgcccccactacccagcctcaacaattgttagcttatagccgtttacaccccacccaggttatttgaagacaagtcagagggagataatttcactgtactcctaaatgttttagtatctcagcaaagattgtatgggcagagaaaggaggcttcagggtgtaggaccccaggagcaggcaagggcttgctctttccctgttggctcctgtagggtggggacagaccagcccccatgaaccctagcgagggccatgccaagaagccgctgttctaatctaatcagtggaggatccagcaagctcggatgggagggaaagaatgactcaacctgcaggccgtctggggtatgcacagtctcgtctcctgagttctctgaagccctttgcagtttttgctttgtatcctaaactccacaggcccgaaccctggcactgagcttgatccgctgcagcccagcccgttcctgtccccatgctggaagcagcctgtcaactcacttccttggtttcctgttgctcttcccaccccatacctgctccccacatttctatcagagccctgtttctaaaacaaaagtcagattccgctgtgttcttaaaacccttcagtggttctgaattctttcaagacgaggttccagatacggaggctgagggcgagggtctgcaccccaggcgtctgcactccttgtcaccagctcctggtcgcagccaccccggctctgcttgtcctgtttcagggtccggcttagggctcctgtcctgcggatgccttccccagccccccggggttgggtcaagttctccagagcagcccccgcccctgccacacgtttcttcccccatgtggtcctcatcacatgtacattgtcaccaggtgctttgcctgtttccctggagactgggcacccaaaccacatttcagaaatccctcccactgtctcaagcagtgctgagacagcatggcacgttcacagcacagtgcattcctgtggcctccccgggccacggtcagcccacaggctactcacagaaagtgacaggccgtgttcagaagctcttcaagcagtctgacgtggctgtggcccgtcatgagattttatattttacaaaagtgtcagtcgataaaggatttgtcctgcgccaccggagcactggcctgaggtgccctgatccccgagaacccctgcctgcacagtcagcgctctccccaatgtctgccatctgccgtgccctgtcaggctgctgtgccattcttcgcagtgtctctggggaagaattttgtcgaaactctgcagatgttcttttttttttttttttttcaaggcagagtctcgctctgttgcccaggctggagtgcagtggtgcaatcttggctcaccgcaacctccacctcccaggttcacgtaattcttctgcctcagcctcccgagtagctgggattacaggtgcccaccaccacgcccagctaattttttgtatttttagtagagacagggtttcaccatgttggccaggctggtctcaatctcccgacctcaggtgatccgcccacctcagtcccccaaagtgctgggattacaggtgtgaaccaccgcgcctggccaactctacggattttctctcaggcatcttaagcaagtggcaagagttattctgtggctaagtgtgtagttttgtgttcgtgaagatggtcatgcataggttttgtgccagtttaaatgctggctcatatatttgttggtgttgagttaggcagattccaagaattgcctgtaagctaagttgccacttccggtattgccagcactttgttttccacatatgagtcatgtgaggatcgtaaggggggtagatgttctagaaggcaggggctgcaaggatttggaattgtattcagtgacaaatggacttctttctgaattctaatgtaaggtggagatcgccatagttgacctgtcttggaggtgggcttgcgtgtgtccccatgaggaattgatgccctaacatgattcatccatggggttcctttatcagcccaagcccatgtgcctcccagcaaaggtcattgttttttagtctttaaatgtcattatccccaagtgagggacagggtaaacctgttaggctgaaggtgggccatgatgggaaccttttcctgggtggagggcagacccccgagagcagcggggtctgacagggcattgttttggaggcctgcaagtctggagcaggtgcaatactgcacgctcaggcaggcgagctctgcaaggacctttggccagacccgagcagagctaagctggaatagggtggggtactgagcaggcaggcggggaagtgggtgggcgtgcaggtgcctgggacccccctcagctcacagagatactcgccctgtgagagcaggagtcacctcagacctcctctccttctgttatctgctagtgtgtaataaatatccacaattcagcggcttagaataacacacagttatgatctcacagtttctgtggtcaggagtctgggcacattggccaagcgcagtggctcatgctggtaatcccagcactttgggaggctgaggcaggtgagtggcatgaacccaggagttcgagaccagcctgggcaacacggcaaaaccctgtctgtacaaaaaaatacaaaaattagctgggtgtggtggcacctgccctgtagtgccagctacttgggaggccgaggtgggagaatcacttgaacctgggaggcagaggttacaatgagctgtgatcacgccactgcactccagcctgggcgacagagggagaccctgtctccaaaaaaaaaaaaagagcctggactcagcctctctgggtcctgtgctcaggtctcacaaggctgcaaccaaggtgtcggccagtctggggtctttctggagttcaggcccctcttctgagccacgtgtttgttggaagaattcagttccttgtggttgtaggactgtggtcactgttcctgctggcgtcagtcagccaggggctgctctcagctcatcgaggccccctcccactgggcagcttgctttctcaaagccagcaaggacactgacttctagaccctcttttaaagggcttgcctgattagggcaggcccataggataatctgtcttttgagcaaggcagtcaactgacgaaggattttaattatttttttaatactttttgccatgtaatacagcctaattacagtggtgtcatccattatgtccatggtcccacgcactcagtgggagaggggtatgcagggcaggtacactagtggtgggagtcttggggaccaacccagaattccacgttcccacacagtgggagaggggtatgcagggcgtgtacaccagagtcttggggaccaacccagaatttggccgactgcagttgtctctccctctgttcccttctggtggcccttctttcccccaaccctttcctctttcttacatctcacccctctgctcctcttcttcttcttgcatggcctcccttctcttttcccggcccctcctctctgttcctctgccccccaacccccaagctggtgggctatggctgctatgaaacctcgtacctgctctgtactggcttagaaactgagccaatggcacagagccacctgccttaccaggaagggctgcacttggcgtggccttggtcactttgctggcccattggtagggccgtaggacgtcactctaatgcctttccttctctgtctcctccctctttgcttttgtgtagacccaagagtcctttcttttgtttgagacagggtctcactctgtcacccaggctggagtgcagtggcacaatcacagctcactacagcctcaacttcccaggctccagtgatcctcccacctcagcctcccaagtagctgggaccacaggtgtgtgctaccacacctggctagtttttgtattgttggtagacacagggttttaccatgttacccaggctggtctcgaactcttgacctcaagagatcctacctgccaccgccttccaaagtgctgggattccaggcctgagccaccatgcctagcctggccccaagaggcccttcacaccatgtaatatggtcttggaaattgaaaatggcaacaaggtatcaaaatcctgatgcagttgtgatttttgacaccccttgatttgaaagacatggggtgggttgataaaggagccaagcgaatagaacaaattcctcatgaggacacaaccaggcaacctcaagacgacagatcaagtgtggccagtttgcaacttagattaaaactgagaaagaaggtacatttgtaatatagtgtaagtctaggatgggagagagggacgtccctgtcaggaccacccccatgccaggagcttgctggccacctcggaagtcccattttaatattatctaggagccggttgtggtggtgcaaacctgtagtcccagctactcaggaggctgaggcaggagggttgctagagctcaggagttcctggctgcagtgagctgtgatcacacctgtgaatacacacacacactgcacttcagcctgggcaacagaacaagacctcatccccaaaggaaaaagaaaaaaaaaaaaaaggaagaaaaaaaggaaaagattatgtaagacgtctgaaaactgtttatagaaccattgttggaaggattacagacgtattctcaaaaaacacttcagtagaaagagggtggggtttgtttgataccagaaaacctgcactcagtaacacttatgccatcgagcttacggggctgtggtatcacatgaagcagtgaatacgcatgcagtttttaaaatgacttgtaagttgtttgtagaaacagttcagatgccaggctcgatagcatcatgtccattcctgctcaagcatttgaaacgttctcacggagcagaatgtggcagaacagctacaagctgaaaaatacttatatggaggctgatttttttagtgcaaggaaggactccaacagctagaaccgttctgctatgatcttcattgtgttgggaaaaggtggactcccagcacggctgtgttttaaggggaagctgagggtgcgtgtgtgctgagaagtgactggacagcagttcgctgggattacagtcccagctccacgccagccagccctatggcctcagatgggtctggcagcctctccaggccttcactttctgctctgtaaagcgaggggttgaactggaaacctggagtagcatccagctgttaacactctgctccatgcatctgtcagagctccagaaggaggctgactgcccagccctgccacctacaggctgtgtgaccttaggcaagttacttaccctctctgtgccttcgttccctcatatttaaactggggatggtaacagtctcggcctaatgaggctgttgcaaggaatacatggcatcatatccataaagctcttagaatattcctgcctagcatgtggtaaggacttgataaatggtagcagttcttataactatttctattgctcctgaccacccttttactctatgaatctggaatttattgctgtatatctgttaaactctgaacaagattttctttccgcatcatcactgctgaccctgtactgggaaggtgcccgctgctctgtcctctaataagatgccctgtccgtttcaggcggaagcccggctcgctgcaaaacgggcggcccgcgcggaggctcgcgagatccgcatgaaggagctggagcggcagcagaaggaggtaacgcttggggctccttgttgggtcttttcacagtgatttgcgtgctgggcccagggtgcaagtgcaggcacctgttgctgcagacgcacctggctgtctcacgttgctcacggtcagagtgcgtttgcgcctgtgacttctgcccaaggtcaggccaggagtgcgcatagcacggataccaggcgtgcctgctcagacctgctggctcctgagaggggcttagaagcctcttgcctgcgcagatcgtcgtttctagctgcgaggagccaaaatgttcagggtctgagctttaaggtctaactgttgtactagaatctagatcctctggattaaagtggaaaagaagaacggattaatgagtttttaaactggccaaattgttttatttaaaaatatgtcccccgtggtttgtacagtgttgatcacacacgggctccaggtttcaggatatctagagcccgtgtgtgatagagagacgggaatgaacacatggatgaaacagccaggaagaaattcctccctgggaaaatggctagcaatgtgttgacacacctgctcaagccatttgcaagttattttcatcatcttgagctggagctaggagtcatttctgacagcataagggttctttaactcacagttatggtgtgactttttctgtgacctcagagacatagaagctgagacccccactcagtccatgttctcccgtgggccatgccctgtggggccaagggaccatccacactgagcccacccccaagagcttttcttcttaagaagatgtgaatttattttgttagacagaagtaaccagctgccttccccagggttgattttaatacacaggttgttgtttggcttacatagccaaatttaaaaaggcgagccagtgtttaaaaccagtgagatttcggataaaaatctgaatttccagattctcttatggtggttgtagattccgccacattcccagcaaagaccaagctggccacataccctgcagggtcagggccctgccacaggtctaatgtgctcattgccctccgctgctaggagtttgccgctccatgtagaaacctgcatgcagaggctaggcagtgtcaccaagccctggaaccatcctgcacactcaagctctggtatccatagtggtgccagaggccactagaaggaatagtgcttttattctgaactggtttttaaatatgtatatgtataatttttttttttttttgagatcaagtcttgctctatcgcccaggctggagtacagtgacatgatctctactcactgcaacctccacctcccagattcaagcgattatcatgcctcagcctcccaagtagctgggattataggtgcgcaccaccatgcctggctaatttttgtatttttaatagagacggggtttcaccatgttggccagactggtctgaaactcctgatctcaagtgatcctcccgccttgacctcctggcctcccaaagtgctaggattacaggcatcagccaccacacctggcttaaatatatgtattttaaatgacaaaatctcaggtgctttttcacactgcccagtatcagtgtctctgtagaatgtgtctgttcatacagacacatttagataaaaacgtattgattgtatccttttttttttctttttttgagacagaatcttgctttgtcgcccaggctggagtgcagtggcatgatcttggctcactgcaacctccctctcctgggttcaagcgattctcctgcctcagcctcctgagtagctgggactacaggtacccgccaccatgcccggctaatttttttgtcatttttagtagagatggggtttcaccgtgttagccaggatggtctccaactcctgacctcgggtgattcccccgtttcagcctcccaaagtgttgggactacaggtgttagccatcacaccggccccatattagaattgatttaaatatatacatattgatataagatataaccaattagaattgatttaaacatatacatattgatataagcagcttgttacaaagttgttgggcaaaagttcttgatttaaaaataactaagatgaattaaggcaagcagtcatcgatttgaatggccccctttaaaagcaaagcatccctttattcctttgattgaaaggaagcccttttctgttgcattttaattgtgcagtttaagaaccatctgttgctggactcccacgtctctgttgtaatattcccagccacacgaaaagaaaaataaaaaataagccaggcgtggtggcatgcacctgtagtcccagctactcaggacactgaggcaggagcattgcttgagcccaggagcctgaagcaatgatcgggccatgattgtccctgtgtgtagccactgcactccagctggggcaacataatgagacccctatctctttcaaaaagtaaaaaaataaaaagtagttgctactccagatgggaaaccaagtcttgggcatttaattttagtatcatgaaaaaggggtgcagggcagccctcactgatgcttctgatgagcacaggccttgcggagaacatctgatgaaatcgggaagtctcacgtaaaacgccatggtttgccttcttcagcatgagtacagatgtcatttgcttagtagatggcattcacattttgaaattcttctccctacagcatggttttatcataaagatatttcaggggtcacaggggtcaagatatctcgccctgttgcaaattcggcggaacatccgccactgagagcggtggttttggtctgtgctctcaccagcagggaccggaggagggggtggtgtcccttgcaggcagcacctttggccaacgtcaccttttgcacggtcctctgtggatctgcagtctcggcttcctcatcaccgatgcctgcacttcttccctcacgaccgtggcttgcggctgtgacacagggcgggcgtcgtgggcgcggctgtggactcctgcctggggttggtcacggaccaggagccagagccacccaaatttaccaggttgtggaatgagagcctgggaaggtgggggacatgtcaggaggggcagagaaatgaacgtggccaagatggtgagtgaggacaccgagtgaagcagctctaccggggggtggggaagccactccttgtggcagcagaggatggacatggcagacaggaagctgccctgggagacgagagccagacgaggaagggccagcccagtcagcccagcgcagcacgcgttcctaacggcggcaacggtgccttcatgaatttcgggtctttgcaaggcggcagcattcctgtttaaagtttatgtctgcttcttcaaaagagggatcgaaagatcttaaataagatagatgtgtatttcgtgactagtcagagaagcctggggcggggggacatcccagagctcctgccgtgtggcagagctgggcttggtgctgtcacctaccactggtgacgggcatcttcccaaactttacaggtgaggaaaacaggccttagggagatacacagttttccccaaatccaagaaaatagccaagccaagattcaaatcagatttgaccagatacaaagcctgtggtcttcctagctcacccctctgtctcaaaatcagttctgtaccaacaataaaaacaagagtggaggagggagtgaatccgtgggccatggggttgaagttcacattgaggacgctggcacgcacagcaaagggggaaacagaatgatccacataatcctagtcactttccaagtggaagcatgccttgaaaaataaagttctccttggtgtggaatttgaggcacaggaatatgaaacataaaatatacaattttcttagaattttctataaatacagaatgagtagctttcacctagctgtgcttttatgtgacccaaagggtggggcagaggccaggaggaatgtactcgtgtgtgcgcacgcattcgtgtgtgtgcgtgtgcatgtgtgtgtgcatgtgtgtgcatgtgcgctcacacacgtgagcatctgtgtatgcatccagagggaagagtgagtcgagctagtggggtctgagcttgcacgtcttcgggccatgcctggaggatttgggaaggtgcactgacgacacctccctcacgctcttctttgcatatcacatctctgggcctggctattattagaaccagctaacataatttgaggttatacaatctggtagcttggggcactggcattttaagttgttgattaaggggaaatgaatacgttttggaagaccagtgtttaaagggtagggttgatactttggtgtaaaaattgagaaacctgatccctgttttcatcggggtcacaagccatcccacctgcatgcaggcgtttctgagcaggctcagggttttcttgagggggccgctctgagaacaccgagaagggcaggaagctgaccggggttggtatcccccaaggaaagcatggagcgtgtacggagaggggaggtggcgaggagacaccagtgtcgggggcagccctgtccccacagcattatcagactccaggccagctctagcccaccctgagctctctttcttgaatggttcttttcagcacacagacggcgagaacccactacagcttactctagctgcgttccggggtctgtttaaaaggatatgagctcttttttaatggatttgttaggggagaataatgtacatattcttgggaaattcaagtgaaccttgaacttcttagggagaacctacactgatagaagaaaatggtgatcatttctcttttcttgctgctgacttgataaacattttggttagagatgctttgtttcttacagtcatattgttggatgtagtcacatgtgttcccccatataagactagaaatgccaacttcttggtctcgcagttttggcagtgccttcaataatgcctgatatgacaaatgtcttaatgaatgaatgaatgaatgaatgaaaatgagtagctatctcagttttatctagtgattactacaaaattaaaagaaacctctgaagcaaacgaatatgtcaatgtatgataataacctcttttaggaatatttctgttatattctaatgatcactccatttagctggaattttcctgttattctgtgtgtgtctgtgtgaatcagaacatcaaagcctctttcttcattatttgtgaatttgaccagttaactttccaattaagtttctgtactttttgattaaacttttattaccgcaaaaagaaattctgaattaaagatgaaggaagtactttttctcattgatggcaataggttatacagacttctgtattagaataatagcagtatttttggtaagattcgtgtggctatgcccctatttccccaatgtatctaaaatgaaatgtaaagtaagtgataaaattacaaactcttgtcagtgggacctcacctgttttcttattcacattttactgtattcgttgtgacttgattcatatgtctagttacttacagaacctttcattctgatgttactgcttctttaattggattttacatttcttttttcttctgtccttctctatagatctatcaggtccaaaaggtaggctcttctttctttattttctaacttgcatgtactgttttttccttgccaagggcctggtcacctttcagaaataacaccttgcactgaagatacatagaagttcttactgtttattttactactttgtgtatgaatttgtttgaacaagaatgcctagatcctcatcttgccccactcaaagcaacagtcagacacatttctgtgtactgaatgcttttgtcatctgcattttcctcaagaaatgtaaaaattgtttctttgagaagaaaagtaattctaaggcaaaattatatttcagaatgtggatagccttctgaaattatgtatggaaagaaaaagatgattttattagaaaacttaaaaaattccatacaaattaccacacattgagagattattagatattgagttaaaaatctgagtaaaaggacagtgatgatataaaatgaacctgccattcatccctaatgctcagagatcataaaatgacgtgcctctctgtttcctagtattttgtagaagcagctgaggtttagaagtaaatacactgggcaggccagatacagaaaataaagacaagcaagtcagtgattcaagatctagcaaaaatgaagtcagaagtgagcgagttccttgagaatttatagaatttgtatacacgggagtctttcccataaatgaatttagtttgatacttaaaacatctgtgatagtttccttttataaatttagtttctagacaacaactgtatttttctcttagagcagatgagaaaatcagaataagatcacttaatttcggaggttagagcacacaggcctcggaatgcacgggcagtaaatttaagagcctgttgtgttggattcctgtgctggccatgatgacgaatcgccttccctgctggagccctgcactctgcatagctgctgtcccgaagagtgcaaagaaatttgttaagtagatgccagaatctcttgtgcttgactagtgtttccagggcccaagtgtagaaatggatattgcagctggagttcctggtcgtcctcagagagcctcgggaagaactggacaggtgcaaggccaggcggggagccctccctgtaactgacagcaggacgctctcatccaaaacctggaagaggggctctatctggtcgtttccacttgcattcatgcctttcttgtgctaggtcacattattttctttttactaacgtgccagggatacattgtgagaactttgtcagaatgtgaatttgtgtagaatgtgaagctagaaggagccccggaaacctgcagtggaggagcagaggcacagttttgtagtaaaggtgtgcccagggaagggaaggctttcctcattgctgagatgtctggggaggagaggaggcggcgattgcgcctccggcccagccagctgctttgcggaacagtttctctggaatcaaagctatttctgaaagtagcgcggctcctgcttccctccgcatggcttccggatcatggtagtgattgacgtttgaaatgtttgcccttcctggactttgctgtgctagtgctgctggctaacccaggaactactagttaattgcacttgctgttactaggggcgttctctccccaggaatgacatggaaatgcagttacagtagccacttataagaccacccatgaacgaggtgaaagattttcagaactggtcctttgtcatgaaaagagcaagttagagtgtgcagatataatgggcaaaaagaaatctatgaaaacagaaaaactgacagtacagattcttttggaatttaaataattttattgtgaatttatatagcccccatccttctaaaaacatattttgcttccctctttctagttaagccaaaaaataagggaggagtgatggcatcatattttacttgtgaaaaatctggaacttggcaggtgctaacattaattgaatgcaaaatagctttaagctgatgcatttccctgacattgaagttaaaacatgactttgggatgtttgtttttatttcctttctgaatttatattccaagggaataacctacagaaaaagatatggctcatgtcctttttgtcttttttgtcctttttgtactcatgtcctttttgtattattgaatttttaaaagtattgttaaattctccctcctaatttctgctcttccaattttctacttactgtcacctctaagagaaagagataagaccgtctgaaaactgcttatttttaaatctggccgcccttcgaaatgaaacaaaaccaaacatagcaacagcatgtttttggttattgtaaaacaatttcaaaaatggtcttgtatttctagcacctgattttttctcttgattataagattttaatgtatgaagagaaaactcacatctgtgttataatgatacggaagtttgcttagttgtttcttgattttcttactggaaattaaataaaaaggagagaagcaaaaccccattatttgggcccatgacctggcttcccacctacctttgggattccctgattgagtggcagcagtagccgttctgaatctgcttttctcattttaacttggaccactgaacaggataaaaacatggaagtataagctaaagcaagcttgtccaacctgcgggccacatgcagcccagaatggctatgaatgcagctgaacacaaatcgtaaactcttttaaaacattatgaaattttttttgcaattttttttttttagcttatcagctatcgttagtgtagtttatgtgtggcccaagacacttcttccagtgtggtccaaggaagccaaaagattggacacccctgagctaatgtcacctccagacatacataacttgtgggtctgcatatttttcttctgtacaaagacctcttctgtaggtggcagtcatctctccatccctgctacaaagacagcaaagtctatgaattctcacaggcctagactcagcatagacatcaggcagctagaacaagcgtcagcacgcagtttctccccttctcctctcagtttccctgaggtcccaacaccggaatggctctgagcttctgcttctcttcgatggtgttttattccttcatcgcgtttgctttgaaggcatgagcagcctgttggagggggcgtgaaggctgctgggccggctttactgtcctgctctcccccgaggcccttcacctggggaagcttcgtcctgggctctcttgctttgccgggatggggtgggctgggaggatctctcttcacagctcacagcctgcatgactgcacgggtggcggtccctgtggagaagccaggcctggtgccgactgctttgccttggcgtgttaccttcaccacacggctggatggcggtttggaaatgcatgtcagaacagtgccttagacaactgcctttttaagaaatttcacttcttgcctaattttctttcccttctgtctatagaaatattatgggctggatacaaaatggggtgacatcgagcagtggatggtaggccttgaatataattttgtttttactcttccctccccacttgaatacagtgttgagacttaaatggtttataatgtaattcttacgcagtttaactatgtagatagattcctattgcaccataatttaatactgagagattttcttccggggatttctgcatctggtctctgtttacatccccaaacgcagcctgcttagaaacagtcctggtcttgcctgtttggtagccactgactgctgatgtctcctggccagcagtttggggaggtctccactaccacagccgccctgatctcctcgagcacagggctctccaccaggactcgggctgggcatgcgcccctggcttgagaactttccagagaacattcccattggcttcgcagctcaccaggctgtggttggaacctgagaggtacattatgctccatttccttcactcatgattacgaccagctgccccatcgccctcatttagactttatctgcatttgctgttgggttctctcttcatcttgtccgctgtgcctgccgaaaccactggtctttggtaagaaaactcctttaccttctccacctgcttcctagaacagcccctctgccttcctgtggatggagagctagcctgcccctgatgatactcctgtccttctggctttctcaggaagcagcggcacccacatagggaggctgcggaaggggcacaatctgtgtgctttccactggtcccgagagagagtggcctggcccttctcgttagttcctctacccgagtccttctacctcttcctgtcccttttgctttattgcctggcctcgtggacttcatcacatgcttttagcatttgagaacctggccaggatggaaatgtcctattaaatgttccttatacataaaatgatctgaggaaaatccaaaattatttcctaacatcttacgtactgggtataaaagaggttcgctcttcagatatacagagcacacacttactgtattgaaaatatgattacattcagcctaggcaaaccatcattttaggcttacatgacataaatgtatttttgttaaatcttaagacatttctgtccacaggcatggtgatataagaaagagaaaaaaagaaaagaaatatttaaaaaatctttacacattctttgaagttgtatcattgttttatataccactgagaaagaaaaaatgctaattataactgagcaacttggattataagatacatccccagcttcagagatgtccaagtgtgaaaaaccgtgtgtgtcttagaatccacaatacatagtagaaagagtgacatccttttcggatattgtgtggaaatgatttatcttctgattcccgaagagagtgaggttctgaaagtaaggggaaaagtagattgatttaaatggatcagatgatagaggttagaaaaaaattaagacccagcttctgccccaaacactgtttttacaacaaaaatgaagtatgcaaattatttttgtgcttaagaacctcccaccccagaaaaaaacatttttacccactggtttaattaaagcctttaaatgaaggcaaagaaaatatttatgtgacatttagatcagaactgctgtattatggtgcagtgggactacctaagcttttttaaagcacttttcctgtgtccatctgtctctaaccttttcatgctgtttcttcattgttaggaagacagtgagcgctactctcgtagatccagaagaaacacatcggttagtaccgtgttcattcattacttgggcaatttgattgaattctaatttatgcttgcagtggctgaagtatatataatatattcaatctcttaatgatgatatcatctcttaaagaaattaactaatactattaatgatagaatactgatattattacctaaataaagactatgaacttagcttttagcattttgacctaaatttgataaggagagtgtgtttgagaaatttttcagtattaatatattcatgacagctgtagtgctttttgtgccattgaatacccataaataatctgcatagtaatatacaccaatgctgtgtatttatattacccgtgagataaagaatactacttggatgaaattactttttttttttttttttttttttttgagacagagtctcgctttgtcacccaggctagaatgcagtggtgcggttttggctcactgcaacctccacctcccaggttcaacaattctcgtgtctcagcctcccaagtagctgggactacaggcgcctgccgccacacctgactaatttttgtatttttggtagagacggagtttccctatgttgcccaatccggtctcgaactcctgggctcaagtgatctgcccacctcggcctcccaaagtgctgggattacaggcatgagccaccgtgcctggccctgaaattactttttttttgagatggtgtcttgctctattgcccaggctggagtgtagtggtgcagtcttggctcactgcaatgtctgcctcgtgggtccaagtgattctcatgcctcagcctcctgagtacctgggattacaggcacgtgccatgacacccggctaatttttgtattttttgtagagacagagtgtttcgccttgttggccaggctggtctcaaactcctgacctcaagtgatctgcctgcctcggcctcccaaaatgctgggattacaggcatgacaccacacctggccctgaaattactttaaatccatattgcccataagcagacagagatccacaaagcccatgctgtggaggacctagactggtgtcccctgagatgtccaggggtggctggccccctcactgctgtgggttggggtcagttcccagcatccccctgaaacttgggcactggttcttcatgtatgttgtatgattccttcacggttgttctcgtcctttcttttaataggcttctgatgaagacgagcgcatgtcagtgggtagtcgtggaagcctgagggtcagtaaccagaatgatggagtttgcatggcacagtttctggtccaagccctttactttctcatccccgcattctgatttcttcttcattatccccgtggtctgatagtcaatatttaaccgatgagatgcttacttaaaatcaaatcaatgggggatgtttctttgttgctgtagagagatgatttatatgcataggcacgttggttgtttctttctcccgagatgaagtcatctttttttcaatacttatccacatcacaaagctcccaagccttgattagcacagttgtctcagcacattggtgttccacaggaatgcaaaggcgcgtctgccctttagtaagtctgtatccactgacacccatgctcctggtaaaatcggaacctctattaaagtagctgtaagttaattattattgagcaatgttttggcatagccactatagactgcctgctgaaaacctggaccaggactggatccgtaaggtctgccttcagccgcttttccttgtatcagttataattagatctctttaccactgataggcttaatggttaatcaacacaaatatggacttttccttaaacattccagaaaccttaataattatacttgaaaaaagtgtgagtttggggggaagtaaaatagaaaaactatgttttgctcagtgctttaaatcagtgaattaacctgagcatgtcagtttcttttactgcaggattgaaattacatctcaccgctagtaataaataaatctcaaagcagccactcgctttattaatccttagggaccacatagagctgaaggcttgtttctcttcactgtggcaattaaatcctattactccttgacttcttatacatgcactgagtgtgcatgtaatttggcccttcccaatgataaaatgcagaggtgaaacacggttgctgtgctgtgaagccactctgtccttgtcagtgtccttgcagtgccaaaagcagatccgtagtgattttgccaaaaaactgtggttcaaatgtgaggccccgtgagggcttccttgctgtttgaaaccttctcctgagatgtagcctcagggatgctgttgtaaccgttacctcgggaccgtctgaccccactcaccccagaagagggaagatttatggatccaaaatagaataaatgcaaagctcaattgacaaagtctgtagacaaggcccagacatcacagctgttgagcaggcccaggagaagcttgagtccttgaaaccagtgaagaaaatgctgtttcagggatgagggggagcgaccgagagaggaggaaactcagacttagcggtatagaggatgtcagtcactttggcaggagaacttttaacggaaatattgagggcaaaacctggttaatatgggttcaagagagaataggaggagagaggcacagaatcccaaactgtctctctcaaaatgcatcattttcagagccacaccctcctgaaattgtaggcacaatttcagatgtaagatgtgtgcacttacattttcctgggaaaagaatgttcagtttcttcagattctcagagggtctcctgaccctgaagagttgaaaaccattgcaatatgaacgagtattacggtgttatgtaacagcattcatttcattttcaatgatttttaaccagaaataagttgcatctttctgctggacaccactctttgccgagatatcaagtatatttgttttaagagctgaaatttcctataggatgttcaccattaggacagtacataagatggggaggaagtggatgggattttcattttcagccacatgacactttcccatcaggtacttgatctgaagaaatatattcctcagaacttaagaacttggatcctggagatgagagtcaaacctcctaatgtttataggcaccaaacaagcccagagtggtgaagaggcctgcgtggggtcacagttcttaggaacaaggccagtgcctgctgctcagggccctggtgggctgtgtgtcctccgtgcgctgggttccctgggctctatgcttgcccctttgtaccaccgaacagggcactccccagagtgaggactggcatctcgctctatttctatgcggggccagtttctactgtttttatgtattttaatattatgaactttttacatttttgattgtaagatcgtatcttttatttattgactctgaaaacacaggccttcttcatttagctagaaaaaatgataaaccctaaaaaaggtggggaggtgatttatactactctggaatttgtatggatgcctcctcagaaagtctagattttggattttctagaatttctcgagtttagattttctggaaaatctagatttttaattttcctttttgaaaattgatgacagtgcatctgttaacctttgcccttttgtaactaaaatggattatgtagaagaggaaataagatttatcaaactgtttcagactttgtgaattatagcagcctttgccatggaagtttattgaatgctactggattctgtggtagctaccattctgacataattctttttgtaaatacatattagatcctagaaattatggaaaaatgcatttttgttaagattttaaagattgcttgtatttatgttttacttagcttttaaatttacttttggcaactctctttgctgttgttttttttttctgccatctttcttctgacagtcgcagcctgacttggagtatgggggtccttacgcctgggtgagatggtcggatatactttgctgtgtgaccttaactgtgtggtgtgaccataataacctgtggtatttccacgaatctcatgggtgctttgtctccagtttttgcctggggggctatgaggccaggagggcaggcttaccctgcagagtgagcagtcttcctcctggggcctccagggtgcagccctgatcctgccggaggggaggagcccaggcatctgtgcatgaacactccctcaccagatggcctttgagcaccagctgtttgccacgccttgtgttagcagctgtgcataccaagatgaaaaagatagtgtctgccttcaaggaactcaaatcagatcaagaattcccaaggcctctacatttgctttaaaagattaaatgtaaagccattttacctaatgaaaaatccattattttccagtctatatccattcaaattaaatgtacaatctgacttttttttttttttttgccagaaagtattctttgagaaaactcctaacttccagtaacaaaaactaaggctttagacataaactcagaattacttcttatatgtctctgacagtttctgtgccttatgctttctaaaagtctgtcagtgttatacttcaaggaagaaaaagttctcagaaagcacagctcagcattaaagtgattcgatactgaagttattgtagcatattatgtactatttcacctgaaggactttacctaaaagcagtttgtgcttcatttgctccagtgcatttcaaaattatttagtaaattcttgttttaaaaatgtatttttgtgtttgcaattatagtgaatcaatagtagcatacatctgcatagcatatttggtgccctgagcctcctgtgggacggctgttctgctcttaacagatacaagagcagaggctggagtgagtagctcgggagtcaggacaggggaaagcacaaagacagggcgttagattcagaaagcgctcttcacagagtatctgttacttacctacagagcactgcaagtcgctctggcaggtgagggcatttctgtgacactgtaactccagcaactctcctgttctttaaggaattcaatgtgttagcaacatatttctagattattactctttttatgttaaattcaaagtaaattttgtttaagagctagcccccagtgggataaatgtatatgttagcaatggtcaggaacacattttggattttttttttcggtcttaattcttttttaaaattcaatagaatgcatcagggatcgaactccagagttttgacgtcaccttccttgtttccttttccatctctaatgccctttacatgtgctctgtcttttgactcatgtagaaaagacatctaacattattcatccaaaaagttggcagtggacttttgcgtggtcccatgggaaggtcacagacgctttgataacactgcgtggtagccattagcattcggactagtcacaagttaccgttttcatagggcatttacccttgtatcttatttatcctgtattagaacatactaacttatgtgtgtcctctttattttattctctcttatggcagtgtttctggagagcttgttagagtgcctgttcctgagccctttctgtaggtatcctgattccctaggcagtggcccatgcttgtgggaagcatgccaggtgtccaggaagcaggtgtgagacccagcctgggagcatggaaccagcaaagtgaacaagcctgtgtaccacttaaagctacacagtacaatagagcgaagcttgttgaacatcagagacccaacttaagatgaagttaatatgctgcctatggacttttgttctaatattgttcagttaactgtcaatgccccttgccctcttatgccacgtaaaaacagccccacccatctaaatacaacacaaaaaaacaccatccaagaggagaaagttagcagtgttctttaagaaggtcaaagtacttctccctatggaggtatagtcaacaagatcctatagatttgggaatacattctaggaacatagcccaggaataggttccttatgatagaattccattaccacagacctggtcatggaaattgctttgcaggctttcctgcaaagtaacagtttttcccaggttttcgtagaaggctgtaagtggaaaggtgacaaatgagaggatactgtcatgcttccagcttgcccagccttctgctccgtcgctgcaggctgagctggagaactacagtgcaaaggacagggttccgccacagagctatgtatttcataagcagcagtggagagccagaggccttgcttatgtcatacatttctcttcctcatttgttagtaaagtcaaagtcatctaaaagtgattaacattagccttcattattttattaatttcttctggaatctagtttctgaagacataacaagggattgagatctaaaatttgcaagtccttgacatgcattttcatgtcaaataatcttgttgctgaagacatgaaaggaaattagtctgagtaaaactcttgccaatctccaaagatttttactattaaatttatttcagaaatgttttaatgttactcatagagttctcaaatttaatatggaaggatttctacactccttttgtttcagaacttcaaattgatttcttgatttgttttgagttacagcaaagataaatatatagtttgatagtcaaagttttatgaatctggatttataatctgtctggaaattcaatttttttttctactttaatgtcatggctgcaaaatatgtgctatacagcacccgtcccccggataaggaaccatgtttagcacctcccatatgccaggccccttccatgtggattcatgtatccacccagtcagctggtgattcatgagggcactgttctaggtgcttgagatactcattttcatctcatttaatcctcacgatggctttgtaatgtatttattattatgcacattttcacggctgagaaaacagatgttcaagtgcattaaataattacttaaggtcacatgacggagcttctttgtggaatttggactcatgcccaggacctgatggcgtctccttccatttttaccagttgtgtagactgctcctcctttttctgtcccgagagctggttttgtctctgatgcttgacagctctattttgaatcagcagaaatttccttatagatgaattaagggacatttagaaagcccatgctttgacttaagggaacctgggctgggaactgagaagagagggatgataggcatgcacttagtagaatcattctcctttattctggaggacacattatgaaattattaaatatgtgttcaaatttcattttgaaaaataaagtaggagggctggatgaataaaaaactagtatagaggatataccccacgatgaacttttgcgtttaactatagattgactagaaataatttctgaggccgggcgcgatggctcacgcctgtaatcccagcactttgggaggccaaggcgggcggatcacgaggtcaggagttcgagaccagcctgaccaacatgatgaaaccccgtctctactaaaaatgcaaaaattagccgggcgtggtgacgcacgcctgtaatcccagctactcaggaggctgaggcaggagaatcacttgaaccagggaggcagaggttgcagtgagctgagctcacactactgcattctagcctgggcgacagagcgagactctgtctcaaaaaaaaaaaaaaaaaagaaatgatctctgaatcttctgaattatggcccatagcatcacaatgtgccataattttcaaagaccctgaaccaggaactgaaaactcattgactcaggctgaatcactacccatcggcctggcatgtggcttcttgcaagcagaatgtccacagagccaccataaaaccagaaacagcctgacaaggaaatggccacaccaagcccaaatgttccaccccgtggagggacttggtgccactttaaaactaagagtggcatgtgacatgaagcctactgacttggttagcttgactgctgttccctcctgagctgcgggggagcagacggcggcagggatgcagtttgggagctgccaggacttgtactgtcctggactggtcattcatccgctccacaagaaaggtcaccttatacctggctggttggtccctgctgatttgtacctgtgaattcatttgtgtactgatgtcagtttttctcttttcttcattgaaacagacaaatggttatgatggagaattgtatggatcacagtccctgaatagaagatctggcagggttagtatagtaaatttgcatggctcaaaattcaaataggttgtttcaaagcttctagaactaaaaactaattgctaaatttaaatttagcttctttgctgtttttaaattttaaaatcggtctgtcttttttttcctagcacatgatggaatgaaagataatgtttttcaactagcaaacattctgagaatgttagccctccaacattctgattgttagtataaggggtagatattgataagaatctcaagttttaaaagatctgaaattaaagattaactctttcattactgtattcccctgggtgtatgtatataatgtgtgtattaagtatattcagctttcaaagatactaaatccaacattttcgcagtctccacatctgtcatttgtaattttaatgtttaccttaaaggcatgtgtacaagcacctgtgtttttctggagaggaaaaggagaataaaacaatgcagatgcttggaaggctcccagttaaggggtgggaggcaggaaggagctggtggaaggaaagggtgctgctctagggggagagagagggagtggtgccagtggcaggggcattagggagaccgggcgggggtggggagggctttggattaatcaaggacaggaggtcattggggattttagaaggttacactggatacatttccattaagcttcacgatatcccacaggtccattctgtgtgaaatggtctaaaaatttcctgttctcatgcttcatttttttcttttagtaatattcctaattgtgtaaaatagtatttcttttcatttatcttaattatgttatattaagatatcatgtgtatgcttaaattatacttttgggcttcaaatgagtgaccccacccagaccttcttccctctccccgaccaaagccgtctttagctttctgaaaccagctgatcaagttgtttttacttgctcattcctatttacctatttagcattgcatgcactttaattatttattttttgagacaaagtctcgtgccctcacccaggctggagtgcagtggtgctatctcagctcactgcaacctctgcctcctgggttcgagcgattctcctgcctcagcctcccaagtagcttggattacaggcatccactaccacacctggctaattttttttgtattttttagtagagatggagtttcaccctgctggccaggctggtctcgaactcctgacctcaggtgatctgcgcacctcggcctcccaaaatgctgggattacaggcatgagccatggcacccggctggatgcgacattttaaaaatgtatactcaagacacgtaaagatggccttcagggcatttgcactctgtggataagggctctccagtggacgggtggcagcaggctgtcacactccacccacctttctggcaccccagggctgagctatagcccgcaggcgggctgggctgaagaaagattgaaaattttgcaataaatggaattttagttacccaaggagataagacaaggagtttactgacaacgcagtgtgaaactcagtaattacgaatcgtgctagggatatgagattgtgaaaagcagtactagatacacccctggcatcaccaagacacaaacactgaaggtgaaaatacagcttagaatctccagttgttaagaatctctgctgtactgtttgtgcctcgcgtctttagataaactagcgttcctgggctcctagtgttggctcggttgtgctgttccatgttcgccttttgaatgggatgggggtgcttttggagtcgtaaggaagtgcttgtcacttaaacgtgttttcttctttggtgctcagaattccagctacagcggtgacagcagattctctactttgtcatcatccagggaggagaagttggttggtttccatttaaatctttcacattctcttcagaaaccgcagattttgtagcatgcaatcttgtgtgtgtggattcagctctacttttctctttcggtgtctgtttgacggatttttgtttgggtagctgtgttattgacgtgaaaagcagcagttaacatgagctccttcattcagatgtactccagtgtgctgcgtttgaccacaccagctcgaatgtgaattgtggcattcagctggctgcaatgaaaggacgtgtttttgtgtatattttctaattagaattaatcaaaaggaaaaaaataattagaagaatgctcttgaattcttgagagtttctgaaaacagaactactttgaagagtacatgcaaactttgtggtggtttcttgggcatggactagacttggaaggaaaatccagagtctcatccaaatccacatgtttacacaacagagttccttcccattctctacaaacatgcatcggtcttgataaacataatttctaaattgtttaagagccctaaaattgctaaggcttgttggtgtttgtttaggttcacatttactcagcaaaattgggactagtttaggtaggaaaatcaagcaggccctgggatcacaaagctaagcagaggaggtgggtgctctccaggcactgacatctagaacagaagccaccggcaccggagaccagtacaggagtgaacagatgagtagatagaatgggagggagacactggttttgccaggaaaaaagatgtgagctgaaccttaataaataggaagggccaggtgtggtggctcacacctataaatcccagcacttcgggaggccgaggtgggcagaccatgaggtcaggagatagagaccatcctggctaacacgatgaaaccccgtctctactaaaaatataaaaaattagctaggtgcggtggcacatgcctgtagtcccagctactcggggggctgaggcaggagaatcgcttgaacccaggaagcagaggttgcagtgagccaagattgcaccactgcactccagcctgggcgacagagtgagattccatctcagacaaacaaacaaacaaacaaacaaacaaatagaacaaatgaaaagaataggaactaaccaggtagagcctagaggggaagctcttcaaggtaagtagccatttgagcagagcagaggccgcgcagaatgggcagaacccaggagaggtgccatgtggctgagcacagggtgctgttggagctgttccgtgaacctggtgactccagtagcagctcccacgctgaaatcagaaaatgaaatctatgcaattcctctgcgatttcctttagccactcccatgtatcattgacctcattaaaatgcttctagaagaaatagctctgacccttccccgccctgtccccaatttccagcccctattctcgtttccctcccggggggttggggggtatctttttcttgccagggcacttcttcctcacctcttcaccccttgtccaaccccttcatgtccagggagactgcagaaggtgctggcagctccatggcgcccactgcttgccacctttctcaacccttcccatagtcccccagtctgtaataaatccccccactgtaagctgatggcccttctgtcccccaatatgtgaattttgactcagtatatgatcagctgtgaacaccaaagcatcggtgggtttaacaccttgaaaaaggctttgggcattttcttaattcaagagattttgctgttgcagagggcacttagtcattaagaaaacttcatttccaactcattttcgataagctgagttacttgctctaaaataaaagatggcaataaatatctcatctttggatatgaacgattcacccaagttcagcctgcatctgactcacttcagtccatttaagagaaataacccacatccaaagggttaaacatcagaatgagagctgactcattcaaacagggccacatgtgaactcgccctgagccctgtgtgcccgtgatttgctgcccgagggctcttgtactcacccaccctcagaaccttcctggaaattgtgctctgtagacatctattgctgcccagtacgtggtgcgtttaattttatttaaatataataatggaaaggtatcagtgtagaatgtagtattgatgactcttcctaatatcaattaaaatttatttcaatatttaatatcaactaaaattaaatatttttttctgtgcgtgaactcaaaagtcctaatttggccccatctcctagttttgtcagttgcctggcccagccgtctttatttccttctgaccctcgttctctccctcccccgtgagtgcatgcctgttactgttttggttgtataaggtaatcgtctctgaactcactggactgatgtacctttgcgatgccgtgagggtgtgagcctctctctcctctctgctgcccatttgctctgattacagggactctccggctccagccttgggcttgccggtggtggcctggctcccacacccctgtctgccccaaatggaagctgggtctgtctccttttcacatcactttgtcgctccttccctttccttctgtgcatcactttaattgctgattacatttagtggatagttcagcctcctctacacaaagtcacaagagcaaagcttagcaactgttttaattggcttgactagtttgctaagacttttgtcaatcttttagaaaaaccatgtcaaataagttagaacctatatagaaaaggagacttaaggaaaaggagggttttattaaatgcatattttcaaaaactcgagtccaaaaaattggtctcttgggtctctcctccttttccagcaattgttccccatttggggtttcatttgtttttttaaaaatattttttctcttgtaaatgtgtccaggaagcaatttggaaggtttttgtgcctaatctgcctccttggtccctgagaagtggacagaacagtgttattcctttggctgggtctccccgctgtttcctgtttttacaaggtcaggttcaggtccggccctgaggtgcttggcctgttagctataggtatcgagtcttattctaatccaaggaagtcggtgtcagaggtgaaagtacacgtcctatttggaggttgaactgtccctctcccttgcatgtcgactggagctgctgagtgatcaccgcctggccgtgcaccttgcctgacttgctcagtgtgccctggaaatgagtccagattctgtcccgtggcacagtctctggacactgggagctgcccttgtgtcccagcctgtcccttcaccagcactgcctccccctgacgtgtgtgctaggcaggattctcctttgacagggctagaccgcggctcctctgggggtgcctcccacaccagctgaggcagccttgcagtgactccctttgtgtcttgaagactgtcgctgggcccctggcatagaaataaagactcttcctgctcctgtcttcatgtgtggacatctgcgtattgaatactgccaagtgtgtcgttaaccttggatttgagctgtgggttttgttgctgttgttgtgttgaccttgtcaccattctgtctcatcccctgaccctttcttccaggaatgcctgaaatgactagaaatgatcgtgttttaaagatgctgggaagtttactgttttaaagttaaaaatcatctcagttatctttcttgtaaattttggatttgcatctatcaaatttgcagaaaacacggtgcctcgatcggtttgtttctgtttaaccactgtacagcagttggctatggtgaatgctgaaactatcgtgatggccttttgctgtcatttgttgctgttttttcaaggcttttaaaacctgccatttgctttcatcctccagccctcctgtctgtacagcgctgcccggccttcggggagttaccgggtgcgtgtgctgcccaccctgctgccccgcaccccctcccactgtgcatgcaccgcccccaccaagcccagagccggggatgtgcctgttcccagccccctgggggaagttgcaccttcacgtggagcttacatgtgccagtggggaatgtctgtcccctttggccagatctgggttttctctcccccgattgttgactgtagctgccacactgctctgtctccaggaagccttgtgtttgctgggatcgttaggcaggaatggaacaacagcaatgtttactttacctattggcagaaagaatggtggctttttaatgctttggtaacctggacagatactaatccatgttactatattactttggaaatttccagttttaaatataagtacttatgctatgcaagaaacgtaaagtaaatactcaaagtagctatattgtcttgttaataaccttttttttttttttttttttttttggagacagaatctccctctgtcacccaggctggagtgcaagggcacgatctcggctcagtgcaacctacgcctcccaggttcaagtgagtctcctgcctcagcctcctgggtagctgggattacaggcacgtgtcaccacacccagttactttttgtgttttcagtagagacgggtttcaccacgttggccaggctggtctcaaactcccgacctcaggtgatctgcctgcctcggcctcccagagtgctaggattacaggcatgagccaccacacccagccattaataactttctgaatttccatcagattgcatacttatgtgtttgatatattaataaatggctgagcaaactagtatgtcctcaagggaaaatagggaaattaaagttcctttataccgggcaaagtttgacatcaccatttgtggcagtgtaagctcctgtttacccacgttgattaattaagtagcattttccagttaaccaattactctttcttctacttagcaacttttaaagggttataaaatatttaacattaaaactataattaacataatttgatattttatcccaaagtcacttcacataagagtaattttctaagcatcaagtatgagaatgccatgacaaaattcaggatgttcgaattatctgctcattttaacctggattaacaagttttcacttaggcctgggatgttttccaaagtaatagatttaaatggtctgttggagattacattgcacacctcctgacaacgactaaaaccggtctctcctcatttccttgtcgcactctgcaaccctttgaagagctggaaaggtggttctcagcctcccctgcatgctttttcaggtcatgctcctggcacgtgtcagtttttcacagctcacgttttcagcactttctgggcactcttggagaaaggaagagcgcccatcctgacagtctcttttggtcgcaggcgtctgtgttggatgaaggcagcttcggtgggacccgacggggcagcacctccggctcccgtgctgtaaggcgctttcggtgatacctcctttcccccgtgcctgctgcatggcctggggatgctcgctgggcagggtccagccgtggggggtgactggccattctcaggaggaagcgccgagtcaccgggctaaccgccaccttccattgtaatgaaggtcacaaataatgtgaatcaggaaacctctggttgttggtttcatgtcctcactcatcagggagagtaacttgcactgagtttcatctgctctctctgcagcacgccaaccatactaacaggtggtgaaaccgtcttcggttaataaaaacgggaaaaggacaacttgacagaccacacatcattctcgtccctggatagttgaggaagaggaacaaattttaaaacttggaatgttacgcatatttcattccctgtttgtattttgttgtctctctacctctttcttcaatttgaaatgataggctcagctatgagggtaaagatgtaataggtgcaccataaacatttgtgaatgaatgcgtgagaaaagcaacaaggtagaaaaatgagatggaacccgtggaagtggggagacgaatttgcgtgtcccagggacctgtggaaacggagcgttcagtgctaaccggtgctccctggcggtggatctcctgtattcagaggctcctccccaatcctataaaaatgtcttcaagccctccaggaaatagaaaggtttactaagaaatacttgaaatgcttttataattttgcttttgaagtttatcagctacttacttgactaaatccagttttatgacttactatgctatttgtccagccatcatggatattcatgaattcttatggtgtaagccagtctaacctacagttttctttaaaatgtaatttatgaatattaaatccagtagttgacatagcattcgtttttgtcgacaactgattacacatttatcaacttttatattacataagttgttcagtattttgcagcccactatataacatatttttcccagttggtaaacattttcataggccattagaaagctcataaaccatgcatgaagaatgaaatagccctgcctatgatgtgatggataaagcacaactaatgattttcttttgtcagaaaagagggagaatactaattcaagagaaatttcccccaagcaccaggtggttttctggtggcttcagtagagagtctaagatctggcaggacggagggctcctgatgctctccagatgctactgtgtcacgtctgagatgggcttcgggagtcgtcagccctagatccttggccttcattgctcttctgcgagcagtgatttctgtgcttttagcccccacaagaattgcctgggagtgatggccttagagagttaagaaaacaggaggtcatcttgtcctgacagcacagctgcctaaaatagggatggtcagctctgctgtgagcaggaaattagcaccatgaggaagacggaagggacaaagaagttcctgacctcccaacctctgccatcgtttccctggaaccctcacagttcccctccaagtggatactccgttccttatgtttacaggagggccttgggagagagccacccctgctctcggtccagcgtgtagggaggttatggcccaggacggtgtccagagcggccccggcgcccaggcctgaggtcccagccccaagtggtcgtgacctcagggtccaggcttcccccaggcctgcacagacagccctggtcctgctgtggaggatttgccctgcccctggaggaccaggaattgcccccgcgcagctcctgagtgtgaagtgactttcttcggtgttgtgacaaagctgggacgtagtcatcaccagtggcattgtctgatccaggagccgaggaagttgtttctggcagaaagtggaaataagaagcccaacatgtaccccctttcctagtcctcagctcctccatttggcccacgtccttacttccatgtcacagatgccgggctaaggaacttccacagccacgtggccaacaagagatggagccatgattcagacttaaagctttctgacttctgcacattagccacataactcctaaacataaggtgcacgtggaccgtggcgatatagactttcactttgttcttttctgcgtgattaggtccagttggaaggtttgagagctgcttttgcttagggaagctggggtgggcagtaagctctattcacaacagttcactgtgtctttgcaccataaaccagggcatgaatggcataggatggagaaggatttgctgcaggatgaagttttcctctctcttacatcaggaaaccctcaggcaaaattcttctgctttaaagtgttgacattaagtgttttccttattttcaacaagaatgccaaaaagtgaggctagtaatactggtgattttcttgtatatctcaaatgtggcattgatgctttacatgtgctgtgtacacagcagtattaatctgtgaatctgaaacaacgtcttgcccctgagtgtaagtgtatagtaaacatttatcaaataaaatagaggtggatgggtctggggaacttgcccatcttgtccacagccctgtacatttaatgctttcaattgacatttgatggttattttagtctacagttgaaatcattcgttcattcaacaagtatttcttgagtttgccaggcctcatctggtcactagccctggtgaggaaacaaactaagagatggtatttgacatgagatcatgagcacccctgaagatctatatgagatcacaagcacccctgaagatctggatgagatcatgagcacccctgaagatctggatgagatctggagcacccatgaagatctggatgagatcttgagcacccctgaagatctggatgagatcttgagcacccgtgaagatctggatgagatcatgagcacccctgaagatatgggcttccttataattcgcaagcagggcacttcggcaggtccccagcagagcctgtgaggccagcagagggttctgtgcccagcacagtgcagggtgtccaggggctggaatggaggggccttcagcagtggcgaggcttgctatatggtgctgcgtgggtctctcttgaagatgctcctcaggacatgtcgggatcctaaatagtgttcaaatcctgcccccgccccaccatgccttgctcaggaagaatatgagaatgtttataataacgtgaaaatgtatctaagactagcagatgtgaacataaatcaaagttacaagggcgtagcttccagataatcgagttgctggtattttcctttaccagaagtgagaaagttcaggtaaatggatagacagatgtgtacatagcaaccacccaggtagaaggtaatctggcaatttaaaaagccatacataattttgtattaaccctaactctcattttgcttccacttggaaagatagtggagaagcaaaatttttgttcccttgctaaagcgccaagcgccctgtgcaagtcttcagtttctgtgccggaaggcagcttaagttctcaaaacagtcatttccacatccacggggtgactttctgtgtctacactaggtgtgactgcacacccaattgaacgggtgctttgtgttattttcttcttcctaactctgagaaattctgtgttcctctgataatgtgattggcttttttattcttagcgagcactgatttgaatatgcgtttgctgtctaaccctaactctcttttccttgccgtgcgtggctaacctcaccacttactgcagcatgttttctgtcggcctctattctccttgctcctttgctgaccctgttcctttgtttctggctgcgtgtcctggcggtggctgtgtgggcagccctcggagtacagcggccacctcaactccagctcccgcgcctcctccagggccagctcggcccgggccagccctgtggtaagtcggcctcctggccttgctcctactcagtgtcaccctccctcccccttcccttatcctcctcttccaacgtctccaaatttagaatattactctgcggtgatattattaggattacattgctcaacttttcaaggaccgtaaaagaaattgttagctgtgcttagagatggggatcttagaggaggcaaactttatacaaagggagaaaataatatagccatgtgcacggatgtgtggttttctttttatgatttaaaaatttgaagtattgactgttaatgctttgcttgaagtgttacctgtgatcagaccccgacagtgtttaaggtaaagcgtggcctgtagatcccgggacgctcccagtttggccccaatcattcgttaccctcctggttctcagatccttcgaaatgtgcagatttgcagccctgcatcctgcttgtcactcagcgtggcccaagttttgtttcagaaaataggagccctattaggtcatccccagcttgttaagtctcattattgtgtgttttcccctgggttgttggaatttgacacagttttacctgatgtgatgcttgaaggcgaccctatgactctttttaaaggaagagtttgcaggacggttttggactggggcttgtgggaatggaggaggggaggtgggcacatggccggggaaacagctccaggctgcacgaccagaccagcgttcccaccctcaagagccagtgagaaaccttggggagaaaaagcaaagatgggcaaggcttccctgttcgtctccactcatatcaaaatttccagcctgagctgggtgtggtggctcacatctgtaatcccagcgtcatgggaggctgaggcaagaggatttcttgaagccaggagttggagatcagtttggccaacatagcaagaccccccatctctaaacagtaaaaaaaaaaaaaaaaattagccaggtgtggaggcacgcatctgtagtcgcagctactcaggaggttgaggtgggaggattgcttgagcccaggagttcgaggttgcaatgagctatgagtgccactgcatttcagcctggacaacagagtgagaccctgcctctagaaaacaaaaacaaaaacaaaaacttctcccagccatcgagaagttaaaatgtggctcttaagttagttactgaacaccatacttcagcgtgctgatccctacaatttctgtaacgttcctagtaatcaaccaagaagtcgcagcgctgagacctcctgcttgcgtggatgtaccttttttggcgggcttttcctattgtggtgctggtggtttgtttgtgttttaaattagatgcagtcttttaaaactgtgaggtttcctacctcgcacctgatacctgcattcaggtatcagcaaatgcaggtatcagcttctttgggggaagaaaacccaggatctctggccacttgactctgaggctgccttgcagaactgcacagcctccaccccacccactattttcgtgaccccgaggccacggcccaggtgccattcatcactgtgcagcatggctttcctgtgctagaggaatgtttatctcctccatccagccatggagagcaggaaaatagagttcaatatgggtgggcattgcaacgccagcgcctctttctctgggggaagactctcccctctgtataagttgcagacacccactcttgtcacacatttggctctgcccacctggcctcacaggcatttgagtttgtgttccacccctccccatcccagagcccagcagtcagcagtgagagaagccaaatgtgtgcagggagtgcgaggcggcagctaccatgcaaactccaggggcacaccgccccccagtaatctctccccagagtgcatcaggcaataacaggaagatactcagctgttcattatgacatgatttcccattttcaaacctgacaagttggtcttgatgctgttattcaaataactgaaagtaaatggttgtgaacaaggaatttcagatcacagactcagtaagcctggccagcccccaaggctgtgtcttccttaaagttgggatctctgtattatctcatactctatagtagagcaataaacataagctgacttatgtgatcacttaaaactaccaggaagaaacattttccgtaataaatttagtgtaggattgctttgtcttctcacactcacttttcagaaaagaaaatgtaagtattgccaggcgcggtggctcacacctgtaatcccagcactttgggaggctgaggcaggtggatcacttgaggtcaggagttggagaccagcctggccaacatggagaaatcccatctctactaaaaatacaaaaattagccgggtgtagtggcgcatgcctgtaatcccagctacttgggaggctgaggctgaagaatcacttgaatacaggaggtggaggttgcagtgagctgagatcgcaccactgcactccagcctgggcaacaaggcaaggctccgtctaaaaaaaaaagaaaaaagaaaaaaaagaaagaaaagaaaatataagtatttacaattgacagaagaatgttgtggctttactttcagtgaatcccaaacacgcttaatgccctctgtaccctctgcctggttccagtgagacatgacaattggattttgttaagcattgtctttattcaagcatatgatgaagtctcaaaataacagggctcaatatagtcacttagagattgaaatgacacaaatttctttgtcatacgaaattgaccgaagagactgaaatgatacaaattcctttgtcatgtgttttctaaatttgtataaaatttactcacaggtttattagatgatcataaacagaaagatgtgagttcagccttcctgggcgtcctgggacctgatgggggtgggtgatctccttgtatctgctcttccttccctgaatcgattgctcaactagcaaaggtcagttgattgcgggctggttggcacgcttagggaacaaaggtcagtcccgcagtgagggacaaggctgtcccccatctcatcctgggtgccttacatctgatgaaacctcccgtatgtggttcttagaatgcagagaggtctctgtagagtgcagggcagttccctcgcggatgtgttacggtatcccttgattgatcgtgtcgagaatagaaagacggtgagcacaggcagcatccctggtatctgaagagagcctgggagacagaactaagctagctcatttccataatttccaaaactcatggtcctcttatactaaattgactccatttctgttttctgtcttgggacatttacaccattgctggtatattttggatctcctgggacaacagaaagtgctagtggttgtgtttggccttgttgatgggaagaagccaggagagcctggataggactccccggtccttctgcctgggagggaggagcaacaggtcttgggcagggcctggtgtaagcgtggtggcaaaggtgaatgaccctccagtctggccttccttgaggtcatatggagcaggcagtgctctgaggcagggagtttcagaacccgggttcagatgtcacagctctcattcctggcttgggacatctagctgggcacataaacttcttgtgcttcccctggaaagaggggtcatgatacccttaaaaagcaaaaagaaacccccccaaaaaaacaaaaaaaaaacatatggttactttatttctccttggctggggttagccagggatgggatacagttgttgtagcgagagctcatgggaaatgctcccaggccggggacttcgtcagggacacgtatccagggccagtatgagtgaggacagaggacaagaaaaatatgaagtcagggtcagccctgcaggctctgtagggagtcccgccctgggtttgggagatacaggtgcacaggtgagtgtgtcacacccatcagaggggagggagggagggtggtgctgttaaagggcagtagtaaccagaatgaaggaagtgactgcttgtcccacttcgagaaaatgaaaatgcttcagtgtccagagaccaccaccagggacaagacttcaagttttctccacccacttggtcctcccagggtccttgggaaagcagagagggcatcagccccatctcaagacaggcatagaatactgttcacctcattctcatcttctcccatgctgtggatgagctgtgttttcttcctctccagcacgaccaggatcttctccttgaggaagttatttcactcattcattcagtgtttattgagcacctagaatgttccagaaacagggccgttgtatgagcaaatgcagacttgccccagccctcatgggacgcacagacaggggcagacggatgcttgttgggtgatcacacgttgtgaagcccagcagcgggggtgtgaggggaggcaaaggtgcctcgagagagctgggatccagaggtttgacggccagagcttgggccacacccaagcagagtgactccacctagtgaagccaacagatctgggtcatccaggccccaaaatctcactgggaacctggtgaagccatcacgtttctgaaacatccatcaggaatgtcccaagggcagcctgggtccatatcttccctcgtgtactcagagaagacaggagcaatgaactcagatctctgcccatttggactagaaaaacaacactattttgactcatgttttttgttgcacaaagaggcaggggcagggaccaggtggaaaaacgggtcttgaattacaaacaccagagttcaaagataagtcattcaggctaaagtaaatattattggatttaaaaccaaaaaccgtcaccctagtggtggactgtgctatcatttaaatgtgaaggaaaattacccttaaaatgggtgttttctgagcagtgtttgctgtttgtttgtgtctcaagaaggacctcgcaaggatgttgcttcggtgatccctttttccatccaagtctggtgttgcctggctgggtgttgaggacaggttccttttgtacctgggcccttgagtagggtctctctgggtacgtgaacaggtgccacatattctttctttaggaaaatggcaggcagctggaacatggaaaacttagcgttttagcctcaccaggcatcgtgtgtacaggagcctagatagcaaactcctttagacacagtgttagaaagttggaattaataaaatatttaatgtgctccttgaagcatttgtttttgaaaggaaacttgacgtaaactaaacttccacagacgtgttttagaagtgactgtttccagtagattttcaatgatgtctgtatacactcagctgtggctgtaaaatacaacacacatactttgtaaacctgttagtgtgacgttttcaccctgacctgaaatgtttagtatcactcagaatacgagagtcatgaagctaacaggctgcaatgtgttcggcgctgtcgcccttcccgtgcaggaggccactgtctgcggggtccggtgctttcccgtcctgggctaaggtgggtgggcagagcagcctggaccgtctgcagccaccatgtcctctggacccctctctgcaccatgcccacctcctccaggcccccacaccatgccatgcagtggccgtgacagtgtttagaatcctttcttgtcttccatttcttcatcattttagggaggaagtgctgtgctttatgtcaagatgaaacacaacatctgattccttacctggctctgctagggcttaggaaagggggcttggttaaggtggactctgctgcctgcggcttctgtccgggcccggcccctgcagctgtgacacactgccatctggtggacacgagtggggctgcgtggctttccacggggctgaatagccttcctgtgtttgaggaaagctgacaaatcctttttcattcggaagacacacaaaatgaaatttactctactatgtaaaatagagataggttagacgttcatttgccatcacctttcaacaagagcttaatttttagtttttctctgcatggtctctacttaaaaatatgcccagattttattttgagtccgttgtgttcttcggagcaaggacttttttaaaatgataaaaacagcaaactatggtttttggggttttttcccttatttgatattttacaaattataaaaacaaatgatgtagacggttacaagcaaaaccatgcagaacaaagatgtgttaaagccctgcccccccaaaatcaaggtttgtggaccccgtgtgttttctttctcagctttcttgcaagaaataccagaaagaaaaaagggcttgggtgggcccttcttttacggtctcagatatctttgtaggtaaacgaatgcattcctggagcttcatttatttctccacagtatttatccattgctgaccagcagccagaaaacatacgttttacaccgtggagcaaacatgccacaggcttttcagtggtagtttggcagtctattaaactggattttcatatcccaccaagagttaaactagcctctttattttcatcttattaatatttgttcagcaaactaacttactctaaggaataaaaggctttgggcccaggagatttaatgaatttattctccagcacgctaagtgctagatagatagttcacatttccttgttctttgaaattttatttattttattttatttattttttttttttttgagacagagttacactctgtcgcccaggctggattgcagtggcatgatctcagctcactgcaacctctacctcctgggttcaagagattctcctgcctcaacctcctgagtagctgggattacaggtgcatgtcaccacacacagctaatttttgtaattttaatagagacagggtttcgccgtgttggccaggttggtctcgaactcctgacctcaaatgatctgcccacctcggcctcccaaagtactgggattacagacaggagctaccgcgcctggccttgaaattttgatttgaaaaatatttcaggaatatttttctttccatgtgaagttgagaaccacacttgaattgctccaatcatcctcacaactcaacatggctgcagggcttctggggctctgccaaatgagatggtgcccatctgatcagagtctgccttcgtatctgtcccatcggagtctgccttggtactcatcttatcggagtctgccttggtgcctccaagtacacagttaggctgatgtggcatgcacatccgaaaaaataactctagatgtgcatttcgacacatcagcaaatgcagatggtatgggctgcagatggtatgggccacagctggagagagccgtcttcactgcggtatagctgggctgcacccaacgtgagaatggacatcagggcagagagccgtaagcagctgggattgtggaaagcgcccgtgaacacatggtcttggacagggcctcaggtgggtccttagcagctgtggctaagtgggcagagggaccaccccaccaccaccctgcccaaagggcttatttagcaaagaggggagagaggccagcctgcccctgactgcatcccactggcctgagggatgtggcctctctgcccccatttccactcctgctcttgggacacaggagactggttagatgagagtagaaagtttatttttgaacacccaggtgtggggtggctgggcgagaccatctgatggctttgggagccaggccgcagggtttagcttggatctgttgagtaggagacccttaaacatggccaccctgagctaagagctggtcttggattttgctttcttttggattaaccgagtattttgtgggattccatttgatcccttaactggctgaccagctataactcctggttatgttgttttagtgttgctccaggtgtcgttggaggagaagttgaaggtacaaggagtttgcaggagggaaggtggcagttaatgagccttcctggtgggaccggatggtgagggcaggggcatctggcccagcgtggactcgggccatagatgggaagtggtcatttggaggtcaccatctctctgacaccctgaccatagcacctgcacccctgtgctgagctgcaggtccccggcaccagcgtctgtgcagctcaggtgttgctgagccgtggcctccgcagctctccatcaggatttctcaagcttcattatgaattatctctgtgtgagctcacaacggtgactgcagagtcccaggtcatctctcagatcttctgaatcaaacatatggtctgcagttgccgcgcatgtctttggccgattttctgacaatcaaagtgaagaagttctgagctacgggaagttgggttgaaggcatgatggggaaaacatgattagttgacagcttttcccagagagtttttagacaaactcaaccttggtaaccttctcagtgggcttatgataagaaccttcaatgtgccaaaaaataaaaaaagcagcactccaggtagttaatctttgtttaaaaaacccttccccccacccagtcctgcaaacaaacaaacaaacaaaaaaaggagaaaaaaagaaacctgtcttttgttggatgctgagccgagaaagaagtaacaccactgccggcctctgcctcttgtcccgagacaccctcatggtgcagggctctctccagggtccgttcctcatgtgcaccctctcttgtagttccacagcccgctgtgggtcccactgagactcctacctgaggacaggagaagagggtcctcagggacgtccaaatgaggacaagagaagaaggggcctcacagacatccaaataggagaagtgtgaaaagctaaatttggagtgtcccatttttctgcttctaaattacaaaggaagcaaatgttttgttttgttttgtttatcattcatagccccatcttcatgttatccatttaatgcttttaaagtatttaatattttgtctgttttcgtctacaggtagaagagagaccagaaaaagattttactgagaaggtaaggaatcgttcataaacctagagggtcccaaaagttgtggatgaaattgataagaaaatatgttgcttggttttttttaataaggatgttccccagcgagggaactggactagaaagcggcccacctaacctggtatcaccttcccggaggtaggccaccgggagtcctgtccggtgtgcgttagatcctgtagagcagggaggcgtttataatgggccccaccatggagtttagggttaatccagctaatcgcagagcatccaggaggtgcctggaaatgatcccctccttacagtttactataagcccatgaagagtttccaatttggaaatggaattaaagtaacagtcctgtgatgttagatttatatgcagttttggttttgtctgaaatcgcatctgtgttagtccgttctcacactgccataaagaacttccctgagactgggtaatttacaaagaaaagagctttaattgactcacagttccgcatggctggggagacctcaggaaacttacaatcatggtgaaaagggaagcaggcaccttcttcacaaggcgacaggagagagaacatgtgaaggaggaactgtcaaacacaaagccatcagatctcctgggagcccactcactatcacgagaacagcatgggggaaactgcccccgtgatccagtctcctcccaccagggccgtccctcatcttgtggggattatggggattacaattccagatgagatttgggtggggacacagagctaaaccatatcagcatgtgatcctctcaacgttccaggggtctcgtaacatgccgggcctgtctgcagccacgctggcctctctgggtgggacttcctctcggagaggcagcggagacacctccatctccatcgacaccgaggcatccatcagggaaatcaaggtgagatgctctcttcttactgacaacttgagagaaccttttgtaaaaatcagtctttagattaaaaaaaaaaaagttaattcataaagttctggatctttcttcttggtcctctctccctcacctcccctaaaatacggtgttctcctaacatcaagacccagctcagatagtgtctcctgcaggaatctgatcctacccactgaccccccagcagggcggaccgtgtgccggccccctgcgcccctcagcacccggggaataccttagtgagagcacttggcacgttgtgttgatgcacttggtcgtctctgtatgcttggtctgcatagacattcagtccacaagtttggacaccagacggctttacctactttcacacaacccctccccactaagtatgttccccttcggcctagaacttgccctttcctttctctttgtaatgtgcctttagtagccctcatctttgtattttaatgattttttttatcccactgtagtgtaggtattattctctgctctatcctcagcacccaggacagtgccaggcatttggtagtattctgtgtgtgaaagagaaacacggtgctatttgttaaagtaactagggacagtgcatctgaaaacctgaagactggaagggcaggtgaggtgactagacctgtgtcctccagggagcagaaccaagacagaagcagctgaaaggagccagaactgactcagattctgaattttctagtgctttaaactaggtttaaaagggaagcaacttccactggggatgtctgagcagctggatggccgtttgccagggaggacggagagggatttaagcatccaccagagtttggccagggttaccttgaagatgcttccaacacctatgttttataagtttacaaaaccagaagagccatttcccatgtgccacccctgggccacctgcagctccttgttgcttccctttttttttcctttttcttttcttttctttctttctttttttttttttttttttttttttggagacaagagttttgcttttgtcacccatgctggagttcaatggcacgatctcggctcactgcaacctccacctcccaggttcaagtgattctccagcctcagcctcctgagtagctgggattacaggcgcccgccaccatgcccggctaacttttgtatttttagtggagacggggtttcgccatgttggccaggctggtcttgaactcctgacctcaggtgatccacccactcggcctcccaaagtgctgggattccaggcgtgagccgctgcgcctggcctgttgtttccgtttctacagcagagcagcagagttggcggcagtcctgatgtttctctgcccttaggttgcgcgtgccgttcatttgttcaggtacttactgagaggctggctggtgccagatgctgtccccggcaccaggaatttggcaaagtagagacttggagctccataaatgcagggaaaaagtgctactgatttttgcctctagcatcttactgtacattgcacagagtaggaactcctagtgcttgaatgaattactaaataggagttgaaataacctgtaccgttttccgaggctctattttgtctgttttttaaactgtgtaaaatcatatgagatacactaaaattgtataaaatcatgtaaaaatatcatatgggatacacctgaactttaatctttaaatattgaagtttattttcccttaacgcttaataaaataaaaaagaaaattgggtgctcagactacccaaatagaaactaccctgaagtataaaagatttagggaatcacctgttttcccttgacatcatctgccttttttgccatttcccccaggaactcaatgagttaaaggaccagattcaggatgtagaaggcaaatacatgcagggattgaaagagatgaaggtaccaattcacagacgtgtggtctcacgatattaacccaacttaacttaaaaaaaaaaacaacatcctaaagaagaaattcaaagtgcatgcttactgtaaataggctccagggtgtagaagaactcacaatggcaggagtgccggcatgggtgtacactcaccattttcccaaatgcattgtttgaaccaagattgaaaatgtaactgcccagtagaaaaggttactaacatactccctgatgcatgccttagacttaccatccttcccccaggcttaaaaccagtttctcatttcccataggcgtgtgccagacacttgaagaaggttcttggttttcttcactttttgtagtagttgtatacaaaaatgcttcagttgatttgcttctcaaaatatctgatgtctactaataaggccgtcctcacatgccacacttttgaaacatcccaattatttgcaccctgtaaaatgctactaattgaagtaaagactgactatggcattggctttcttggagcgtgtgcacactgcttttagagtgtgcagtgacttcattgcaccagccaggagatgtggttgccctgttccttgacagtaaggtgggcaatcagtgactgtcttccttaggcagcagcggatcatggatctggaagtgggtggcgtatctgttacttccttttcagccccctagaaagtacctgcaagatcatttgaatttaatatcaaagggcaccagacagaggaggtgacatcgatcatgactaattcactatcttcatatctgccacctttcctgaaagggggaaaaataagactctggctttcaattcatgcgaaaaggagccacttggccaggcgtggtggctcacgcctgtaattccacactttgggaggccgaggtgggtggatcaccggaggtcaggagtttgagaccagcctggccaacatggtgagaccccgtctctactaaaaatataaaaattagccaggtgtggtggtgcgcacctgtaatcccagctacttgggaggctgagtcaggagaatcacttgaacctggcaggtggaggctgcagtgagccgagatcgtgccactgcactccagcctgggtgacagagcgagacactgtttcaaaaaagaaaaaatgctgctggggagccactgaaccaaccggagacccgctggtcccacgtgaagcagctgtcctggtgtggaggtacagagctagaccagcactggtccctccagccccctggtagcctctgctgcacctgaactggcagctcttgccgctgcctttagctctgcatgtatgcgccctgaaggttctgcctctctgttttggaatcgccttcccctcctcatgtttggggacctgcaagggtgtgaggcacgtgagggcatcgccatgcgtattttacaggcctctttctctggactgtccttcaaagggaatgacctttgtctttccaggacctacccagtgagatctgcctgccattttcctatgagtcaaaaatctgaactcactactgctcctttcctggttcataagccagagtagggctggttggcagtcactggcttgtggccctatgtaattatctcagccatcacacactggctctttcacaagggctggtcacacgcctcgagtgattcttcagaaatctgttgaacagcctgacacccagccctaggacgccgtgctggggggattccccagctactgagtggggccagagactctactgcctctgtgaccacatccctttccatactggtatctcgtttgttctaatgagtgtgtccattgcttttaatagtgaattttctgagcaatgagaatttgaccaaattgaaaagggggatttccatgcatttgaaattgccatgtgtttcttcttctgatccatttgctctaagaaatatagtctaagtttaggactgagggtttttttttaacagaatactgaatgattctttgttttgatttttttattgcaatttcaaaaatatgacctgctttccacaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagtaagcattagtatgatacagaatgttaacaataggctgcgtgcagtggcccatgcctgtaattctggtactttgggaggccaaggtgggaggattacttgagcccaagagttcgagaccagcctgggcaacatggcgagacatcatttctaaaaagaattaaaacaattagccaggtggtacatggctgtagtcccagctacttgggaagctgaggtgggaggatcacttgagcctggaaggttgaggctgcagtgagctgtgttgacaccactgcactccagcttgggcaacagagaagacactgtctcaaaaaaaaaaaaaaaaaaagggaatggtagggtgtgtgtgtgtgtgtgtgtatgtatgtatgtatgtgtggatatatcgtgtgtatgtatgtatatataatgtataatttacattatgtatttttatatttttaaacaatggctctccgcttatccaggaaatccaaacatctgagaataaaagtaccatactctttgccaagtgacttgaaatattgatacgtataatttcaacatgtaaactggagacagtttttctaggagaacatctaagctaaaagcaaaaccatgaaaaaacatacctatgaaagagccaccatgctcagataaggtgcgatcagatgcttcaagattttcctattcatatgtattttctgatttttattttgttctctctcaacaccatagggaaatagttatgagtatcaaagattttaagaaaattatattattttctgctgattgggaaaagacacagttactctacttaagaattaaatatatcaccaagctcagagagagagatagtcttatctgagctttcattaggaaccactggaactagtttgttaatagctgagatcagatataatttctattgagagtctcaagcatgagtcatgtgttaagataagtaatgacagcggactgattccacgaaggctgggcttggatgttctttagatagaaagcaaggaatacttttttcatacttttaggaattgtccaatttttcagagattctgagaaaaacagaaaatgtaatgtgtgagtgtcgttgttgttgttgtttttaactggctattatcctctaaatccaaagggttaaaaccaaggtacccttgacaaccttcaggcctgcttcttcgactgctatagaattgagttggaagctgaagaacattttacgcacaaagttccttatagctgaactctgcaagaggggagcttttcacaagactgatgtcatgtgggaacggaggagtggagagcacagcccagccccccttcgggtgggggcctgtaatgcatatgcattcctcctggaatgctgtcattaggcatcattcagtggactgaaaactcccgagtctcactccagagaagctggatggtgctagaatgctgtcccgagatggacacaggggccatgcaaagccccacaggagggcccttgtcatagccaggagggcaccagccacccccaagctaaaggaagtgggcgaacagaagtgccagggtgagcagaagctcaggccagatcccatctcagatcacccgcctgacaggtctagggaaggagcgtcctgcaggcctgtaagctgtcagcaaagtgagttgggtctcaggccgtcaccagggattgcgctgctgtgactgggcaggaacacagcagagccgagctgccagcttcctgggctgagcctcaggtggggaggccaggcctgaggagcagctaggttttgcaggctctccatttgctcccccaaactctcctgtttttgtctcttaaggggcagccctgaagcacagagctggccaccagctgttcatgagagatgctttagtaggccatgtttatctcctttttatcccaaagagttttccttgtcatatttcagcaggggccattttatggtaagtccttgcagggcagcctcacccaggctctcagcacagtgctgtggaagacaccaggctccctgggggggcccttcgtcggctcttgcttcactgtagataagaaatcagaaaatccttgttgattgcatcaactcctcaggttaatttgacagtaagtcatcaggcatcatctataaagtccagaggaatctgtttgtgttgtttgaaagggcttgaaggccaggtgcagtggctcatgcctgtaatcccaacactttgggaggctggggcaggtggatcgcttgaggtcaagagtttgagaccagtttggccaacatggtgaaacccgatctctaccaaaaatagaaaaattagccgggcatggaggcaggcgcctgtattcccagctacttgggaggctgaggcagcagaatcgcttgaacccaggaggcagaggttgcagtgagctgagatcgcaccactgtactccagcctggacaacagagcaagactccatctcaaaaaaatatataaataaaaaataaaataaaagaccttgaagattgtgatgatgtagtagcaggtgatttgttccacagaaactataaatcgtgagagcctgaactggcatgccagaaacatgggattccactgctttagtgctgtttttctcctttacaggaatttgaaagggaaaaacacgcccacagtatactgcaatttcagtttgctgaagtcaaggaggccctgaagcaaagagaggaaatgctcgaggtaggtagcattctcctgcttttcttttccttttttccctttggagcattttgtcaggccatgactatcttagcttaggctgcagtaataaaataccatacacagcatggcttaaacaacagaaattaattttcttacaattctggaggctgggagtccaagatcaaggttgggttcaggtgaggcctctcttcctggcctgcagacagccaccttcttgctatatccttcctccaacggtggagaaaaagcaatgtctctgatgtctcttcatataaggacactaatcctatttgatcaggaccccactcttatgacctcatttaaccttaattacttcgtaaaaaccctatctccaaatacagtcacattgggcattagggcttcaacagatgaatttagagggacacaattcattccatggcaattactaaagttttcagttttcttaaatctgagagtttaggctaactctccatccctagatttacgaaacagtccctctcattggtgaacattcctattctttggtgatcttgtatttgtttggggaggtgtggtagacagaataatggtcccccgaagttgcctacatccagatccctggaaactgtaaatatgatgccttacatggttaaagggcccctgcagttgtgatgagagaccttgagagaagggattatcctggattatttgatggaacaagcatccttctaagaggaaggcaactcaaaggcagaagtagaagatgtgacacaggaagctgaggttggagcgatgcgagagaggggccatgagccaaggaaagcagctcagtcttagaagctgaaaaaggcagggaaacagattctccctagagccttccagaaaggcttgattttagcccataagactcattttggacttctgacctctagaattgcaagagaataaatttgtgttttaagctgctgaatttatgacgattcattacaatggcaataagaaactaatacagggttggtttttaattttttgacttaatcggttctttaactgctgccttgaagtgagaatttcacccaaagcaggttttcttcctgcacttcttgaagccggaagtaggacaaggaaaaaaatcctagaatgctgacaatgagttcagggttgatgaggtgaaagagtgcttgcggcctcactcactgtcccagctctcaggttctctctcgggctggggtttttcttcctctttaaccctttatctgctttctgtctgttcctttcctcaggaaatccgacagctacagcagaaacaggcgagttctatcagggagatttctgatcttcaggaaacaatagagtggaaagacaaaaagataggggtaggattcccaagtcttgaaaatctactcaaatgggcagcctgcttagcaaatagagttttttcagagtctttagtttgcaaaaccgcttgtctgagtatgcatgcaactcccacgtgacacaaagtcgtattaatttatttaattttattaagtagtgaatacactaacttatccaaattgatatgaacttggattgtgacacggactctccatggagggtcttgtgaatgcgtagctgtgcgctctgcctgccccgtggctgggccgggccggtggttgttgaaacagctggagtgaggaggacactctgaggaggtctgatgtgtgcaagtccagacgtcttgggattatctgcctggtggtgctttgagaaaaaaaatctaagcaccaccaggcagatatccccactttgaaatcttccccagggaaggtctccacatacccttctccctccacaagaagaaaagaggcagttctacacttagaattgaaggatagggggaacagaaccccacaaagtagttgtcatgattggtaacaacaaatggtttccccaaaatggtgattcctacacatagctctaataaagacgtcgagatacctgcacaaaccatcggcacgttgactcaagccacactgtgtttccactgtcacgctcatcagcacttaggagtgtgtgtgtgtgtgtgtgtgtctgcatgcacgcacactttaggaccacttcatttatctgagatgatggataccaagaatcagtgtataaaaatagtctaaatggctacaacagccgtcctgggaggtgcttaagcaatcccttttctttactgacccctcattcaagtggagactttgcgtaactctaacgcagctgtgaacacgcagacaaagctagaaagtgatgcaaatatagtaacctctggggccccgtgctgtgtccgtgtgcttcaagatgcgcatgtctttcatggagtatgaacagtaacatttcttggattatatatactaagcgaaaagcttaatacttggattttgttagtatctttaggcagagtctctttaatgtctagagtccactagtgttttagatggtagaagcctccttctggttcctgcttctgaagtaacttgctcatctgtgcaaatcttcttctttctcttggctctgctgcacactcaggcattagagaggcagaaagagttctttgattccgtaaggagtgaacgggatgatcttagagaagaagtagtcatgctgaaagaggaattaaaggtatgaagccaaactacagttttatttaaaaaaaaagaaaaaaaatccaggtgacaacagcaaattttgggatgctgtgaatatgtgtgtacataattcattttatgtcatttagttctgttaataattcatatattgggttaactgacagcgatgagatgtaaaataaatgtaggttcagtgggtggtgcccaaggccttttgatgttaataaacatagccaatcttgaatgcaagaattttttgatacattatctaaatttttctcatactcactagtaaattctccaggatattactcagacttagagaattaatttgcctctttatattaaaacccccaatttaaggacttctctagaggaacagtgacttgggtaagtggtttgggcaaggatcccgctaattagactttgagacctactagattacaggtggaagacggttccctgtccttggtgggccacgccaaggcgtcttcagccgctgcttgacacaggtgaagcgccagtggcagcactctgggtgggggggttcctgaaccgtcaccatctgctgcttggcctccagggtcaaagccagagcagtgagccagccagctacaggcttagagctaagattcgtaattctgctccttgaagaggcgatcagttcaggggagttcctcacacacaagggagagagagccacaggcggcaggagggcatgggtgagtgatgtctgcagttgggaagtgctgctgttttcagtgaattctgtttcttttgaatatactgaacattctagccacctctgaattccttctttaacataagtttcgtgtgtctctttcagaacatgtatatatttctttctttatctggtttctctttttaaagaatgcaatcagggttttgaaatgaaaggtcacttggcagtgacttgcttactgctccacttgggggcagcccacaggccactacctgtagttaaaaaggatgcctggtggaagtagcttgtcaccagcaaatgaaagcatggattggaacatctgagaaagaagtagcctttggaggacgatatcccagatttgtgtgtgttgaccgaatatttacgagtgctgcaccctagcatttctcttgtctctgtggagttaccctgtacttcaggaaaaaatggttttcttttttattattgtattaaaacagagtttaacctaatatcactgagtaaatattacgatgagcctatttttgttcccagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggtaagtatttgctttccttcggctcctcacacctttccactcagcattggttcaccctccatgcactgctggggttggagccaccgtcgctgatgggttaacagtcaccagcatgccatttgtttcatcacttcatggtaatttccttgcccacccggtgtggtcacccacgtgttgtctggcatgcatctctgtgtagtgcaccatcaatggctcaagtgaaccttttcttttgctgctcaaagctaccaagcaagactgtgaaggcaaaaggaaaacagtctcaaaattaagtaacaatgtggagagtactatttggttttcctcagacacatatatatctgtacctataaagtgtggctttttaaaccgattctatgacagaattatcaaaagatcagaatggttgaggccgtcaagtcagttggccatatttgcaagccaacatcgacatcctgggcagcattcagcgctttgagggtacggggtgcctgtggacagcaggtccgtctgtgttgcctttttcaagccaccgctcgaggtgggcaggcggccgtggtagtgggtgtggcggtgctgagagtctgagtatgcccacctttgtcagaggggatcctcctttgtatgccacgtgtttgcttctgaaagaatataaaactggggaatccagtagatcagaggaatattttataccattttcaatgatctgatttgtcataatttgtcataagagttggctttgggagaaaccttcagattctggcgtgcagcctgaagttgcagcgtgcaagtgaggcctcatctgtcactggtcaccctctgcgttccagtgttttacaaagaggctggaataaggtcagggtccgtgacttttcattttaatgtagaagctttcatcttatttctttttatttatggaaatgtagacacctccaggccccatcttctcaggcctcgcattccagggaggtacctcattcattatctttatgactattaaagaaacacagctcttttcaattgtgtaaaaaaagttgtggcctagtgcagtggctcacacttctaatcccagcgctgcgggtggccaaggctggaggatcacttaagaccaggaattccaggccagcctggcaacctagcaagattccgtctctagataggtatgtagtatctatataccgttgttgagaaaagataaattaatcaatttccatcatacctttatatgagctacccgaacagctaggaatctgattacgctgctcttactcaaatacacattttataaatctttgataaccattgtgaaatgttgtaagaaccagaaatgtcagttttgaaagtggccttcaaatgacttttgatcacatattccttcagcaaagaattgtaggatccaatatgtatgtttattttaaatctacatatgtatactatttcattaatataaaatgtacgttataaaatatatgcaaagatatgcaaagaagttttagagtaaaactctaaatagaattcctaatatttcccccattttccctgggatatgggcaccccaccatggagatcactgggctataaaattatctagctttgactttcagtaacatagtaccatatctaatctgctggggttttgtttggagagtccaaaaattccaaaacagtttgatgttctttagacgatgaataatttatcatttaatttagtggtcatcttgatcttgaacatttgcctcctgctggtcctctctccctagtcccttagggaatggagcagaggtatcagggcatggacacagggtgttttctcaggaaaacaatagttgagtggcagaagatagatttcctttcatatgagctatttcaaaagcatcttccttgagactgaccttgaggctgcatttctaaaagtgcactgaatattctttttaaaaattacttgaaagctgcttttagggctgtgtgacatggagtgcagtttgacagctgcaaaagtacaagttgtcaagttgttcattgagaagtgagagtggggaattgaaccttcagtctgttcctaaacccatcattgtggattgtttggctgcctgatccagagttctttctatttgttgaaacttaacgtcacctttaaaaatctgtccacacaagatggcaccagcagccactctggcctttgatgtggtggcagtggccctcactgacccaaaatttactaatgcaactgctgctttgccgcacagaactggcaaaggcttgtttctcatgactctttgatgactctgtctttaggaataggggtgggtgggatttggaacgtgtgtttacattctaatgtagattatgtggccgccacatcatggggtcccttcaattttctcaatggtcttttaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgcaagcctgtggttccactctttgggctgcttgaagtctgagtctgactactgttgtatgtaataccacctttgagtaatatctgcttgggggttgctgattcctattggggttccgtggaagacccacgcctgatgccctccctcagtaaggaatgcacttccctcctggcatcgagcctggggctagcatgggcattactgggagaactgagacgattgtcacgcaccatcccctgtgatctgtggttctgatgtgcagcctcagctgaaaacggtcttcacctgtggctgtgcttacctgcgccactacttacagtgttttgaagagcaggatgaaaacggcaaaaaccttgactgtttctgctcaagtgtcctgaagtagaggatggtggggatgataaatgcttgctaggaaataagtccaagggctctataggacttcacagggttttagtttatgtctctaactttagcaaagctgcattcctattggaatgcatactggaaacagctctcattcctacctttaaagggctcttggaaagcagtgtgacaaccaaggtcactaaatggtgagatcatcaagccattttaagttctttctcatgttattcaccagcaccctgcaggacgttgggcacacatcacatccctcagctcagccatccagccgtctcagtgattcaccactcatttgcttaattaatagacaggtttgatcactttgtacatggaaggcactgtgccagtgaacaagcagttggacccagccctccagtagggaatggacagctgaaaatccatgagcaagaaagaaggaaaaagaaagagttctgagcagccaaaccatttctcgatgatttcagagccttcattctgagcatcagttatatgctctccagtgtaatgactttatagccaagcacagtaattgatattactgtgaaggcccttaacttatcaagaaatggttgaggccgggcacattggctcatgcctataatcccagcacgtgggaggccgaggcaggcagatcacttaagcccaggagttcaagcccagcctgggcaacatgatgaaagcccatctctacaaaaaaaatatacaaacaattagccaggcatggtggcatgtgcatgtagtcccatgtagtcccagctacttaggaggcagaaacacctgagcctgggaggtcgaggctgcagtgaattgtgctcacaccactgcattccagcctgggtgatggagtgaaaccctgtctcaaaaaaaaagaaagaaaagaaaaagaaagttgacttagctatactccatataagaaggtatagaaatatatagagcaatttagaaagattatagtgtcaaaagattcaaactcagaaaagaattgaaaggttgcctgccagccatatccccagacgaacctagaccactggggtttcactatcatacagaatagagaaaaacattggttactgacacctgaaatcaaaaagcttggatatttttcagtcccaaaccagaacatagctcccgtatataaatgtaaatcttccttcaaaagtataattaagtataattatgggtgtatgtcaaaaatatagaggaagatggatttttacttataggttgttatacaaagttgggacagcaatcaaatttttaaacagttttcaagaatgtatgaccttaaaagaaatgtgtgaccctgatcactttccatatttgtaattaaccggagacctaatggtctgaacacttaagtttccactatcactaggaccctgaatgctaattctggggagtttagatggtttggggctcctgttttctattcatagactccctttctgggagaccaccccccaaccctgtacagcgtaccacccgtggccaccagccaagggaacacaacagtaagatttgttctaaacgtctgggcccctaagggaaagggaggggtgtttgtgtgtgcatgtattatgttcagaatatgtacttgttcagtgtgatagttgtacgtggagaaaactttgtctttcaagaggaaaatccttttgttctttttgtccctatctactgcctctcttaaatatttttcaacatgtgaatggctggtggctgatacagggaaaaatttcccagctatacagacactataagtctaccggtgatgtgccactatttattcaacaatatagacttggtggtttttaacgctacgaaaactagtactctttattttcttcatgtcaaattattttgcttcatttctttttccattttcttcaaactctttcgttcttgttttcttgtccaagtctcctttagaatttctcttcctgaaaagtttcttctctatttataatgttctcactatacaactaaatgtcagattacctatatcaattttgcttgcactcttattacattttaacacttattttctagtgcttatgtagaatatttgaagttttctagaagaaaacaataacaattgtacaatagatacttgagcttcaagatcacattctggtgtattcagtgtttcttatgacgcctgtagtttttgtatgtaggagtattaaaacatgtaagaaaatgaaaagtgatattgggcaaaagaatcaggttcataactgcaaaaatgttttgtttcaatgttgggtgggttatgggggggagcgagtaaaacatctgtcagaagtaatttgactgtaaattaaaatagaactcaaaaggatgataaatttaatttatattgtgcttaacattatctggtgtttactgtgcctttcaaaacaacttaggatctttggaaaacataattagagaaaaatgtaacttggattagcatgtggctagatgattttttaaatgaaaatgaagatgcattttatatgaattattttcttttcacatggctaatcaaggttagtttttcattctatgaagaatctggaggtaggccgcatgacagcagtgtcctagtgagctaagagctttgagtcagggtctgactcgggcgtgtgagtttggatctggaaaaacagcgggtgcagtgtttaggggagtgttcccgtggctgggccgcaaggcctgaagaaacttgcttagtggttctgggcctctgagcctcatctatagaaggaggctatgatgaagcctacccatagggcttctggggctgaaacgagctaatgatgtcgaagctgctagaactgtacctgtgtcagagcgagtgtgcagcatacgttatcatcactgtcatcactccagcattctgactgtgcctttaaactagtgtgggattttgcccaaacctctaaaccctcccctagccgtggtttcccccgcagtctgaagactctaatacttgacactcgttcagagagatgtttggggaatttatagacacttaacatttatgcatccttatatatcgggtccaggaggaattacagacacttaaaccattactgccttcttcctcaaaagaataacagctttggtaactgggttagcagaggtgttagtggacttagggttgtaaacagatactcatggcactgacatcgatgagtctatgagggaaattagaaagataaatacatctgggatgtaaactcggaaaggcgaggctgttcaaaatgttggtgctattgaattgtgattctcggtgtttgtacattgctaataatgttaaaccatgaagcctgtgagatcttgtgttgcagcgtggtttggccctagcgttcttgcatgctaacctaaggtagaagattagcagcctgtttgcatgcagccggatgctgcccctgacgtgaagcatgttctgggaggttgacccaacctcctttggctgtggcctcattcaccccgtcctgtctgtggcctcattcaccgtggtacgtgtataactacttccatcattcatttcactaacctgaacgatcattcttcagtttagcaatgtgctgaaaggcgcggcacgcggattcacctaaacctgtgtctttgtgatttctttagatattaggttgaaaaagctggttgatgaacgggaatgcttattggaacaggtaacaatctttttattactttaccggttcatgaacagggcacctgaaaccacctgcccatccttccttcttgcttactcagaaaacccctaagttaatcatgtctgaaagtctttatcaagccaactggtgttcttaagattgctatccaaatagaacatcaaagttaatattttcatccaaagagaacatcctgagtcatatgaggtttaataaggatgtctcaaagacccaaagccatggaattgaatttggtacattttactgaattgctgcttaaaataaatataaatgttgattattaataatattaatgattaactgttgagagacaagagcattactgagtcattccaaatagcacttctcttgtccatatgggttgtttgtccataaaagtcagttttgtactcttggtgatcagcacccctctctcacaggtgtttctttgttacagctaaacaaagttgttttaaccatgtttatcttcattgctctctcctacctcaagaagtagcaggccaggtgcagtggctcacacctgtaatcgtagcactttgggaggccaaggcgggcggatcacttgaggtcaggagttcaagagcagtctgccaacatggtgaaaccccgtctctactaaaaatacaaaaattagccgggtgtgatggtgcgcgcccgtaatcccagctactggggaggctgaggcaggagaatcgcttgaacccgggaagcagaggttgcagtgagccgagatcgcaccactgcactccaacctgggtgacagagcaagactccatctcaaaaacaaagaaacactgaacagttatcctatctgatctttttatatgcaggatagtgattaaatcactctacaaccactttcctctaatttctcctcataagcctaatcaaatgtatttgccttacttcctaccattctgttgaagattctccgaaaattggagaaagcactaaatatggtaggaagattctcttgaagttcctgtgatcttttgaaactgcattcctgagttctatccttacttccttaaagcagcatgcacttttggtttgttgttaatcaggggtctcctgtgcttggtgtgtggggtaggaaggcaggtgatcacctgcaacaattcttcacagattggaagttaaacatgaaaagcccccggagaccccacgaactagatgccagaaagttctgcagtcattgactgttaactgcaattccaactatacggtcagccctccatatccatgggttccatatccgtggattcaaccaacatggattgaaatattccaaaaaaaaaaaaaaaaaacccataaattccgcaaagttccaaaaagcatagcttgaatttgccctgcacggagtcctgcactgaatccacacaaatgaagtgagttgtaggcgttgggtattaaaaggaatctagaggtgatttaaagtgtaccggagaatgcaggtaggtttctgcaaatactgcaccattttatatcagggacttgagcatccacagatttggtgtctgaggggtcctggaaccaatccccccccccccccgcccagataccaagggacaactggacatgtttctgtcttgcttagagaggggaaagctagctagagaccaactccctgaaagctggcaaaccgcctctgaacacacctgcagctggcctggacgctgagaaagcactcgacttttgggggacttaattacaatatattggagcccagaaggctccaagtggccctttctggtttcttagtaaataaagagaaagtgaatagcatggtgacttactgagtcttaaacattgcaggtatttcatgtacagtctcctcctgagtcctagaagaatttcactttagaaatgacttttctctcagagttacagtgtaattcatttttcattcattgtacattgaattgtgtttctgagaagagtactgatggacacaaagtgccttctgtcatttgacatgctgcttcctttctgatgggctctaacttcagcttttcggtctcattcagagtagagaaattaacagattttactggcgggtgttttcagattaagaaactcaaagggcagctggaggagagacagaagattggcaaactagacaatcttcgatctgaagatgatgtcttggaaaacgggacagacatgcatgtaatggacctacaaagtaaatgtcaattcttgtgtagaagtaaatgctttcacatgtgctgttttagtatacttgtgctggcagagaaaactgtcacggcaaagaatgccctcattccctcacatccccacaaaagcccttaaaaataaaagcacaaggaggggtaggtagacagaacaatggtgtttctctctgagcctatgaaatagaacaggtacccaaaaacgtgcaccaagataccaccacatgttgtgccgatggaaaccacatttactttgctggatacagcaatctttcgatctgttgattgtatgaaaaaaaaaaaatgaaaggcttttttcatgctaataaactagaaacagtcttaagggagataaaattatgcccagtctctctccgcccttttccctaccccctaccatctctttgtcttcttcactcataggcactctcttgcctgaggtttcctgccccaagcacaggggcggaaggcactttccctgggttcatggggagagagtgccttctcctactctcagctctgggaggttgtggaggcagggccagaactaacagatttgtgagatgattacaaagtaagggcttggttcccagtaactattgttttaatatttgaaaagcccaagagcttaacagattttccttctctttcaacctttaggggatgccaacagacagatcagcgacctcaaatttaaacttgcaaaatctgagcaagagataactgcattagaacaaaatgtacgtgtaagcaacaacgggcagaactgatgattgactggagttttacttgctagaaatagccctgaaaggctgaggaccagaaaaagccgagatttttagaaccaagaaatgtcctaagagggataagttaagacagcaagtctttccatccgtttcttacagagcaagcaggaaggaaagaattcttagaatttaagttgttacagtagatactaatcctttatcaacaacagttagttgtagaaaatagctaatgtggcttgggagtgttttaaaattttgttctttaaaattaatttagttaattggccgagcgcagtggctcacacctgtaatcccagcactttgggaggctgagatgggtggatcactgaaggtcgagagttcgagaccagcctggccaacatagtgaaaccccgtctctactaaaaatacaaaaattagccgggcatggtggcaggcgcctgtaatctcagctactcaggaggctgaagcaggagaatcgcttgaaccagggtggcagaggttgcagtgagccgagatcacgccactgcactccagcctgggcaacagcgagactctgtctcaaaaataaaataaaataaataaataaataatgtagctaattaaaaaaacacatcatactgggacgtccctcttgcctgggcttttagcctttctcttgcagcgaggcccgccctccctggtgtctagacatggggcactcctgcctctagcaccctgggccctagggcaatttgtgttctagccagaaagagagaaaaaaaacaggactgtttccccctccattgtgggtgtacttggctggaactttttagaatgtttatagaaacaaaaatgagaacagcacaggtagagacgatgtgtgcttttgattgcggcagagtgaaggtgtccagcaggccttcgctgctgccgtctttcatctcagaaccttggctggggaatgccatgccgaagccgcctcctttcactcctcgccctgtcctttcctcctcccacccccgccaccccaggagagattagactggagctgaggtcgtggcggaacacgtcccttaccagcaccattctgcctgttccaacagaacagccccacgcagcgggagaagaagcaggcagcaaggtgccagcactgcagaaaccaccctggtggacggggtcagaggaaatgggtccccatcatgtcagcacagggtcgcccagaaatagtaaccaagaatagcttgcttggctcaaacccacaccatagtccaaaatgttataagtatttacatggtgtattctcccattttattaaatcacactctttgatctcaaagtaaagaaactgaagaaagaaaacaggcttatcaatttatacatatggttttttttctaccttttaggtaataaggttagagagtcaagtatcacgttacaaatcagcggctgaaaatgcagaaaaaatagaagatgaacttaaggcagaaaaacggaaactccaaagagaggtaaatttcctaggcaatttctaggaagagaatggctgccagtatttctctagtggggacggtacagagaggatttactactgtgacatctgcccctgggctggtcattgtcagatcatcccacaccactctgcagtgccggtgtcttaataaaggaaggcatggcgcagccagttagggcttagggctagacccttgctggcatcaactagttcatctgtcagttttgagcatctcctataggtcttgtccgtaaacgtcaagagaatgagataaaggagtagccaggcctcttatgctccgaatattttttgtgtcatgcagaatgagcccaggtggaggaccaggagcccatgggcctgctgtggccaagagctgggtgtggcaccagggccaggccacagctgtctcaggtcaccctatggagagtgcccttgagaagccgagctgctgttactccacctgctggtcacactcccaaattaccatgcttgccaattaaaacacatactttaccttactgaagacacttggcaaagttgtttgttcaacaaatatttacagcacccgttgcatgccgggcacgggttcaggtgctggagatgcagctgtgaccttacagacaggagtctccgcctccatagagcctgtgctctggaagagggaggtccataaaagtgaccacaggcaggagaggggctggggtgcggaatggcccaggccagggcagttctaggtaggtggccaaggaagactttccttcttgtggcatataaggacaggcctgaacagcccagggagtgagccaggcagaactgggagaaagccttccgcgcaaaggatcagcacgtgcaggggagctcggggcaaggcactgcctttgtcaaggaacagtcagagcggtggaggccaagtgagcagggggtgagggggtggagggagcagtgagagcacctcagcccgtgaggcagggccctggaggccatggacaggacttgggatcctcctgtgcataaagtgggagctactgcagggttttgagcaaaggagtggcttatgttgatttatgtttcaataggatcactcgggccgggcgcggtggctcacgcctataatcccagcactttgggaggccaaggtgagcaaatcgcttgagctcaggagttcaagaccagtgtgggcaacatagtgaaaacctgtctttacataaagtgcaaaaaaactaattagccgggtgcggtggcccgtgcctgtagtctcagctacttgggaggctgaggcaggaggattgcttgagcctgggaggtgaaagctgctttgacacatgagcgtgccactgcactccagcatggggcgacagagtgagaccgtttttcattaaaaaaaaggaaagaatcactcattttatatttaaactgtaggaaagggactgtggaggagaaaccaaagatgccatttctctcctctttattttatttatttatttattttatttgattttattttatttatttatttttttgagacggagtctgactcttgcccaggctggagtgcaatggcgccatctcggctcactgcaacctccacctcccaggttcaagcctcccacctcagcctctcgagtagccggaaatacaggcacccaccatcatgcctggctaatttttgtgtttttgtagagacggggtttctccatgttggccaggctggtcttgaactcctgacctcaggtgatcctcctgccttggcctcccaaagtgctgggattacaggcatgagccaccatgcctggcccatttaaccttctagcctacttttgctatggtcagagaacatggtccctgttatacctggtctttgaaatttgtcaatacttgcttaatggcctgatacatgattcacttttgtaaatgtctccaatgtggttaagaagaatgtgtagtctctgatttatggatgcaaaattctgtatacttccactgatcaaacttgtgaagtgtgcattcagatctgatttcttttgtctgcttaaattctcagtagctgatagagatttgtcaagctcttccaaaagatgatggtggatttatctcattctccctatttctcctatatatgttgaggctattgatactagatgtttaaaattctgatatcttcttgatgagttaaaccttttatcactttgtagtgacccttttggtccctgctgctgttgaccttgtcgggtattcacgtggccgcatcagctttcttttggttagtgtttgtccacttctgatttttgcatcccttggcttccagtcttccgtgtgttgttatgcgttagatgatctccttcagatgcacatagctaggtggcggtggctcttagttgaatctggaatctgtggatcttaatagagcccttagtccattgttattggtatatttggactcgttttcaccatctgactgtggataaccatttgttctgtcttttgtgtgtcatttttctcttgccaaatttaaattttatattcaatttctattcttttcagtgatcacacatggggtatttttatttaacttaaaaaaaaattaaagttgaacactatctttactcccctcctataaaatagaaggacttttgagcactttagcttcaccctcctgcctggcatgcacaccctcacacatatgtgtatatgtgtatatgtatatgtacacatgtacatccacacataaatacttttgagcttcataaatcccacttatcagataatactattgttgtgttgttgttgctgttgttttatattgcccatgtttgtttgacataactacatattggccattttatatgtctgtcctgctagtgtctcagactgtactagaatcattttcctcctcactgaagtacatactgtagaaattcttttagagcagacttcttggtggtgaattccctgtttttgtttgtacatgttttcgtttcatccttgttcttggacagtagtattcagggacatgcaattctgtgtggtggtcattttcctcaatgattatagcgattatgccaccatctgctggcttccattgagctgttgagaaagttgttgttttaacggtcggtcctttgtagggacctttttttttcttctctagtttctttcaggttctgtttgtctttgattttctacagttttactgttagatgtagtttattggaatctttctgcttgagatatatagtgtttcttggatctgtgaagtctttttaaaaattgattttggaaaatattcaaccattaactccttaaataattcctcttttttagtctctccactttcccctctggaactctaatcagaggatgttagagattctcattgtctccacattttttaaccatctctctttcatgttttctatctccttacctctctctattggataatgcctaaagtttttgcaaagattttccagttcaccattttttttaaaaagtgtcttcattgttgatagtttcttgctgcatgttcatgtatgtcctctttttaaattgtattcttattctttaaatatttcatacacagctgtttggttttctgtatctgacaactgaaacatgctcagtctttgggggtctaattctgtcatttattgcttctgttgactctcactcaaatggtttgtcaccttagtgttttgtgagcttatgcttgattttaatttgtaggaataactccaggcttaacttgtggaaacttcctgcaaaaagggcttgcttctgcctctgctagtgaggtggggtcgggacttctgtcccaggacccaaacaagcttccttgagtgttttgggtcgaaagcagagccatagaccctgttcttgtcacccctccaaaaccacgttctcccagcttagggcaccccactctgccctgctgcctgtgggtccagatgatgccctgctaatgtggcttctgcagctcgtcttctgcctgactctcaggctccatggccctggctcccaggtgtggccgtcttggcctcaggcattcctgccttggactctggctgccagggctgtggggaccaccttcgccatgcagtccaggctcagctcttgttgtttgtgtttgtttacctcatgcctcacttaccttttgtgaaaccatcaggatccccactgggcgtgtggctcacgcctgtaatcccagcactttgggaggccgaggtgggtagatcacctgaggtcaggagttcaagaccagcctgaccaacatggtgaaaccccatctctaataaaatacaaaaaattagccaggtgtggtggtgtgcacctgtagtctcagctactcaggaggctgagacaagagaattgtttgaacccagaaggcggaggttgcagtgagccaagatcacaccgttatactctggcctgggtgacagagcgagactttgtctcaaaaaaaaaaacaaacaaaaaaagaggccgagcgtggtggctcatgcctgtaatcccagcactttgggaggccaaggcggacagatcacgaggtcaggagatcgagaccatcctggccaacatggcaaaaccccgtctctactaaaatacaaaaaattaactgagggtggtggcgcacacctgtagtcccgggaggctgaggcaggggaatcgcttgaacccgtgaggcggagcttgcagtgagccgagatcacgccactgcactccagcctgggcgactgagcgagattccatctcaagaaaaaaaaaagaaaaccatcaggatccccaagggtgttccctctctggagtccagttgtttcagaggaggaagggcatcatgagggaccaggggccaagttatcattttatttttcagtaggattggaatttcggtaacacagaaccctgttatgtttggaggaaacaagttccttaaagctcactgcctttcctccgttcccagctccgctctgcattggataaaacagaagagctcgaggtgagcaacggccacttagtgaagcgtctggaaaaaatgaaagcaaatcggagtgcactcttgtcccagcagtaaattccagctctgatcaggcaactggttggtgactggagagcattgtttcataggcttttctctgtcctatctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttcagcaatgtggttctaatttttttccactgagaaagaagatctttaatttcatattaatggttctgtatattttgggtcatctttttattttttaagaatatcaagtcaattcatttttctttccctatttaaaaaaaaaggtgttttcacagaatgagtgcacttaaaaagtgaagtgaaggaggaggtaacagtagagacgatggcaatatcatcaaggacaaaagtaaaaacgtttagctacctgctgatttttagtgactgttcatatatgttgtatttcaagtatggctggtgaagccagtcagcttttcgggacgttagcaagtggaaactgagtcagtatcatccaaaaccatatctagtcttaacacatggagaatgctggagtgagggttgtgagttcagggtatataatcaagaaaacactcccagcataatgctaggggtcaccagtgtccatcccccagaactgtatggatctaggatatacacagctgcgttgcattaagaaagagatgaaatctctattaaaatacacaagatttttgtatctccttgtgcagaggatatttgccactgcccattgggaagcagacaagttatagggggctgggggccaacactggcaagtaggaaaccacgggtcggacaggtgagcaaaatgtgctggcaggtgggcaccactgggagacccacactgcacacccgggcaccgtatgaacaggaaagaggaaggaagctggacgaagcccctcagggaccctgtgctgaccatgctgggcccaccggcaaaagggagatattcagttccttgtctcatccttaaggtttcttccacaacatctgaatacaagcatgtttaactgggaaaatgtctatgtcatgcgtgaataacaccagcagcaaacactcacacatcacgcagacacggccggcagcatgctgacgcttttaggtatttttcactcatgcaattttcacatattttcactcatttcatttgcacggaaattctatgaggtagatgctgttatcaaatccacattacagatgagggacccagggtccaggaaggtgaactggcagaagtctcccagctggtagaacagggctgcaaggcatcgattcccaggtgtctcacagccctgagaagatggcgttttccctatcagtggctctgaggaagtcaagccttcagtctctacctctcccaccaattcttttggaaacagcaaaccaatgttacacacacttcctaatccagaggaagctagaacacgatttttaaatttatttagtaaaataaaactttttttgcagatgtaacgaa

SEQ ID NO: 2443 - DNA, 67504 bp, Homo sapiens
tttactgaaagaaaaaaaaatattttttatttcagttaatcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaacttatggtgcgcccacacactggagtactgtgcagatccaaagggactaaacaagagctctaagaactgcgatggagtcatttccaggatccactgtgaagcaaagggagcaaagcgcaaacatatctactgcattctaccaaagaaagaagggggggtattaaggaaggacacaccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgtatttttagtagagatggggtttcgccatgttggccaggctggtcttgaactcctgacctcaggtgatccacccacctgggcctctcaaagtgctgggattataggtgtgagccaccatgcctggccctaaatgaacttttaagagcactgaagatgggaaataaagggtctttaactctactgtaatattctagttctttctaatggaaattacttgaagcaaatatagtatgatgattttcaattctgtgcaatgaaaggcacatgggtgtttgttaatttgctggctgctacttttataattaaagacaaatttcaaaaaacccacaaagaagcctggattgtgctgggtgtggagtgcaggtaaaaatgataaaaaacgtggatggagctggagtccattgtcttcagtgacacagctcagacacagaaagtcaaataccgtacgttctcacttagaagcaggagctgaatagcatgtgcacatggacagagtgaggaatggcagacactggagagactgggaagggtgggagggggtgagggatgagacattacttaacgggtacaatgtccactattcaggtgatggttacactgaaagctcagacttcactactatacaatatatccacgcaacaaaactgcacttgtaccctttaaatttaacaaataaaaaacaatgatagaaaacaggtattccaaatgagtttacccttagcccagagggcctgcccagtcccagggtgacctgggcatttgcacaccctcactaagccttcactgcaggacccaagggagggaggctgggctagggtgccaggtgactccccaaggctgtcccccagggggtttatggtgtttgccgaaacacaaactttttcaaagaaacctgccaggtgtggtggctcatgcctataatcccagcactttgggaggccgaggcaggtggatcacctgaggtcaggagttcgagaccagcctggccaacatggcgaaaaccccatctctattaaaaatacaaaaattagctgggcatggtggtgcatgcctgtaatcccagttactcaggaggctgaggcaggagaatcacttgaacccaggaggcagaggttgcagtgaaccgaaatcgtgccactgcactccagcctgggtgacagagtgagactccatctcaaaaacaaacaaacaaacagaaaacaaaacaaaaaaaaccccatacacctctcttcatcctccctctaatcagaaccccccacacacacacaatcttgattatgaggagaactaaatagctagttcacaagttcatacattttacagttgaagtatcctcagaaaaaccacctattcaactcctgagtgttacagatggaaaaaaagaagttcgactagacagaggaacttgtctgagatcaccgtgagtcaaaaacacacgtgtctgttcaccaactgccttcgtcctgagccagatcctgcagcatccttccacctccaagaactcacagtttggaagggaggacaaataggtaactacaacatagttccagcctcccttccccctgaagaaagcttgctccaggcacagcggaagcacaggggtgtggataatgaatcaggagtgagtgggctgtcagggcttatgagttccacaggtgggacagagggctcagggcatgccaggccagatgggcagaggcggcactatcaacatggttatagctcccaccctatcacccgtgtgacgcccctccctcgaggaaaaagtgaccaatgatgcccaccctgtgtcaccagaggctctgggcctaaccctgtcaccccctcccaccttttcatttggagaactttcaggttcatctggagaactttcatctttcaggttcagttaggatggcacttctagaccgggcgcagtggctcatgcctgtaatcccaacaccttaggaggccgaggtgagcagatcacttgaggccaggagtttaagaccagcctggccaacatggcaaaactccgcctctactaaaaatacaaaatatttgccgggtgtggtggtgtgcgcctgtggtcccagctactcggggactgaggcatgagaatcgcttgaacctgggaggcggaggctgcagtgagttgagatagtgccattgcactccagaccaggcgatagaacaagattccacttcccaaaaaaaaaaaaaaaaagatggcacttctgagacaccttccctgctcctgcctccctccctgctctatgagccagggcacccgagccctcagtgtacttagaacaccccactgtgcgtgccaacccccatctccccgctcaatgcataatgccaggcacaggtgcaacccttactcaacacatgctggatgaataaccacaacacggacgcagcgctccacgtgcttcttctgatggctggagaccttcgaccgtaagcttctagcaaggagaggctagctcagtgctgaaaaaaaggtgggctctgaattggtgaataaacaaatgatgagtttgggacatatcagtagtccgttggacactggtggcttggagatggcggaagatgaggtggaggaagtcactgaggagggcctcagtgccccagggacagtagcatggaggatggttacgccagaggatggatcgacttctagccatgtggtggtcaggtatgcagacacctctcctgctgaaacaactacaactgccaaactgagtatcttacagaagctgctagagaagccacccacaagctggcaagaaaggaaggaatacacaggctgaagagcaaataaaagtacggggcccttttctgtggagaaatctggcaggcaccaccttaacacacgaccaaactgagctcaggcccctcagtgctgctgagatgaaccagcatcacgagtaggagactgaagcttaccgtgaggagacagcaggaagagtccagagagggcgtgccatgcaaccacggtctggactcaagatgatgagagaaaacaagggggtgggggaacatttctgataaaggagactgaagggatgacacaatcgaatacaacacacagtcctggactctgcattccaggctcaaaggctctaaaaaaggcatttatggggtatgtggagaaatgtaaggttctgtgttagctcattgctaaacttcctgagtgtcttaactgtactgtctgctcttaggaaaggcatgcttaaacgtttaggagtgaaacagcacgaggactatgactaactctcaagtgatcaatgggctaggggaaatacagtgccaatatggtaacatgtttaaaagaagggagatgacatcaatataatcagaagctatgccaactgacagtaatattttgaagcagtggtaggcaagctttttaacaattaaagagaatgccttcatattacacaaagacattaagaaaaaaagctgaaggctgggcacggaggctcacacctgtaatcccagcactttgggaggctgaggtgggcggatcacgaggtcagttcgaggccatcctgaccaacatggtgaaaccccctctctactaaaaataaaaaattagccaggtgtggtggcgcgcacaaagggaccggggcggtgctggcggcgatgccaacagacctcagtgtactgtggggttctttcagccagaactgttcatggtttcatcagtgagctccagttaccacaccacacaagtttggagtgatccaccccgccccagtttttcctgcacgaactcatgtttttattgtgtgatttacagaacacaagatctttttctaagaatgcacacatcacacgttgaagcagaaaggcctttacaaaatcttaaaatacctacaaaatatgaagtaaggctcttaagaaataaaatattcaatgattttgctgctagaatgcaaacattagatcaaatccttcatttgatctagcaaaggaaaattagagttgcaggaatcttgttttcaggccaaaccatgacatcctgaggggtctgatggcaggaactgcctgcattttcctcatgaatgtgacctgcagtgatcttgtgagaaaggcccggaaggccgtgcaaattacaggggtacaagcaacagctggcaggtgtggccagacaggcaactgcagttaaggaaagactactcaatccctgaggttttcagattttacaaaaaggcaaaaaagccaggtgaacaaggcagatgaaaggtatttttcacttgaattggaatccagccccctccctgtcccctggagtgagctccagagaaacttccagagccccagcaatatcccaacctttcgtaaattcactcatgctcgccactttcaggagatggcatttctcagcacctttcacttccagttatccctcggcacagcacaaagagctaaactaccactcgaggcagttaacctaagggcagggtggtggctacagctccaggtgaacagtctgggaccagaggaaataatgagcccccccttgtactggctgcttccaccctaaagtgtcatccagatggtgtttccaattctttctacttccagtattagctgcagaattacggaatcaaggaggcttctctgcatgaatcaataaaggctatagcactttgagacacaagctttggccctttaaaaatgtgagaaatcaaactggcacaggcagagtgtctcagtggtctccagggagcaagagagaatgaggttcagcttgaaggctacaagggtggagcctgaggttcagctgccctgctctgaattcgcagtccatttcttaatcctccacttttgagaagatgcgagaaaccagttatgttttgctaagcttaaataaaatgcagttcttgccaaccaaaagcagaaccctccccaaatacaggcaaccagtgccatacagcaaatctcatctttatagatgtgtaaaatgaaaaccgaaacacaagcccaccacatacaggttaaaaaattcctgctgtggagaacagtttggcagtttctcaaatgttaaacatggagttaccatatgacctggcaattttactcctagccatacactctcaaaaagccacaactatgccgggtgcggtggctcacgtctgtaatcccagcactttgggaggctgaggtgggtggatcacctgaggtcaggagtttgagaccagcctggccaatatggcgaaaccttgtctctactaaaaatacaaaaaaatttagccgggcatggtggtgagtgctacctgtagtcccagctactcaggagactgaggcaggagaattgcttgaacctgggaggtggaggttgcagtgagcagagatcgtgccactgtaatccagcctgggcgacagagcaagaccttgtctcaaaaaaccaaaacaaacaaacaaaaaaccaaaaccagtaaccaaacagatatccgtacaccagtgttcatggcagcacagtttacaacagccaaatggtgggggcaacccaaatatgcattcccaagggatgggtggataatcaaaacctcattatctataggatataatatcattcagcctcaaaaaggaaagaaattctgacacatgctacaatgcagatgaaccttgaggacattacgctcagtgaaagaggccagacacaaaaggccaaatagtgcataattccatttataggaaatgtccagaataggcaaatccatagagacaggaagtggatgagttgttgccaggggctgcgggtaataagaggtgactgctcctgtgtctggggtttcttttgggtgctgaaagtgttctggaatgacacagaggcgatggttgcacaactctgtgaatgtactaaaagacactgaattgcacattttatttttaaacaattttttctgtgagcctatgaattatactgaagaatgaattgtacactttaaatgagtaaatttcatggtatgtgaattatatctaaattaaaaaaaacaacaacattaaaacagcagctgaccaccaattattctaaatcataaagataggttttgtgatgcctggccagtgctcagagcccacacagctgtctcagagcaagtctatctggctgtggcacagagccccggcagatagatgggctgtccgtctgaggaagaggccaatgtggggacctatagtgatacatgacagactggaccaagccaacctgaatgtgaaactctgaagcccaggacacaataaccatgacaatcagaaaggaatttagttcaagaagtttaatgagtaggcatttagccaagtggaaggttgttggctattctgaggacatttgatcttttttttttaattgtggtaaaatacacataacataaaatttatcattaatagcatttagtacattcacaatgtcatgcgaccatcactactctctagttccaaagacaaccctttacccattaagcagttgctccccactcccactcctctcagcccctggtaaccactaatctatttgtctccacaaatctgcctactgttgacacttcatataagtggaataataccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaaaaagggggaaaaaagaccaggaaaaaaaaaaatcccaaaactaaacaacgaaaaagttttttttagggagatagggtctcgctgtgctgcccaggctgggctcaagcgatcctcctgcctcaggctctcaagtagctgggactacagatgagctaccacgcccaacttagaaacatgtatttttttcagattagctcatcattccctggtaacttctccaatgatttccccttgcatctctgccactatattctagcagggttctcacactgatcctacacacaagtggttagagactcaccaggccaagctcacctccaattccaaatacctagtcctcaaggtccaagtggcctgtttccatagacactgacactgtgcatgacttttctgtcctcagctgctggctttctccatttcttgttgataatgtttttttcttacctttacatacttcatgtaaataagtttcacagacttttaacaaagtgttggctgcttttatcaaagaagagaaaatctgccaaaataaattttcaccatgaaggcaacacattttggggaacaagaaagggcagaaaggagatctcttttactagagaactctgcttaaggactggctcatttgatccaaacatctcatcagtaacttggagtgagtgcccttgttttcgtcatcttgcgtctcactagtgtaggtcagtccacatcagcctgcctgacgtacttggttcgtaatgctgacatctgagcccccatgtttatttcaccctgattctactgaaatgaccaacgaaatgcaaaacaggaggaaatatctctatcaatgccttcagaggaaccgctgtagaatgtggtgtggctgggatccatgcgagagaagcagctctcacacgattccaccacagttaaacacatgggcaaaggagggacctgccggaggtatgaggattccgtagcagagcccaagaaaatctgcaagatcagagaaactgggcctaagagccagactggcagaagtacggtttgccggtggcaaatagaaggacctgaaccaccagtgccctaggtggagaggtcagtgacaggctggccaggttttcctgggcactgctgggacagagagagacaccaatatagaggagattctacctgtctcaagaatctgccagcagcaccctgggtccccaccctgactccagctgctgccacaggggaagcagcagggactgaagctccaccccataaacaactctagggactggggatcaaacaagtaccaacaaattagtaactgtcctgtgtacaaatacaaattaggtggaaactataatgattgaacaccagtcattccagtcaagatcccaactggaggccgggcgcgatggctcaagcctgtaatcccagcactctgggaggctgaggcgggcagaacacgaggtcaggagttcgagaccagcctggccaacacagtgaaaccctgtctctactaaaaatacaaaaaaattttagcctggtgtggtggtgcgcgcctgtagtcccagctacttgggaggctgaggcaggagaatcgcttgaacccaggaggcggaggttacagtgagccgagattgtgccactgcactccagcctgggcaacacagcaagactctcgtctcaaaaaaagaaaaaagatctcaactggattttctttggaatctgacatttacctagaataggcatctgaggacagccagaaggagtgtgtgtgtgtgtgtgtgtgtgtgtgtgtgtgtgtgtgtgtgtgtgcagggggggggatggcttccttctggtagccactgctctagggagtatttctcaccatcatgtcacaaagcacacaacaggagcactctcacatggattagggaattagatgcagacctcctgcacaactgccctcttccagtcctagtaagataagacacaaaagaaaggcagggaaggagagtgtgaagggaagatttcagcacacaaaggaaaggggtgtaattcaaagcagtctgagaaaagactccagaggacaaagcagcagcaaagccaggctcctgccccgtcccccagaaaccaccctagggagcgggcaacgccctgggaatttgcagtcagtaagctggagagaagcaaccaagtgggagtccttcactttttccttttagacccagaaactccagctgggaggtgcaggagaaatggcaaagtgcccagtgagccagcccagctctgtgggaagcaactgctcttaggtatacacagattatggaaccacccagagactgaggtgccccctatccccatggaaatggcacacacatccctcgtgcagctagagtgagccttagtaagacatccaacacagttcttagaacaaagagaagaatccagatagggctgaagactacatggctgcagctccctccagcgtgcaaattctctccggatacaagataacaagcctgcacgcgatagctcagaggggaaaacagcaagagaagatgccaagaaactgggaagagagagccaagaattcctccactgtctcaaagcaaacagaacgactatgcagagccatccaagcctgagccaagacgaaaagaagtgacatggtaactaggcaaacatattatggccagaagaaaaaaaagaggcccagggagggagatggcacgagaaaggcaaagtctcccaccaagaagagaatacacaaggaagggaaaaaaattccccacaacttcataagaacatgttcccaataaaagagttcaaagatgggatgataaaacagaataagatgaaaagacaaatttccaacctagagaaacaaactgcagaccaaaacacatcattatgaaactaataaatacattgaaaaacagccagaaacagaatatacatagctgaaaatcaaattagacaaagtgaatgcagatgaaaaagacaaaagctaaaccaattacggcaaagctaatagcattggaagagagacaaagacaatccaacatgaggaatttgtgtccctgaagtacagaactcaacaaatggaacagaagatgctgtcaaagatccataagagagctgacctgaaacagcaacgactacatctgcagactgaaagaatacaccatgttcccaggacaatttgataaagaatgctcaatagcaagccagactctagtcaacctactcaacttcaaggataaagaaagcattcttcaggcaccttgggattcttccaagggggaaacatcagaagaccagacagaatgtctacaaagttctgaggcagcttagcgcagtggtggtgggggagaggtcagaggtaaattcagagagatggacaggggccaaaagcctctctgagaagacgaaatctgaacacagatctgaaggaagtgagtggtgagggagcaggtcaagtaaagaggggtccagccaatgaggagcagcaagagccaaggctctgactctagcaacattatggcaagttccaggaagagcaagagcagtgggagccaggtgagcaagggagagaatggtagagaatgagctcaaataggcaaggagggatcatgttccatgtggctgctgaggcaggcccagttacacaatttgtggagcctggtgcaaaatgaaaatgcagggcctcttgttcaaaaattaagaattttgagatggtgagagtagagtattaaaccaagcctgggttccagcaagcccatgggcagttacaaaggcccatgaagctggctctgctttcaagtaatggacttcgggttttattctgagagggtttttctcaagggagtaacctgatctaataaacatttttcaaagagcccatctgaggctgggcacactggtacacgcctgtaatcctgcattttgggaggccaaggcgggaggattgcttgagcctgggagttcgagaccagcccgggcaacatagggagaccccagtctctacaaaaaatataaaaattagccaggtgtggtggtgcatacctgtagtctcagctacttgggaggctgaggtgggaggactgcttgagcccaggaggttgaggctgcagtgagtcgtgactgtgccattgcattccagcctgggtgacaaagggagaccttatctcaaaaaaaaaaaaaaaaagcccattctaactatgggaagatatagagtagagggagtggggcaggagggcacaagatgccacaggggggctctgcagaagcagatgttgggtcacggtttgaggtgtaagatgttcatcaggaactgacatccataaagggaggtgggaagaagtcaaagagaaggccctataagggccttgtacccttacctcgctcagtcaccagggtgctgtcctggaaatggcgtgaccttgggtgaggaggctcttgcagctgaggctaaccggagtgtccgcagggcatccagagaggagagtgacctccgggtctgccacgtgagactactgcagagtctaggcagggatgcagggagctggtctaggtgccatccctgaagggcatgggcaccgggacagcgaaagggcgagagatccaggactctggcttccgtttctcatgtttttgatactgaggtatttagctttctagaggcctaaagggcagctggatgtatgaatctggagttcaggggagaggtctgaagagccaggcgagtgcgtgagggcgtgctgaatataagtgtaaacaaccctccccctgctatttggagttgtgatgaggagaaagaatcagcagaggagacagagaaagaggagtcagtgcagagaaggaagatcagacatatctgtcaagattattggtggcaatcaatagaaaccaactctagctgatttatgcagacaaggactgatgaaaagctattgaagatgcatgtggtgatggttgcacaatataaatgtgctcaataccacagaattgtacacttaaaaatggttaaggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaatagtacagactggggggcctattcaactgaaatttctcacagttctggaggctagaagtccaagatcaaggtgtcagcacattcagcccctggtgagggctctctttctgacttggagatggctgccttctcattgcatactcacatggtggagaaagcaagctctctgctgtctcttgttataaggacactaatctcatcatgcgaaacccaccctccctcctgatttcatctaaacctaaccacctctcaaataccccatctccaaataacatcacattggaggtttgagcttcaacactggaattttgggggacacaaacattcagtccataacagtgctgatgtttatgttttaatgttaaatgataacagcacagcacagcagcacacacactgtgtgatgccaatctgtttgtttgtttgtttgtttgtttttttagataggttctcactctgttgcctgggctatagcagtagtgtgatcacacctcactgcaacctcgacctccaggttcaagcaatcctcccacctcagcctctcaaagtgctgggattccaggcatgagccaccatgcctggcctccaatttgtatttaatgccactgaactgtacatttaaaaatggtaaattttaggtgatgtgtattttactacaatttttttaaaagtctaagagaaggcaagaaaggagaaggaaaatttaaaagaacagaaaatatggaaaaatagaatgcacaaatatgctataaatgaatctaaatacatcagaaatcaaatagatgttaaaggacgaaacagacaatggattttttaaaaaatctcgaggccgggtgcggtggctcacgcctgtaatcccagcactttgggaggctgaggcgggcggatcacgaggtcaggagatcgagaccatcctggctgacacggtgaaaccccgtctctactaaaaatacaaaaaaaaaaaaaaaaaaaaaatcagccacgcgtggtggcgggcacctgtagtcccagctactctggaggctgaagcaggagaatggcatgaacccggggggcggagcttgcagtgagccgagatcgcgccaccgcactccagcctgggcgacagagcaagactccgtctcaaaaaaaaaaaaaaaaaaaaaatctagctatcagctgggcatggtggctcacgtctgtaattccaacactttgggaggctgaggcgggtgatcagctgaggtgaggagtttgagaccagcctggccaacatggtgaaaccacatctctactaaaaatacaaaattagccgggtgtggtggcacgtgcctgtagtcccagctactcaggaggctgcggcaggagaattgttttgaacctgggaggtggaggttgcagtgagccgagatcacgccattgcactccagcctgggcaacaagagcaaaactccgtctcaaaaaaaaaaaatctagctatctgacattttcaaaagctccacctcactgatgcataaagacacagaaaggaggaaaataaaaaactgggatggccgggcgtggtggctcacacctgtaatcccaacacttttagaggccaaggctggtgaactgcttgagcccaggagtttgagaccagtctgggcaacatggcaaaaccctgtctctactaaaaatacaaaaacttagccaggcgcgctggtgcaagcctgtaatcccagctactcaggaggctgaggtgggaggaccacttgagcccaggaggcggaggttgcagtgagctgagattgcaccactgcactccagactgggtgacagagggagaccctgtctcaaaaaaaaaaaaaagaaagaaaaataaataaaataaataataatttaaaaaaaaataacatattagtatggtcgcttcataataccaaagggttcaatacaccaggaatgtgaaactgtatctaaaactgaaaatgtggcctcaaaataaataataaaatgaaaatgaccaaactctgtggagaaactgatgtgtccatcaccacagtaggttttaacacgtattccatcagttgataaatcaagtaaacaaaatgacagtaagaagagaaaatactttcacaacaaacggataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcctcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaaatatctttgggctaacttaaagtgacaatactatcagaacttgctagatacagttgaagtagttccagagggttagccttaaatgtttacatttgaaaaaagggtagaaaaatcaatgaaccaaatttataacttaagaagttagggccaggcgtggtggctcatgcctgtaatcccagcactttgggaggccaaggcgggtggagcacctggcgtcagcagttcgagacccgcctggtcaacatgccaaaaccccatctctactaaaaatacaaaaaatttgccgggtgtggggcaaatgcctgtaaatctcagctactcgggaggttgaggcacgagaatcacttgaacccaggaggtggaggttgcagtgagctgagattgcactactgcactccagcctgggcgacagagcaagactctctctctcaaaacaaaaaacaaacaacaacaacaacaacaacaaaacacagagaatgtactctaagaccatagaaaaaataataaagataaaagcaaaagcagaatttaatgaactagaaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgtacatagaacacctcaaaagacacagacaagaccctggatgcagccgttccctgaagagaggcctaggcagctgggagaccagggcagcagggacactcagaccttgcatcactctggagtttgcacttcctgaattgtgaagcatgcacatgtctcacttatgcaacagtgaatccaaacgtgcctgtatacaaggaaaggcctcacctggctgcgccgtggaggctggcctggcgtgtggagcaggcagaacattagcaagctaccgagcaggtgcaggtatgaacatcagctgacgctggctctttgctttctttttaatcttgacaaatttggtaggtgaaaaggcatcatttttgttctcgtttgcatctctttgattaccagcaggcagaactcttttcctatcttcattggccatctgtatctcttcttttatgaatttcctgttcatagtctttgttcattagtggtgactagtggtaagttagcaataagaactgtttgcattcaagtctagactgagaaggaaattaaaaaatctgcccatgtattctcacaataaatgactactgactagcctgagataattgtacccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtgtttttaccttgcccagaccctgcacactgcatcaaggtcctgagtttcaagcaacagaaatcaactctggttaaattcaatcacaaaggagttcttgggcagcagatctggaaatggagagagaactagagaactaggctcagaaaagcagcaggaatagaggctgcaccactgcaaacacagccaaggttatactgcagggacctgctggttgggacacccaccctgggcactgttgcatgtcatcactggacattagccaccactgctggttttgtgactcaactgccaccaccatgactaatccctcactgtccctcaagagtcaaagtccctgaaggcagaatgggtttggccaaacctaggcttcatcgccatcccctagtttccagagagcaaggggagggaatatatccattcccctgtggcaggcactgccagttgtcccccaacatccatgttctccatctgccttactaatgagaccctgcgctcagctaaggagagttattccccgcttcccagcagaccatgggactacgttatggctaaggagacagtggccgagtgcactcctgttcatcgttctctttcaagcttgctcttgttctactgactatgggcggagcacacctcccacccactgactctgggcttgctcacgtgttgatgggatgggggaagaagaggctttaagaggcttctgtgactctgctcactcctcttggactcctgacctccgcctacgaagagacttcccctggcagctgcttctccctcctgggtcctggaacgacaggcttgagaacagatctgaatcccatcttgcagctgacccagacccatgtgtgagaaataataattgctgttatagctactgagctgctggtgctgtttgttccctaggacaagatgatgggtgtgaagatggaaatggaaatattgaatgggcctagaagttaagatgtcaagtgccattttgcctttcccctatgacctctttcttcctacctggaggagtggatgcaatgactagagcagcaaccgtcatctcacaaccaagaggcaatcttgagaaatggaagacacccactgaggggccctgggtcctggatccttacaaagccactgcagtggtcatggacagcatgagaaggaagtacaccacaggcccccaaccccatcttcaggttttcttaggtagaaactagggtccacctgcctcttactaagatatacacaatggggagacttttaacacaaaaaaaggtatgaagatggtcagaagccaaaaaagcaacaaaatgttcatgatatgccgtatgtggggtttactcactacactgcttttccaccgagttagcataatcactataactcaacccattgaaaaaatgacaaaacagattctgagattctcttcctatttctgttagctaaaaaagcagcctttgaattgtttataagtgaattcaagagataaaaataaacccagataattcagaatgtactgagtacaacacatatgccttctatgtgataagctcccagcattatttattcaaagaaaacttgccttgttgcaaaaatataaaaaaacttaaaaaaaaaaaacaagtaattacacaacacaccacctcctacaacaccagattccttttctttcctttgtaacctgaccagaagaaaaacaaaacattgttcaaattgctgagacccacaaagttcaattagagcataaaaaatgctctcccaaaatatagctactagcagggaaatgagcaggctaagcctcctggtgaacctggacattgggcacaagtaacaggcacatttagacaccaacgaccagattccacatgactgaatccagaaaccctgccccttcccattcccttggagatccagggggacgccatcaattgctcactccttctccttacacatacagttaggggtgctatactatacaggggaaggcgtgaggaagtcacacatgctttggtgttcaagaagctcataaagccattagggaaagagcaacatgccagaaagcagttgtctcttctggctacagaggttgcaaaagacgtctgcaagggtcagtgagggcccaaaggagtagtaaccaaggccctgaagcctgcctgggagctgaggtgggcagtatcagcctcttctcaataatcagttcctaaggttccatccgagaaagtagaaaaccacagaggccattctcatgggtactttaagcagtacatctgttggcaaaacacaaatgttgttacacaaatactaagccacagattgcaaaggcacctgacagcctttaaaattcatttctcttgtttcgcaaagctgcactgggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaacttttacagcactatccactgtaaaagttgtttgagaaaaaataaaatgtagccagccttcagagcatatatgcatctttattttattttatttattgagaccaagtctcactctgtcgcccaggctggagtgcagtggcacagtctcaattcactgcaacctccgcctctggggttcaagcgattctcctgcctcagcctcctgagtagctgtgattacaggcacccgccaccacacccggctaatttttatacttttagtagagacggtgtttcaccatgttggccaggctggtcttgaacccctgacctcaggtgatctgcccgccttggcctcccaaagtgctgggattacaggtgtgagccaccacacccagcccagagcatatgcatctttaaaaagttgtcttcggccaggcacggtggctcacacctgtaatcccggcactttgggaggcagaggcaggcggatcacctgaggtcaggagtttgagaccagtctgactagcatggtgaaaccccgtctctactaaaataaaaaaaattagccaggcgtggtggtgcatgcctgtaatcctggctacttgggaggctgaggcaggagaatcgcttgaacccgggaatgcggaggttgcagtgagccgagatcacaccattgcactccagcctgggcaacaagagtgaaactccgtctcaaacaaaacaaacaaacaaaaagttgtcttcaagagcataatcaaagatactttcacttcttaatgttttgtttccatgtctcgtcacagaacatggtacagacaaatattagaatagactcaagggatcacttgattttaactacagaaactttccggtgaatcatgagcactgtcttgtttccagctgctgaagtatatgggcaccagacaagagcacagcgctgtcactcaaagccaggagtaatatggctgttaccatgaggactacttagcagaagataagcatctcattatgtctacagtgaactaaactattgttgccaatggtatatggattaggaccgactgccactgcccatctgcttatagcttagaatctggtgaatgcaaacaactgttttggggggacttctggcccttccttgggctctgctatcctggaaatggacaggcttctacaggggttcgatggtagccccgaatagttaggtgtatgtcttaacccccagaccctgtggctctgaccttatttggaaggtctttgcttctgtaattaagtgaaggatcttgatatgagatcatcctggatttagggtgggcctaatacagtgacaagcatccagagaagaatacggggacacagagaaggccatgtgaagacacaagcagagaatggagcaatgcaactgcaagccaaggaaagtctaggactgccaggcagccaccaaaagctggaagaggcaaggaaggatccatgctagaggctctggggggaatggagccctgcaacatcttgatttcagacccctggcttcctgcactgtgcaagaatacagttaggggtactttattctgactactccataaacttaagctctaattctcgctcagcttctgagctttaacaaagggtccgtgcaacttctaccgttcccgttccccgtctttaccaaagaggaagcatttactcaaagcccacctcctgcaacagctctagatgccgcttcccccctccacacaaggagtctgctcctccaggtccccatttcctccttctcacgctcccctctctcctgggccattcccagaaggatgtaaacatgctctcatattcacccacgtgaaaaacaccctcatccccctctaccccactcctatttttctggtcaccatcacaacaaaacttcttaaagagagttgtctatacccaatctccactccctcaccttccactcactccaatctggcttctgtccccatcacctctaattcagttcaccatgtgacaggtagggtttttgctagttttagacataatggatcttgttattcctgggctttaaagccttcaccagaggatggccaactgcctacatgtaattgccacttgacccttcaaacctcaaagaaaccgaagtacagacatatgaaagggaagaaatttctaacagaggcaatagcaggagaggacctctgaacggataagatacactcagcaaatttctagatgctggaagtaggcaagaacatgttgactaatggaacagagaggaatgtactacaagagagctgtagagcagatgagagcctgtatacctgtcagagccccaaagaagctctcagaccagaccagaccagaccagaccagaccagacgagaggaggggcaagcagtgctgtcatgtgtgcaacacctgggggctgctgactgccagatcccgacccacaagctttggggcagggcaccttcaataagctcccaggtgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagcccaggagttcaagaccagcctagacaacacagacacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtgacacagtgagactctgtctcaaaaaaaaaaaaaaaagtatccattaaaatattttcaccctttaaaaatcaggttgtctttttattaccgagttataggaattcttctgaatacaaatcctttgtcagatatgactttctattttttctatgactggtctcaactgttttcttggtggacttgtcttttcattttctttgagacagggtctcactcagtcacccaggctggggtgcggtggcgcgacctcagctcactgcagccttgacctccttgggatcaagcaatcctcctgcctctgcttcccgagtagctgggactatggactacgggtgcacgccaccatggttggctaattttttgtatcttttgtagagatgggatttcactgttgcccaggctggtcttgaactcctgagctcaagcaatccatctgccttgtactcccaaagtgctgggattacaagcatgagccacagctctcagcctattttcttttgttttttctttttctttttttttttaagagacactgtctcactatattgcctatgttggcctagaactcctgggctcaagtgatcctcctgcctcagcctctcaagtacccagtagtgactacaggcaagcctcaccacgcccagctctgtcttttcattttcttaatggtatcttttgaggaccaaaagttttaaattttaatgaagtccaatttattttttcttttaatagctattgcttcatgtatcctaataaatctttttttggcctggcacggtggctcatacctgtaatcccagcactttgggaggccgaggcaggcagatcacttgaggtcaggagtttgagaccagcctggccaacatggcaaaaccctgcctctactaaaaatacaaaaattagccaggcatggtggcgcacacctgtaatcccagctacttggaaggctgaggcatgggaatcgcttgaactcgggaggcagaggttgcagtgagctgagatcgcaccactgcactccagcctgggcaacagagtgaaattgtgtttaaaaaaaaccttattctttggactgcacagatattctcctatgttttcttgcagaagctttatatttttagcttttaaaacatttaggtctataatctctcatgaattaatttttatgtatggtgtgaagtagtgtcatgggttggactatgtcccccaaaaaagatatgttgaagtcctaaccctcagtacctcacactgagaccttagttggaaacagcgttgttgcaggtgtaattagttaaggtgaggtcacactggagtagggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccaggctggagtgcagtggtgcaatcttggctcagtgcaacctcccaggttcatgcaattctcctgcctcagcctcctggctagctgggattatatgtgtgcaccactacacctgactaagttttttgtatttttagtagagacaaagtttcaccacgttggccaggctagtcttgcactcctgacctcaggtgatctgcccgactcggcctcccaaaggccgggattacaggcgtcagccaccgcacccagccaaatttctgtggttttaagccacctagtttgtggcaactctaagaaactaatatttagggtaaggtcaaggttcatttttgtctggtatggatgtcatttgccatcatccggcacgtgctaaaagactttcctttcccgcaccggactgttctggtgcctctgttaaaaatcaaatgactataaagtcacatcacataagccccttaattttgttctctttcaagtttactttggatgttctaggtcctttgcatttccatatacgttttatttatttatttatttgaggcaaagtctcactctgttgcccaggcgggcgtgcagtggcatgatcttggctcactgcaacctccacctccgggttcaagtgattctcatgcctcagcctcccaagtagctgggattacaggtgtgtgccaccatgtctggctaatttttgtattttttgtagagacggggtttcgtcatgttagccaggctggtctcaaattcctgacctcaagtcatctgtctgcctcagcctcccaaagtgctggtttacaggcataagccaccgtgcccagcttccatatacattttacaatcaatttctacaaaaaaaaccctgcagttatgactggggttatgaatctacagttcaatgaagggagaactgacactgtaaagacacttagtctttcagctgatgaacatggtacaacattccatttatttaggtctttaatttctttcagcaacattttcagtttcagcgtgtaaatcttgtacatttcttattaaattattcctaacgatattgcatttgaaatttcatttctgattagtttttgaatgatctcgtaccctgagaccttgctgaattcactttttagttctagcaggttctgatagtttctttcacattttcgacattacctacaaatagaaacagttttacttcctttaaatattaatgcctcttatgttttttcttgcctcattatactggctatgacctctagtataatgttgaatagaagtggttagagtggacatctttgcctttttcctgattttcggggtaacatgttcaatatttcacaattaagtacaatctatctgtagctctttcatacatgcacttcctctatttctaatctgctgaatttttatcatgaaagggcactgaattttgtcagatgcgttttctgtatttattgaatagactatatggtttttctcctttattatcttttttttttttttttttttttttggatactgggtctcactgttgcccaggctagaatgcattggcgtgatctcagcttactgcaacctccgcctcttggtttcaaggattcacctgcctcagcctcccgaatagctgggactaaaggtgcgtgccaccctgcccggctaatttttctatttttagtagagacaggatttcactatgttggccaggctgctctcaaactcctggcctcaagtgatctgtccacctcggcttctgaaagtgctgggattacaggtgtgagccaccgcacccggcctcctttattatcttaatgtggtgaattacaccaactgatttttgaatgttgaagcacactcgtgtttctgcgaaaagcctcttggttgtaatatgcaggcgcacctcatttgattgtgctttgctttactgtacttcgcagatactgagtttttaacaaattgaaggtgtgtggcaaccctgcatcaagcaagtttaccagtgccatttttccaatagcatgtgcttacttcatgtctctgtcacattttggtaattttcacaatgtttcaaatttctcattattatatttgttatggtgatctgtgatcaatgctctctgatgttactactatcatcattttgcggcaccacaaactgcacccataaaagatggcaaacttggccgggcggggtggctcacgcctgtaatcccagcactttgggaggctgagccgggcagatcacctgaggtcaggagttggagaccagcctggccaacatggtgaaaccccgtctctactaaaaatacaaaaaacaagctgggcgtgctggcacatgcctgtagtcccagctactcgggaggctgaggcaggagaatcgcttgaatccaggaggcagagactgcagtgagccgagattgcatcactgcactccagcctgggtgatggagtgagactccatctcaaaaaataaaaaaaataaaaaaggtggcaaacttggccaggcggcagtggcttacgcctgtaatccccgcactttgggaggccaaggcgggtggatcacttgaggtcaggaattcgagaccagcctggccaacatggcaaaccctgtctctactaaaaaatataaaaattagctgggtatggtggcgcacgcttgtaataccagctactcgggaggttgaggcaggagaattgcttgagcccaggaggcagaggttgcagtgaactgagatcatgccactgcatgccagcctgggtgacagagcaagactgtctcaaaaaaaaaaaagaaaaagaaaaagaaaagatggcaaaacttaagtgataaatgtgtatattctgactactccaccaatcagctgttcccccatctctctctctctccttgggcctccctattcccttggacaagacagtactgaaattaggccaattaataaccctacaatggcctctaagcattcaagtaaaaggaagagtcatatgtctttctctttaaaccaaaaaccaaatgatcaggcttagtgagaggcatgttgaaagccgagaagccaaaagctaggcctcttgtaccaaagttagccaagttgtgaatcaaagttcttgaaggaaactaaaagtgctactccagtgaacacacaaatgatatgaaagtgaaatagccttattactaataaacgttaaggaagttttaatggtctggataaaagatcaaatcaaacacaacatttccttaaggcaaagcctaatctagtgcaaggccctaactctcttcaattctatgaaggctgagagaggtgaggaagctgcaaagtgtattgtttaatttttaaatatttggggctttctctggatcttccattatttcttttttttccccccactcactctgttgtccgggtaggagtacagtggcacaaccacagctcactgcagcttcaaactcttaggttcaagcagtccctccacctcagcttcctgagtagctgggactacaggcgagcgccgccatgcccagctatttatcgtaatattggtattataattttgtaattttatgtctattacaagataaagcaaataagtaactatgttaacattagtaagacccaacattttcagtgtaaggaaaagatatatacagatcaaataaaagttggccaggcatggtggctcacacctgtaatcccagcactttgggaaatcgagatgggaggatcacttgaggccaggagttcgagaccagcctgggcaacgcaacgagaccccccatctctacaaaaaatttttaaaaattagctgggcatggtgatatgcacctgtagtcttagctactcgggaggctgagggaggaggattgtttgaagcctaggcatttgaagctgcagtgaattaggattgtaccactgcaccactccagcctgggcaatagagcaagaccctgcctcaaaaaaaagaaaaaaaaaaaaaaaagttaaggaagaaccctgtaatgttaaattgccatagaagacatcattatgtatttatgacttaaaaaaaaaatggagggcacagtggctcacatctgtaatcccagcactttggtttttttatttttcttttgtgaaaatatttaccagcagtttgccctgacagatgtaatcccagcactttgggaggctgaggtgggaggatcgcttgagctcagttcgaaaccagcttgggcaacatagtgagaccttgtctctacaaaaaaattaaaaataaaaaataaaaactgaatatattttctagcgatgtcctctgaaagtgcctagatataatgttaccccagtaagaatcagcacatttagtacccacatgttggattctaaataccgttgccactataaggaaccagagctccttggaatcagttctaggacacgaaaagcacatattgggatggaatatcttgtgccagaaaacaagaaattgctcaaagactaattaatgagggtatgccaggagaatataggaaccaacatgaagggactcttgttgacccaatttgaattgtaaaacatttaataaataaatccctatgagtccatattgacatgaaagagaaaaggaaacacaacagcaaatattttgccaccatttgaggtgattattctaccaactccttactctgaaatgtaataaaggcaaagattaagcatctatactgtctttttaggaggaaatataatgcctccttatttgatgagggaaaattcattacagaggaatgacagtactaaatgtagaagaggtgacaattaaaaaaactatcattttgcaacccccaatgtaataatggtttcaggcaaggatcaatgaatgctaaaataattatgcaaatggctgttgggcaataggatatttgtatggtgccaaagcatcacatcacagattatatatcaattaccacaggaaaactgtatgtctacaatggggagatttggcagtcacctccttctttaatcaagtgttaaaacgtagcatcacaaaccacagggtaaccaaccattaagtgcctggtgagctgatgctatatgaagtacacagtactgcctatgaaatattcttgcccaaaatgtttaacctgaacatgcctgtagacctaacttcttgtctacaagtaatatatatggacaaacaagttaaattatatcacaagaaaagagagacatctaaaatgtgggccagctagtcgtggtggcacaagcctgtagtcccagctacctgggaggctgaggcaggaggattacttgaggccaggagttcaaggccagcctaggcaacatagtgacacgccatctctaaaaatatgtatcttaaaatgtgggcccttctagatgacaattgggctgactgcttcaaaaagtcagtatcacaagtgaaggagaggtgggtaggctgttcttgttaaaagagacaaaggggctgggcatggtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgaggcaggagaatcgcttgaacctggaaggcggaggttgcagtgagctgagatcacaccactgcactccagcctgggagacagcgagactctgtctcaaaataaaataaataaataaataagagacaaaggaagcatattcaaatgcaatgtataaatcttaattgctttggagcccctcaacagcgataagagacatttggaggaaatctgaatttaaagtgggtgcctgataacattagagaattattgttaacttttaaagatgtgatcggggtattgtgcttatattggaaaatgtccttatttttaggagatgtatactgaagtacttaggggtgaaatgtcgtgacatctgtgagttccttttaaatggtgagcaaaaaggtataaaaatgcaccctatctatacagaccaggaaaatacgccaaaatgttaacaattgtctaatctaggcagtaggcacacaggcttcacagtaagttaaaaaaaaaaaaaaaaaggtttggctgaaataaagaatttaacagaagggatagaaaataaagtcaggaggctgggtgcggtggctcacaccactttgggaggctgaggcgggcggatcacttgaggtcaggagttcgagaccagcctggcaacatggtgaaaccccatctctattaaaaatacaaaaattagccgggcgtggtggtgcaggtctgtaatcccagctacgtgggaggcagaggcagaattgcttgaacctggaaggcagaggttgcagtgagccgagatcaggctactgcactccagcctgggtgacagagcaagactctgcctcaaaaaaaaagaaaaaaggaaaaagaaaataaatgcaggagatcttccaaaattcagagcaccccccaccgcccaataaatgaaaaatatgagagaagacagaagaccaatataagaggtccaaagttaaacagtagtccccatagagaaaatgaaagcatgtaaattagtaatttttttttaaaaaaaagagttgacaaaagtattcagattgaatgaccacagtacaacgagtgaacaagacacaactctagacatattctcatgagatttcaggacactaaaaataaggagacgaaatcctaaaaacttccagggaaggaagagaaaagaagggcacctacaaaagaaccataataagattggcatcaggcatttgttgcatttgttactctgcatactagaagagatgcctccaaagttaggagaaaaaatgattttcaacttggaaccctatactcagccaatcaagtgtaagagtagaagaaaggtatttcaggcatgcagtgactcagaagacctatctgttacaatgcttttggttacaagtaacagaaaagaaaactgaagctggctcattcagtaagaaagtccatcctatctgagtccctagctcaggtaggacaggccccagccacagtgcaatcaccagctaagcaacggcatcaagacccaggttcttcccgtttctctgctccgccttccttggtgagcaggctttatcctcaggctttgtccctcagtctgaggttacagaagagcccccagcaacacctttctcacttactccagtgagagaaaaagagaaagtcttccctgaacgtgccatggaagtccttcccttcagtctgagtgaaccaacttagatcgtatgtccatccttgaccagtaacagttgccaaaggaatgcaatgtgtggaatgacttaaggatcctttctgaagttgggaataaggtagaaaggtgaataatatcaggattctgttaggaatgggcaaagaagaaatggatatggggtaggtgacaacggtatccactacagtttactccccatgcactctatctgagcacattatttaaggatgcagtccagaaaacgagggagtaaaccatgtgaaaggaagatatgggttttaagacacgggctccaacccaagagcccagtgaggagaaggtccaggtacagctgtatatgcaaccttaaatcaaagagcagatacttgcccagattgcagaagggcagaggccttccaagagaaaggtcttcagtggggaaaaagccgaatcgtacgaaataaacagcactgctaatagcattttacaacataatcaaggaggaatagtaaacaaaataaaaaggcaactagaaatggtgggcaaaacaaagagctatataagcaagccaaggtttgaatatgaagtagattaaatcctagcaaggattttaagcaggtgacagagtctaagaaaagggaatccatttgaccttgattggtcattctcctttgagtggtccagatctgtaaagaaggaaatgtaatcctgggcacattcattatttggtctcgccaagaacaatactcacatgtgtaataatgtaaataatgttattttcgactttagaattaagctacaacttggctgtggttgcagggcagaacacacatgttaacaaatgcaagaatgggtatggtcaagtacagcttttaagacgcagaagttaaggagggaaagtggaaggaaaagtagggttattaatatccttatcttaaaaagaggggaactgacatatggactaaaatactgtttaaaatttacagagaaatgtgggcttggcatggtagctcacacctgtaatcccagcactttgggaggccaaggcaggcagatcacctgaggtcaggagtttaagaccagcctggccaacatggtgaaaccccgcctctactaaaaatacaaaaattagcccagtgcactggtgtgcgcctgtagtcccagctactcaggaggctgaggcacgagaattgcttgaacccgggaggcagaggtttcagtgagccgagatcacatcactgcactccagcctgggcgacagagtgagactccatctcaaaaaaaaaattacagagaaatgtgaatatgaatttcaacatggggaggtaacgtaagctaagtcattctctttcatttcagggagttaacacagttccctaaagttggcaaatcaagaaagatgtataagcatatgatttaattttggaggtaaccatcaaaggaactaaaatcagaaacagttaaaagctgtcatgtctgagtcagggaagggaaggggaaggggtagactgctgtttttacgatgacctcttttgttatatctaacttgttgccgagtagttgcaatattttgataaaaattcaaaacccaaaccaccttacccttcatgttttctatcgctctgatgttaacattcaaaatcctgcatgatccagcccctgttgacctctctgatggcccggaccctttgccactctcccctaacccctcgttcagctcctgccacacaggactaagctcttgccagactgagggccttcacacatgctcttctccatctggaaagcctttttcctctctgcaccttgcccacttctgttcaaccctcggttccctgcatcggcgttgcctccttggggaaggcaggctgagctgttcccccattgtacagtcatgagtcgctcaacaacagggatatgttctgagaaatgtgtcattgggcgatttatttgtgctaacatcagagagtgttcttacacaaatctagatggtgtagcatactacacacctaggctatacggtatatagcctattgctcctgggctataaaactgtacagcatggtactatactgaatactgtagatcactggaacacaatggtaagtatttgtatatctaaacatagaaaaggtacagtaaaaatatggcattctaatcttatgggaacaccactgtatgtgtgctctgttgtcggttgaaacgttgttgtgcagcacgtgactgtagaggactggagtggctcccacctccatacttgtccttctgaacacttaagtactggtacaattatctaagatctgtctctgccgctaaagtcaagctccatgaggacaggtaccaaatctgtctaggttaccccatccctgcctaacacagggcctgaggtactatagataccttacttactcaattgtggaatgaattgatggactatagcctgatgtactgcaaatccttcagcatgcagcaggaatggaacttggtgtttaaactaaactataatggctagatgaaaaagagactaaatgtgaaataattccatcattcagaattgagtgttggtataacaaacagacccatgaaatatgtagcgtttcacaaggatatcagtgaggaagttgttcaatatgtcatccgaagtcccgttgcataatgatacttgcacacgcatgcttatagcagcacaattcacaattacaaaaatatagaaccagcccaaatgcccatcaatcagaaagtgaatagagaaattgtggcatatatatacaaaggaatactactcagccataaaaaggaatgacttaatggcattcacagcaacctggatggaactagagactattattctaagtgaagtaactcaggaatggaaaaccaaacaccgtatgttctcactcataagtgggagctaagctatgaggatgcaaaggcatcagaatgatacaatggactttggggacttgagggaaagggtgggagggggtgagggataaaagactacaaattgggttcagtgtacactgctcgggtgatgggtgcaccaaaatctcagaaatcaccattaaagaacttactcatgtcaccaaataccacctgttcccctaaaatctatgggaataaaaaattaagaaaataaataaaattttaaaaggaaggtcatccctacacttcaagttataaaataattctaccgtaaaaaaaaaaaaaacacacacacacacaacaacaacaaagtcctgttgcgtacctctgagaggtgttttgtggcttggactagcatactggcagtgcagatgctgagaagtggttggcctaacaggacttgctgacagatcagggatgatgagagaaagagcagaatcagggcgggtgcagtggctcacgcctgtaatcccagcactttgggaggctgaggtgggcggatcacaaggtcaggagttcaggaccagcctggccaacatggtgaaaccccatctctactaaaaatacaaaaaattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatttgagacacttatgagcaactcaagtaaatgctgacgaggccatcaaatctggagctcaagagagaggtttgaaatgcagaaacagggttgtagccatcagcaggcagacatatcatcattcagagtcatgaacatgcagaaataatggaaatgcctcttaattaaatgaaggcatagacatacaacgaaatgttatgtgattactaaaaatgatggtagaaaaacattatccagaagttatctttatctgtagatgacagatttatggacaatttttacttttcatctttgcatattttctgaaaattttttgtccattgaacatgtattacttttataataagaaaatgcaggctgggcacagtggctcacgactgtaatcccagcactttgggaggccaaggcaggaagatcacttgaggccagcagtttgaggccagcctgggcaacatagtgaaatcccatttctgcaaaaaatattttaaaaattagccaggcgtcgtgacatgtgcctgtagtcttagctatcttggaggctgaggtaggtggaatacttgaaactggaggtggaggctgtagtgagctgtgacatcactgcactccagcctgagcaacagagcaagagcctgtctcaaaacaaaaacaaaaacaaaaaagaaaatgcaagttaagttattttcattttagggaaaagtgaagatatacgtctatttttatggacatggatatttacaacattttgttgaggaaaggtagcaagttacaaaagtacatatatgatctcattcatctaaaacaatatgtgggccaggcacagaggtgcacacttgtaatcccggcactttgggaggccgaggcggaaggatcgtttgagcaaaggagtttgagaccagtctgggcaacatggtgaaactccgtctctacaaaaaaaatacaaaaattagctgggcatggtagcggacacctgtagtcccacctacttgggaggctgattgggaggatcacttgcacccaagaggtcgaagctgtagtgagctgtgattgcaccactgtgctccagcttgggcgacagaccttgtctcaaaacaacaacaacatgtgtacgtgcttacaggcaaataagaaagactctagaaggatgtttaaaatgccaacagcaggcccagcgtggtggctcatgcctgtaatcctagcactttgggaggccgaggtgggcagatcacaaggtcaagagatgaagaccatcctggccaacatggcgaaaccctatctctactaaaaatacaaaaattagctgggcatggtggcgcgcacctgtagtcccagctagtcaggaggctgaggcgggagaatcgcttgaaccagggaggcagaggttgcagtgagctgagatcgcaccactgcactccagcctggcgacagtgtgactctgtctcaaaataaataaataaataaataaataagtaagtaataaaataaaatgccaacagcaaaagtaacttttaggctattatgcaccaacaaatttatgtgatatcgagaagtgttaaacagttttagttgcattacactttgcataatatacacaaaacactaaacatgttaataaatgtttgatataataagatgacctaagtttaagtgtaattttgactccttttactgtacctgtgttttcccccactaactgactagtcaagtgctgactggtttttaagagatggggtcttgctctgttgcccaggctggcctcaaactcctgggctcaagtgattttcccacctcagcctcccaagtaggtggaactacaggtgtgcatcaccatacccggcttaacgtctgtttttatatttgtagccacatggtacaaagtacagaacaggtgttcttaacctttttctgccatggacccttttggccttctggacccctcctcagaagaatgttttgaaatgtgtaaaatgcacagaaattaacaacatatttcaagagttcgttctcaaataatatgtgcttcttcagtaaatcattaaataaccagatctagagatgggtctaataattaccttaagtttgaagcagtgatggacatatatatttcaaaatatctgtaacaactataatatgatatgaaagtatctttgatctctactggtgacagtcactgctattctaatactaccatgatctgttgcttacaattgtcattgaagaaaatgtggatttttttttttttttttgagacagagtctcgctctgtcgcccaggctggagtgcaatggtgtgatcttggctcactgcaacctctaccttccgggttcaagtgattctcctgcctcagcctccggagtagctgggattacaggcgcccaccaccatgcccggctgatttttgtatttttagtagagacaggatttcaccatgttggtcaggctggtctcaaactcctgacctcaggtgatctgcctgcctcagcctctcaaagtgctgggattacaggcatgagccaccacacccggctggattttttttttttttaaaagacagggtcttgctatgttgcccaggctggtctcaaactcctgggctcaagtgatctgccctccacgggcttccaaagcactgggattacaggcacgagccaccatgcccagctaaaaatctgggttttcagagacattagtgaaaataaagagtgaatgtttttcccatccaaggtcacagacccggctgaattctcaaccaaagttggaggccttggtctagaaagatacataccaaatattaacagcagttttttttttttttggatagtggaatcgccagagtgattctattttgttttatgatatttttgtagagatagggtctcaatatgttgctcaggctggtcttgaactcctgggctcaaaagatcctcccaccttggcctcccaaagtgctgggattacaggcgtgagccatggcatgcctggcctaattttttatctttgtacctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggctgcagtaagctatgatcatgctgttgcactccagtctgggtgatggagtgggatcctgtctctaaaaaaacattaaaaaaaataagtaaaaaatttaaaaactggttaaataaattgtggtacatccataacagactatttaaacccaacccttaaaaggaatgatacggctctgtatgaaccgattctaaataatctacaggatacattaaaataaacaaatgtgcacaatattttatagtatgtgtaaaaacacaacgcccacatacccttgtgtatttatacacacatgtaaaatatatacacaaacctaaacacacaaaaatatgtccaatagagacaaagagtagaatagtagttgccagagggtggggtgggggaaaggggagaagtgggagttagtgtttaataggtatgaaatttcagttttgcaagacgaaaggttgtagagatggatggtagtaatggctgtacaacaatgtgaatgtactcagtgccactgaactgtacagttaagatgattaaaactgtaaattgttatatatatcgatatatattttttgagacggagtctcggtctgtcgcccaggctggagtgcagtgacgcgatctcggctcactgcaagctccgcctcctgggttcacgccattctcctgcctcaggctctcagagtagctgggactacaggcgcccgccaccatgcccggctaattttttgtatttttagtaaagacgaggtttcaccgtgctcgccaggatggtctcgatctcctgacctcgtgatcagcctgcctcggcctcccaaagtgctgggattacaggcgtgagccaccacgcccagcctgttatatatattttataataaaaatttaacacacgggtacacacacgcttttttttttgagatggagtctcattctgttgccaggctggagtgcagcggcgtgatctcagttcactgcaacctctgcctcccaggttcaagcgattctcctgcctcagcctcccgagtagctgggactacaggtgcccgccaccatgcccggctaattttttgtatttttagtagagatggggttttaccatgttggccaagatggtctcgatctcttgacctcatgatccacccacctccacctcccaaagtgctaggattacaggcgtgagccaccgtgcccggccacaatttttttttttttttaaagaaacaggtaatagtggctgcctccagggaaagaaatgaatgtttggggcagggtagcagagatactttacaatataactcttttttttttttttttgagacggagttccgctcttgtcgtccaggctggagtgcaacggcatgatcttggctcactgcaacctctgcctcccaggttcaggcgattctcctgcctcagcttcccaagtagctgggactacaggcacgcaccaccacgcttggctaatttttgtatttttagtggagacggagtttcaccatgttggccaggctagtctcgaattcctgacctcaagtgatcaagctgcctcagcctcccaaactgctgggattacaggcatgagccaccatgcccagccccatataacttttttctattattatttttctgagatggagtctcactctgtcgcccaggctggagtgcaatggcacgatcttggctcactgcaacctctgcctcctgggttcaaacgattcttctgcctcagcctcccgagtagctggattacaggtgcataccaccaagcccagctaatttttgtatttttagtagaaatgatgtttcgtcatgttggctaggctggtctcgaactcctgacctcaggtgatccacccacctcggcctcccaaagtactgggattgcaggcgtgagtcactgtgcccagccccgtataactttttacaccacctttttaattccgtattgtccatctaactattcaaaaaatcatttaaaaaaccccggccttatacaagaagtcttttccttaatcgtgtcatttattctatccctcttcctttaagtaaaaaatattttcaatcaaaatcagaattcgacttcagctttgagggtatttattagattcaaataatgcaatttataaaaattacacttgctaccctaaaaatatattcactaaaagccttttctttttttcttttttctttttttttttttttaaagagacagtgtcttactctaaagaacgaggctgcccaggctagagtacaggagtacagtggtgtgatgatggctcactgtagcctaaaactcctgggctcatgggatcctctcacctcatcctcccgagtagctgggactacaggcatgagccaccatgcctggcccctctatttttatcaggtgttacagaaaagcttcaaaatcatcatggaagaaaattatcatttttaccagtacaaaacttttattgcatcccaaccaagctaagatgaatacagaattgtttcaacagaagttaccattatcataattcaagacaaaaatcagccggcaattacatgagttggaaaacaaactactcttatgtcacagtctaccctaaagctccaacttatgtcagaatttaaaatacacacacatatacacaaccctgtggattcctcctcatttatgtaaaacctacttttgtgatgatctgctattttcttgagtcttctggaatgaacactgtagccccactcccggataaggagaagataccacttccagggcttagcactgcccctggcttgaagcagatactcaaatatttgttgggtgaatgaatgattgtctgctgatagggctgcccatcaagcctcataaagaaaaaattcagaaaaaagcaactttatagagaaaataggaaaaagtttaagagatattttgctcacttgaagaaatcagcatttgttaaaggtgaagactggattgactggttcatcaagtggcttagacacaactgactaagtgggctataccttatcccaccccaaagttaaatacaaaacaggtatttttttttttaatcacaggaaaaacacagggcaacttaactataaaattattatttttattttttatttttgagacagagcctcactctatcgcccaggcaggagtgcagtggcgtgatcttggctcaccgaaacttctgcctcctgggttcaagcgattctcctgcctcagtcaccccagtagttgagattacaggtgcccgccaccacgcctggctaatttttgtatttttagtagagacgggatttcaccatcttggccaggctggtcttgaactcttgacctcaggtgatccacccgcctcagcctcccaaagtgctgggattacaggcatgagccaccgcatctggcccttttgtatgtattaaatacgtatgtatgaatataatacatcatcaggttttttaggaagaaaatatagatgactattgatctgttgttaagagtaggaaaggatttcctggcggggcgcggtggctcacgcctgtaatcccagcactttgggaggcagagacgggcggatcacaaggtcaggagatcgagaccagcctggctaacatggtgaaaccctgtctctactaaaaatacaaaaaaattagccaggcgtggtggcgggcgcctgtagtcccagctactcgggaggctgaggcaggagaatggaatgaacccgggagatggagcttgcagtgagccaagatcacgccattgcactccaacctgggcgacagagcgagactccgtctcaaaaaaaaaaaaaaaaaaaaaaaaaaagagtaaaaaaggatttcctaagtatgaaagcaaaagaataaatcataacataaattttatatatcagaaagacaagaatcaagacgtaagacaaaacaggaaaatatctgcatgacaaagagttaacatctttaatacattaagagctatgacaatgattattgaggtttagcctcagtaataatccaagcggcaccaatttaaaagatgtatatccaattctgggacgatatgggaaaatggcactttctcagactgttgtgggaactgggatagccattttggacagtgatgtggtggtatccaccagaaattccaagtctaggcagccattcttcaaaatgactggcacatgaggaatttcaatcctgtagcatttttaataacatagagagacaacgaaatgcatgacggtaagtcagccctggactacactgctatttaaaagaaatgaggcagagatgaatatatgagatggaaaaatgcagaatatgtatatataacaccatcctgaggccaggcacggtggctcacgcctgtaatcccagcactttgggaggccaaggcaggtggatcgcctgaggtcaggagttcgacaccagcctggccaacatggtgaaacccatctctactaaaaatacaaaaattagctgggtgtggtggcaggcgcctgtaatcccagctactcaggaggctgaggcaggagaatcacttgaacccaggaggtggaggttgcagtgagccaagattgtgccactgtactccagcctggatgacagagcaagactccatctcaaaaaaagaaaaaacaaaacaaaacaaaaaccctcctgttaattacaacacaaaaagtacacagtttagtcttagaagacttagaaggatctacattaagctattaacagcagttattctgggtagtgggagcagagattaagcggggagctttcatttttttacctgatacttttttttttttttttttttgagaccgagtctcactctgtcacccaggcaggagtgcagtggtgtgatcttggctcactgcaacctccgcctcccaggttcaagtgattctcctgcctcagccttccgagtagctgggactacacgctcaagccaccatggccagctaatttttgtatttttaatagagatggggtttcgccgtgttagccaggctggtctcgaactcctgacttcaggtgatccacccgcctaggcctcccaaagcgctgtgattacaggcatgagccaccttgcccagccacctgatcaatttttaagtggtttgatttttctataaatccatgtattattttagtaattctttaaaaagtaaaagaagaaaaatagatatcaagcatttatctactaaagacgggtactgtcctttgagaattccctcaaaagttctttgaagctcaaatggctacatctttcccattcataagatactttttaaatttcctctttctacatttctttttaaaagtttattttcaattagcttcctcaggttgaactctctgtacatttcttaggagaaactgtatggtgtcaacactgcctgttttataacatccattcgtaatctgtaatctgagaaaaagactcgtaaaaacccaaaccaccctccaggcctaacatcttccagaagaaacccattcactgcccatattacatttagtccacacaatttctgagacaaagcacaaagcactagccatacaactcccaccagcataaatacgtggagtacaaagaatgtcctgtcagctgggcccagagcacaccccacagcagtaaaagagaatgacaatttgagtcacaggatcaggagcagaatcaaatttgggacttgaggcagtgtgatgctcttctggtcttccgcttccttccacaccttctattctccttcagccaaaccttgccctcacataatccctaagcaggctatttcttatggatgtctacaacagcttcacactgaggtgtcagaaaccactagagagacaacaaagaacgacttagggtctcagtcggaatcacaatggccgcataagtgaaaactcacatttttgcttaggggaaaaaaaatgggaaaattcaattggaacattctgctttaccacacagaagttctgaaatccacatgtcaaaacatcaaatgcggagtgaccactaatcaaaaagacaaaacaaaacaacaacaacaacaacaacaacaaacagcttgagatgttgagcctgaaggttgagaaattaaggaaccattcatttttacaaaactaaagtccacacaatggtgccaagtagttcaaactgcagctgatacagcacctgagtgtcagacctagaatgactggggcccccaggtttttacaaagtactcatcctcctctagagtcccaagaaccagatgtatatctgggtactctctttagttaccatgggaggagtgtagcaagcacatgacattagccatggcccccggtgttctgagacagctttcaggagggtgtccttctagggaaccaaccacataccagttcccatatctgaaaatgcattaccactgctcactaatgttgaccactaagccatttaccccaaaccaaagcaaacacatgctgaagaccgctaaggcaacagcagcagcgcaaaagggctcagtgcaagcgctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaaattactggcacgtaacacacagtgctaaaataaaggaaagattcatgcttgttagaatcaacactatcacaagccttgtcacctctaggggacacttcgacactacaaaagcataccatgagtggcgatttctggcaagtatttcttctaccacggcacacagaaattctcagggaagaatacatgttcaagagaatacgcaacatcaaaataccatccctgaaagaacacatggaacctagaggcagtctcccttctttttcaagcagctgaatgaagttgcaataagctgctgtaacaacatcacataaaggggctttaatcctgagagaaaaaatcagcaccaagggaaaccaagtgctctgggagacccaaagccatcatccaaaacatgcaagtctatttcagggcaatcagttttaagcctctcagatcagtcaatctcgatgttcaacaaactcagttattagtttgatagtttctctttttcttttgaacacatgttcaaaaaaggacttttgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtctcaaaaaaaaaaaaaaaaaaagaaagaaagaaaagagaaaatgagagcagtttatgaaatctaaaaaagaaagttaatatatatataaaacacccctagctcttgggctaggaagacaagtgcatccttactaaggcttggtcctgtcaacttcagaggcaataatgagagcccagactacagtgtctacagtaactgcaaaacagccacacagcacagcgggaacacattcacacgccaggagacccagcatacatgtgcttgaagaagttataagactcaggctttattctctaacgaaatggtcattccccctttgatgtgggggtgggggtggggatgccctgcccaccccccaattccggctcccactcagttatcccacataccatacataccatcaaagtatttaagcaatggcatgcaaagcaagctttcgacaggtttcttgcaagagaaaggcagaagagaacaggtaaaagcagaagagcacacaggtaaaagcagaagagcacaacttctacttaagcccaaagaagagggacctgttcacatcttgtcctacccggaatgatgcacacgcacaggggcttgccgggacagcagtagtttcactggaaagggctggtatggaggcaccgaggacaaggtccttccatcgcagcggtgataatgctctacccaagaaaaaaagattgcgtctgccagccacgcaagactggtctgcaaggatgtcaccatagcagagggcagggaaaacaagcaggtgtcctgccacactctttgggactggccagtctaggagtgtgctttaccccacgcactgaaaacactggttactagaaatatcaaacatttcctgtgattctctcctccaagataactcgggcagcttgagaacaagctgctcttagctaattaaaagatttctgctgatattaacctttataaaagatttcaggttccaggacacgtcatttatcatgcagagtcccaagcaggtacattagcaatggaaaccaggctccaataaggaactaacaattttatctctgttgttctttattttaggttaaagaaatgaacttctcgtttcatctccacatgggaggaatgttctggagggggtaacagcctattaaactcatctagctttttttttttttttcaaactccacagcttgcctccctaccctactagactagattgcacagaggcagggcaggcacgggaaacgactctggttggaaattacaaacatatacacacagaatgcaagcaccataaccctttgaatacacagtggtttgtgccttgccccagacctacctaaggatttaaacagcacagaagtcggagttcggctgactgcatgacactctcctatcaatcgggtgaaacaaagacccagtactctaagcttaaagcattccaggcaaaattttagttaacaggcaataggaaggtgtgataggccagtgctaacaagaaagccacagatgggtttctttgagctgttaagacactggaaagggctggtatggaagcccagtggagccattaggacaatggaaaaggaggtacccctccaccaggcactttgcagagaaaactatactctggaagctgcctgcactgttgatagggctagacgtatgataaacagctaaccggaggggcacccgaggagacaaactgccaactatgaagaacaaagcagagacctcaacttgtcacgtctcaagctcagatgtacaaactttgggatcgtcaagtgaggctcgtgtgtatgcctggggatatgactgtattccagtgatcagccacctagctgacctgccacgaatgggtgacctgtggtgacttactttaatcaactgtagtacttctagattgattgggtgatttaaggttctgacatattcaggcaagaaaataaaagcaagtgtttcctagacttcctcattgggatttgaaatagaaatcctgaaaagcccataaaagcctatttccctaaatccttggtggaaattcccaaaagattaaaaaatccagaccctgtcttattatagggacccagcagatttcaaaagactcaagaggtcagcttaatctggttattaactgaaattgctgagatactgatgaacattccagccatggaacccaaaattctctagagtaataattacctattagtgcaatgttactactgaggccgtatatgcttcatttttacagtataacaaaatgtctaaaacttatgagagtcctacaacgtctaggccactcagtatcacatccaagtaggtatggttcctggatcaccaaccaacccctgaattcgatcctgttatctcacagtctggggtactgatcccgcacagcagagacacaacgtgtgaaaggctcggcagagcccattcctgttcctggaaaaataaccagaagcacacatctgcctgaccatgagtcaggaatatcaattttgtggtggagcccatttctgctgtgaccaacccacacccgaacacactcgcaacagaagcaaccgccacagagcaattccagaatgagctttttccccctcggggtccatacttagcaatgtcataaacggtctcccctgcgacagcaatccttttacactcttcataatgaccttaagtctttagtgcaaaaccacagaaacattgccactgccatataaaagtcatctgagtttcagtttgggtgattcggtcatgaccaaactgaacagaggataacctttcaggcacaattaacaggagccacagcgtcgcgatgaacttgccccatctggtaccggtgatcccgagcgctccagggcgatgagagcccgttacctactatgtcccactccacttatgtaactggaagatcgccggcgaaggggagggtaggatgggagggtgctcacattccgaggccacagcactccaaagaacctctgagcaccctggggacacgctcgcaccttagagcctctggcgccgaagagcctcgggtgctgctggacgcacagtcccctacccacggctcctgatgggaactataaccacctctttatgatgagttgtgggacccagaacacaatgtctagtcccttttgtggataataatccccacctacttgttcctgctagatggggaaaggagccggtggacctactcgctcgcgggggggtagcggggggcagaaattcatggaatgggcgagaaggagggggaggcaaagcccagagatgggggtgagagctcaggagcccttgtggcgcactctcccgacgggaggcgaagtgcgcacgcgcgccggtgggggggccgagtaacgggagagggggcgcgcgagggagggagggggagagcgcgatccagggagaggccggggccgcgggcgcgcgacggcgccgcggcccaaagccccgagaagggcaggagcgcgcgcagccccgacaggcgaaccccggcgacaggggcgcccgcggggccgggggccgggatgcgcgtcgagggcgggaggaagaggggcgtcaggcgaaggcggctccagggaggccgcgccgaggacggtcacccgcgagcacgggtgacgggccgaggggagagtcgccaccggcggcggcgggagggggagggtagagaggagggacgccatccgccagccgtgtcgtccgaccccgcgggcccctcccgcgccacgtcccgcccctgacccccgccccccggcaagggtccccgcccgcggccacggcggtcccactcacagtctctcctcctcgcctcctcctcctcctccgctcggcgcggcggcggcggcggcggccattttccggacggcttttaccacagccctctctccgagaggagggagcgcgcgcgccgccgacgccgg

SEQ ID NO: 2444 - DNA, 75926 bp, Homo sapiens
taaatttataaggcaaactctttatataataaataggttacagggattcagtggggggggggtgtttttgaaacgtatacaggtacattcagacaggtttactgaaatggtacaaatttccttaataaattgccttttgtttttaaatatatcagtgctttcagtcatttggctatacacaaagaaccttttttctgaacactacaaaaaagcaatcaataatttttgtttttaaaacgacctacttattttctaaagtaattgtcccaaaacacaaaaactgaaggtgaatacgatacagggcttttagagacatctccagctaagtgtgtcccggcctctccctgtgccccaagtgcacctctcccaacctcagacaggtttccaggctggagccagctcccttctgcacagggtggcctgtgttactggcaatgctgtccatagctctcggcctctgggctggcacaggggagcatgacttcaactcaggagggggcagacaccctgcctagctcttccagatgctgcacccggcatgcaatggtcactacagtcagcactctccgcctctcagaggagggaggggctgtcaggtgttttgggagcccaaaaccatgcctaatgagggtaatggcttttctaaggagatgttttcgccatggaatgggaaggggttttctcacatctaagttttgctggcgatcgggtgacagccaagagagtgcaagccccctccatggtcattttattgccctgggaaggggagggtggggaatagagatgtcacagtgttgagccctggaggatggggtgggatgtgacggaagtgtcttaaacagtaatgcccacggggcacaccttggagagagaatgcccaccacctggcctgtccaggaagagctgcatctgccaacattagcctgacctgtgcccacagcagagcgtcccagcctcctgcttgggtgggcccagccccattctccccagctcttcagctctgcacacacacatcccctcctggctcccctcaaggaaacatcaatcttgcctttccttaaaagcacgggatggtggtaataatctcggggggaggggaagcaaaacaagaatccactgggcggaacaaaacctggttttgcagtgacttggaaagtggcaacacatcagctattcggcttgctggcttggagtgggactcctgggctccactgctttgggtggcttctggctgatctgggcaggggtcatctgttcagctctcccctctcatctcagtcaccatccccctccctccgaatgcttttgtttgtaaagaaaaagtgtctagaaatatttgtctctggaacaattactttaaacatagttacaatacagacttcagttcaaacacagaagagatttacttagcaaaattcctttcacccaccaaaaattacacaaatataagcctcaacaccacagttaagaggaccagtagagagaacctcatgtttggaacacaaaaggagaaataaaaaccaaaccaaacccaaacagaaaaaccccagaaagacaagtaaagggcaaagaaggaaggggaaggggagcaaacacagcacacgttacagtgtccagatacacgggagcccagcatgggcaagggctcggcacacattgagtaacagtcctggtgatatttggtcatatattcattgactactgactctggagcggctgttattgattgaagcagtgacaaatcaaacggaaaggaggccgtggtagcaagggaaggagcaggcttcaagttctgcaagccttttgcactccactgtccagctccccagaaacactgaaccgggtgggccccgctccatccgggcagggctagaggtcaccgggtgaggctaactcgggcgtcgatttcatgtcagtcagaaaacacgcacgtggacgcacgcagacacccacctgttcacggccaaacatcagcggcaacggcctcctcgcctcctctgcccctatcccaggctgggtgggaaagagcatcatgacccactgctaacactgaacacacgccggagctggccccggatgtgggcccagaggctgccccagccctggtcctccgaagggctcacgggtagcccggccactgaaagggcctatggctgtttttcttttggattcaggcctcagaagaagcaatgacagcagggagggaagcttttggccctggtgattataatgctctctgctttggaagaacaagtttctggatttttttggtgtttctaattattaaaaaaagatgatcaaaaagaactgttacagctaaactctctagcagatattgctcattaagaattacaaaagcaaatgcaattactcgtaggatgggggagaagaaagggacatttctggagtcttcactactcctggaggggaccccttggactgacgcacatgattctggggtccctggcgttctacctggtgcagctcacaggttccgagacaggccaggcctcccgtctccgctccagcccccaggctcgacagagtgggaaggatgaaacacactcggaccctactggcagggaggcctgcgaggctgactccacatgggctcaccctgaccaggtcacgggaaggggactgggggagtcaggccaccccagtggactccagctcccagaggtggaaggcgaccaggctgtgccgactacgttccggacttcagcaggtcaagggagcgctcctgcacccagaaccttgggacctctttcacaagcacgggagaaacaagagtgcaaaacctgggtgctgcctggagcctccttcacctggcacaggaaagcccttgaaagaagcgaggaaaagaccacgaatctgcttggacagaagaagtgaccagcagacagatttgtcgtttttttttcttttttttctttttttattttcccttgtcctatgctatggttatcagaaatattgtaattaagcaacaggtataattttaacaggtctttttttgtgtgtgtggagccacaagcaaaatgagtttataattgtgcaatatacagatatatatataaaaattcaactgctttgtgtgtctagtcggtgcgttaaataaaagggacagaaaaactaaaagcaaaactaaaaagcaaaacaaaagcccaggatagaggagacaaagcaggcctatgcgcacagtctatgtgttactggatataatcagggtcaccaggaagaacagctttgccacttgacacacaaacactgcggggagaggggctatcagtgggcaggagccaaacctcttggccttttcacctcatctgctctcactgctgagcaggacctgattaaaggtaggacagaatgggggtttgggggcaaagagatttccaaattccccaaatgttcttgaattcaaaggtaggatttcctccagggtctgggctctgcctgtgcacaagtcggagcccggagcgggagctgggggttgtgctccctccttgcactgccctcacacctgcttccttctgcctcctgacagggcaggcagggggccttggggaggcagtgagaggccagctcagaaggctcagctgatccgaggcgagcagagcaggagtgggcaaggcaggctgcccctcaggcagaagtgccttcctagttccctgggtgttttcctgacacgtcagcgctggggcaggctctgtcaagatgagaagagtgggaaggagggtggtgctgggccttccaggtcactggtgaacgctccaccttccataccactcccaaaagacaggttcagaagccatgtcctcaggtcggctacctccagattccccttgcctgtaatgctcaccaggcatctcaggccaagtgctaagtatttttagatcagcactgttgtaaaagcttgctcgtattcattcaaaaacatcgaaatgtaattttctgccaaatgttttctaggttttccttctaaattgttgagaactgacttcagtgttcagcttttcccctctaatatgtaattttagaccctgggggaggcagtatcctaacgatttataacaagtagactatgccttttctaaagattgatacaatatctaaaagagaaagacaccaaaatggagagaatcaacaaatcccgtcagagcagagagaagagtaggaagacccggagggagcagggctctgcccccccaccgggcaggtcctccagacccactccatggtaggaactctagaaacagctgactccctgaagtctaggacacaggtcctagaatctgcaggtgtgaacttgaaacaggaatccatttggggcaatgacacaggctaaaaatgtatatgcccaaagatcttcttaaagaactggtacctgtaacctcccctggcccagtcagcccagagagcctgactggaatgctctggaaaaggagctgtggttagacgggggacacagagttctggctgtcaggctccacttgggctaaaccaattccagatggtcccgcgcaggggactccgctcgtatccctctgctccctcctgggcttgagccgcttactaagtgatttaaaattcagagattctgtcagctaaagaaactcctttctccacccaacttggcagtttgtgtctggttattaccctctttcgccatcactgtcacagcaatgaaaagctgggcagagaagcaggtgacaatttggggctgctccctgtcccaggtgcactgttcatgcttcgggcctggaatgatgccacccaacagaagattgtctgcacccgcactggcgctcacgagtagcagcttccgccatccagcgagctgagaagctggggccgttggctagtttggcactgatggattgggggatgtggcgtttctgggtgtcccctgtgtcttttgatatgggaatacagcatcaacagaagggagctgtgctagcgcctggctgtgaccaagtatctccagctcactgagctgtcaagaccggcaatcccactggctatgacaagcccaccagcaggcagggccgggaggggtagacctggggggagctcgacgacatacagtattgtcaggagaggaggtagtaactaacaactggaacaagggtgggggagactgtggatgtggccttaatgacctagccccatgggtactggaaagctgtcggtcaattctgctgttcacaaattcactgaaagaggcccccatcttcataatgttcaagtacagacaaaattgaaattgaggtcacaccccaaaactgggccggacacagctggtgagaatcctgcagcttaaggctttccctccaacctcctgtcaacctgaccccaaggcaggggcagcatgagagctgcagggcccctgcctgccagggcgataaaccgccaaggctgcctgctgaaaggcgactgactcgtgatgcctttgggaaagacgagggaatgaggaagaaagggggaaatagagagaaaaccctaaggagcctcaggccccactggcagctctggaataaactggaagggaaagaggctgggcaactgcctctttgagggagctgcaggtggggcccgaatgaaataaagtgacgcttgaaatgctgtgttcccaaccacgactgccccatcggccctgaatgaactgtcatgggtgacaggggggcctggtgggccacgcactcctcttaccaggaccagatgacgcccaggtgacggggaagcagctctggacaatgattccagaagccacattacatttgactaagtataatacataaaaacccaactgaccaaaataaacatcttctcagtgacaacctggtcggatgctgcgctctcgtggataagtgtcctttggtagtgccaggagttcgaggccactatgggggcaggagccttctgtccttggaggaagagttctggaggactcaccctctcttctgaccccccttcccttcctggggaagagtcagaagtgaagctgggggggtcatcagcagagcaggtggaagggatcagggatcagggattgggctgatgggagtttggttgcaggacttgcttttacagcataaggaaatggacacatatatgctagaaagtccaactatgagactctacaaacagaacggggcaaactccctcacttctaaccattccagaagagacaaacacggttttttcttaagctactgattggaactgtcaactatggttcctgatcactaaagactggcaaggaagtgctagacagtttctatgatgtttcactccttcatgattacaccatagtaaggaagccagggacaataactgaaatacacaagacaacacacacttgacagttcatggcagcagctcacatgggacatgcctgtgggtgtttctggaagcataagactgctgtctcatttgctactttgataaggtacttctcagttggacagatttagatataagagacatctctgtaaacacagaaaaggatataccaatatgatgaagatatgcagctagataaggacttcctgaacagaggttaaaaagatgggatcccacatgaaaactgatcaattaaaaacccacagcaagcccatgcctctaagcccctacaccacagctatggaccagacagacagtgaaatgtgtggtgttctggccccctgtctgcatcgagcaaaagcaaaacattgccattcaagaagaactccgagggaaaagggggagcagaggaagggctggggacccaggtactggtcccagctcgggtcttgggagttctgcattggtaccgctactgccctgctgcactacgctagactctggacttctgagtgaggtcaaggtcggctggcatggagcccctgttgggccactcgatgactggcaggccacaggaggcctctgtgctttcctcaactaccaaatcgggcccagctcctccagtccacttctctagagtagaagggtgaaaaggctcgttgttcagggtgggaaatgccttttgctttttcttaccagggaagagggggctacctaggagagcaagaccttgctgctctcttgctcttcacagacaggccaggtcggactcagcagagcccaaggcctcctcagggctcaaaacagggtggggctggtactggcagcaggaggacaaagggcaggcagagttctggggactggagccgacaagtgtggttgggcaccgcggctgcctggaagagaagggatgaactaggaaggaggaggatggaggaagggaaagaagtgaaaggatgaaatgaacaaaaggcagaaatggaaggggagaagagaaaccaatcaggaagtccttataaaattgcagcaaacacttagagtttcggagcttcgtgggaaccctatgtgctgagcccactttaaaacaagcgcaggtatatatacaaatccaggtagttctcaacactgtcacatctggtggcttgagggactaaatgtcaccaattcaagccagtttgctctcagagcatctgtttgttttgaagtgggaacatgaagactcaatagtgcaaataattctaagctgtccctaaaggagaattggaaagtaactggaagaacattttcttctcctccccctttgccccctcccctgtccactaagtcacagactgctctgagtgattaggaatccctctcaccccgctgtgctctgcccggcctgaccccaggccagcctgcctgcaccttgtcctactgcctccatggcctctagcgccacccgttggaggacgtcccttgagaatggaccatgccacctcaccctgggccatcctctcctgtggttcaggccagtctacacccagtagttcaagggactcccccctcctagccatgccagagctggagcagacaggtgccactttcctgtcctgtgaagcgtccttgccagttttggattggggctggtgtggggccagacttgagccaccacgggtgggatcgcacaggccatagccactggtcatatccatcttctctaaagaatccaactgtctctcctgcctcacacctccctgtcccaacgtggttgggagtgggggaggtggggggagctgggggagctgtagacggggcactgatggcaccgaaaacgggagtgtcctctcaactgctctgtcgctctgtctctaacgaccacatgggggaaaggtttgggcgggaggggaggtgcctggtcaacagcttgtctggtcagtagtatctgcagcaagccttgttgaaggagcctagtttagaaaagtgcaaagctacttctggccctggttaggtcttcaacctgactgtgcttgtcggtaagaaaaacatccccaatgctccaactactcccaccctgaagccacgaaactctaagtttactgaaagaaaaaaaaatattttttatttcagttaatcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaacttatggtgcgcccacacactggagtactgtgcagatccaaagggactaaacaagagctctaagaactgcgatggagtcatttccaggatccactgtgaagcaaagggagcaaagcgcaaacatatctactgcattctaccaaagaaagaagggggggtattaaggaaggacacaccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgtatttttagtagagatggggtttcgccatgttggccaggctggtcttgaactcctgacctcaggtgatccacccacctgggcctctcaaagtgctgggattataggtgtgagccaccatgcctggccctaaatgaacttttaagagcactgaagatgggaaataaagggtctttaactctactgtaatattctagttctttctaatggaaattacttgaagcaaatatagtatgatgattttcaattctgtgcaatgaaaggcacatgggtgtttgttaatttgctggctgctacttttataattaaagacaaatttcaaaaaacccacaaagaagcctggattgtgctgggtgtggagtgcaggtaaaaatgataaaaaacgtggatggagctggagtccattgtcttcagtgacacagctcagacacagaaagtcaaataccgtacgttctcacttagaagcaggagctgaatagcatgtgcacatggacagagtgaggaatggcagacactggagagactgggaagggtgggagggggtgagggatgagacattacttaacgggtacaatgtccactattcaggtgatggttacactgaaagctcagacttcactactatacaatatatccacgcaacaaaactgcacttgtaccctttaaatttaacaaataaaaaacaatgatagaaaacaggtattccaaatgagtttacccttagcccagagggcctgcccagtcccagggtgacctgggcatttgcacaccctcactaagccttcactgcaggacccaagggagggaggctgggctagggtgccaggtgactccccaaggctgtcccccagggggtttatggtgtttgccgaaacacaaactttttcaaagaaacctgccaggtgtggtggctcatgcctataatcccagcactttgggaggccgaggcaggtggatcacctgaggtcaggagttcgagaccagcctggccaacatggcgaaaaccccatctctattaaaaatacaaaaattagctgggcatggtggtgcatgcctgtaatcccagttactcaggaggctgaggcaggagaatcacttgaacccaggaggcagaggttgcagtgaaccgaaatcgtgccactgcactccagcctgggtgacagagtgagactccatctcaaaaacaaacaaacaaacagaaaacaaaacaaaaaaaaccccatacacctctcttcatcctccctctaatcagaaccccccacacacacacaatcttgattatgaggagaactaaatagctagttcacaagttcatacattttacagttgaagtatcctcagaaaaaccacctattcaactcctgagtgttacagatggaaaaaaagaagttcgactagacagaggaacttgtctgagatcaccgtgagtcaaaaacacacgtgtctgttcaccaactgccttcgtcctgagccagatcctgcagcatccttccacctccaagaactcacagtttggaagggaggacaaataggtaactacaacatagttccagcctcccttccccctgaagaaagcttgctccaggcacagcggaagcacaggggtgtggataatgaatcaggagtgagtgggctgtcagggcttatgagttccacaggtgggacagagggctcagggcatgccaggccagatgggcagaggcggcactatcaacatggttatagctcccaccctatcacccgtgtgacgcccctccctcgaggaaaaagtgaccaatgatgcccaccctgtgtcaccagaggctctgggcctaaccctgtcaccccctcccaccttttcatttggagaactttcaggttcatctggagaactttcatctttcaggttcagttaggatggcacttctagaccgggcgcagtggctcatgcctgtaatcccaacaccttaggaggccgaggtgagcagatcacttgaggccaggagtttaagaccagcctggccaacatggcaaaactccgcctctactaaaaatacaaaatatttgccgggtgtggtggtgtgcgcctgtggtcccagctactcggggactgaggcatgagaatcgcttgaacctgggaggcggaggctgcagtgagttgagatagtgccattgcactccagaccaggcgatagaacaagattccacttcccaaaaaaaaaaaaaaaaagatggcacttctgagacaccttccctgctcctgcctccctccctgctctatgagccagggcacccgagccctcagtgtacttagaacaccccactgtgcgtgccaacccccatctccccgctcaatgcataatgccaggcacaggtgcaacccttactcaacacatgctggatgaataaccacaacacggacgcagcgctccacgtgcttcttctgatggctggagaccttcgaccgtaagcttctagcaaggagaggctagctcagtgctgaaaaaaaggtgggctctgaattggtgaataaacaaatgatgagtttgggacatatcagtagtccgttggacactggtggcttggagatggcggaagatgaggtggaggaagtcactgaggagggcctcagtgccccagggacagtagcatggaggatggttacgccagaggatggatcgacttctagccatgtggtggtcaggtatgcagacacctctcctgctgaaacaactacaactgccaaactgagtatcttacagaagctgctagagaagccacccacaagctggcaagaaaggaaggaatacacaggctgaagagcaaataaaagtacggggcccttttctgtggagaaatctggcaggcaccaccttaacacacgaccaaactgagctcaggcccctcagtgctgctgagatgaaccagcatcacgagtaggagactgaagcttaccgtgaggagacagcaggaagagtccagagagggcgtgccatgcaaccacggtctggactcaagatgatgagagaaaacaagggggtgggggaacatttctgataaaggagactgaagggatgacacaatcgaatacaacacacagtcctggactctgcattccaggctcaaaggctctaaaaaaggcatttatggggtatgtggagaaatgtaaggttctgtgttagctcattgctaaacttcctgagtgtcttaactgtactgtctgctcttaggaaaggcatgcttaaacgtttaggagtgaaacagcacgaggactatgactaactctcaagtgatcaatgggctaggggaaatacagtgccaatatggtaacatgtttaaaagaagggagatgacatcaatataatcagaagctatgccaactgacagtaatattttgaagcagtggtaggcaagctttttaacaattaaagagaatgccttcatattacacaaagacattaagaaaaaaagctgaaggctgggcacggaggctcacacctgtaatcccagcactttgggaggctgaggtgggcggatcacgaggtcagttcgaggccatcctgaccaacatggtgaaaccccctctctactaaaaataaaaaattagccaggtgtggtggcgcgcacaaagggaccggggcggtgctggcggcgatgccaacagacctcagtgtactgtggggttctttcagccagaactgttcatggtttcatcagtgagctccagttaccacaccacacaagtttggagtgatccaccccgccccagtttttcctgcacgaactcatgtttttattgtgtgatttacagaacacaagatctttttctaagaatgcacacatcacacgttgaagcagaaaggcctttacaaaatcttaaaatacctacaaaatatgaagtaaggctcttaagaaataaaatattcaatgattttgctgctagaatgcaaacattagatcaaatccttcatttgatctagcaaaggaaaattagagttgcaggaatcttgttttcaggccaaaccatgacatcctgaggggtctgatggcaggaactgcctgcattttcctcatgaatgtgacctgcagtgatcttgtgagaaaggcccggaaggccgtgcaaattacaggggtacaagcaacagctggcaggtgtggccagacaggcaactgcagttaaggaaagactactcaatccctgaggttttcagattttacaaaaaggcaaaaaagccaggtgaacaaggcagatgaaaggtatttttcacttgaattggaatccagccccctccctgtcccctggagtgagctccagagaaacttccagagccccagcaatatcccaacctttcgtaaattcactcatgctcgccactttcaggagatggcatttctcagcacctttcacttccagttatccctcggcacagcacaaagagctaaactaccactcgaggcagttaacctaagggcagggtggtggctacagctccaggtgaacagtctgggaccagaggaaataatgagcccccccttgtactggctgcttccaccctaaagtgtcatccagatggtgtttccaattctttctacttccagtattagctgcagaattacggaatcaaggaggcttctctgcatgaatcaataaaggctatagcactttgagacacaagctttggccctttaaaaatgtgagaaatcaaactggcacaggcagagtgtctcagtggtctccagggagcaagagagaatgaggttcagcttgaaggctacaagggtggagcctgaggttcagctgccctgctctgaattcgcagtccatttcttaatcctccacttttgagaagatgcgagaaaccagttatgttttgctaagcttaaataaaatgcagttcttgccaaccaaaagcagaaccctccccaaatacaggcaaccagtgccatacagcaaatctcatctttatagatgtgtaaaatgaaaaccgaaacacaagcccaccacatacaggttaaaaaattcctgctgtggagaacagtttggcagtttctcaaatgttaaacatggagttaccatatgacctggcaattttactcctagccatacactctcaaaaagccacaactatgccgggtgcggtggctcacgtctgtaatcccagcactttgggaggctgaggtgggtggatcacctgaggtcaggagtttgagaccagcctggccaatatggcgaaaccttgtctctactaaaaatacaaaaaaatttagccgggcatggtggtgagtgctacctgtagtcccagctactcaggagactgaggcaggagaattgcttgaacctgggaggtggaggttgcagtgagcagagatcgtgccactgtaatccagcctgggcgacagagcaagaccttgtctcaaaaaaccaaaacaaacaaacaaaaaaccaaaaccagtaaccaaacagatatccgtacaccagtgttcatggcagcacagtttacaacagccaaatggtgggggcaacccaaatatgcattcccaagggatgggtggataatcaaaacctcattatctataggatataatatcattcagcctcaaaaaggaaagaaattctgacacatgctacaatgcagatgaaccttgaggacattacgctcagtgaaagaggccagacacaaaaggccaaatagtgcataattccatttataggaaatgtccagaataggcaaatccatagagacaggaagtggatgagttgttgccaggggctgcgggtaataagaggtgactgctcctgtgtctggggtttcttttgggtgctgaaagtgttctggaatgacacagaggcgatggttgcacaactctgtgaatgtactaaaagacactgaattgcacattttatttttaaacaattttttctgtgagcctatgaattatactgaagaatgaattgtacactttaaatgagtaaatttcatggtatgtgaattatatctaaattaaaaaaaacaacaacattaaaacagcagctgaccaccaattattctaaatcataaagataggttttgtgatgcctggccagtgctcagagcccacacagctgtctcagagcaagtctatctggctgtggcacagagccccggcagatagatgggctgtccgtctgaggaagaggccaatgtggggacctatagtgatacatgacagactggaccaagccaacctgaatgtgaaactctgaagcccaggacacaataaccatgacaatcagaaaggaatttagttcaagaagtttaatgagtaggcatttagccaagtggaaggttgttggctattctgaggacatttgatcttttttttttaattgtggtaaaatacacataacataaaatttatcattaatagcatttagtacattcacaatgtcatgcgaccatcactactctctagttccaaagacaaccctttacccattaagcagttgctccccactcccactcctctcagcccctggtaaccactaatctatttgtctccacaaatctgcctactgttgacacttcatataagtggaataataccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaaaaagggggaaaaaagaccaggaaaaaaaaaaatcccaaaactaaacaacgaaaaagttttttttagggagatagggtctcgctgtgctgcccaggctgggctcaagcgatcctcctgcctcaggctctcaagtagctgggactacagatgagctaccacgcccaacttagaaacatgtatttttttcagattagctcatcattccctggtaacttctccaatgatttccccttgcatctctgccactatattctagcagggttctcacactgatcctacacacaagtggttagagactcaccaggccaagctcacctccaattccaaatacctagtcctcaaggtccaagtggcctgtttccatagacactgacactgtgcatgacttttctgtcctcagctgctggctttctccatttcttgttgataatgtttttttcttacctttacatacttcatgtaaataagtttcacagacttttaacaaagtgttggctgcttttatcaaagaagagaaaatctgccaaaataaattttcaccatgaaggcaacacattttggggaacaagaaagggcagaaaggagatctcttttactagagaactctgcttaaggactggctcatttgatccaaacatctcatcagtaacttggagtgagtgcccttgttttcgtcatcttgcgtctcactagtgtaggtcagtccacatcagcctgcctgacgtacttggttcgtaatgctgacatctgagcccccatgtttatttcaccctgattctactgaaatgaccaacgaaatgcaaaacaggaggaaatatctctatcaatgccttcagaggaaccgctgtagaatgtggtgtggctgggatccatgcgagagaagcagctctcacacgattccaccacagttaaacacatgggcaaaggagggacctgccggaggtatgaggattccgtagcagagcccaagaaaatctgcaagatcagagaaactgggcctaagagccagactggcagaagtacggtttgccggtggcaaatagaaggacctgaaccaccagtgccctaggtggagaggtcagtgacaggctggccaggttttcctgggcactgctgggacagagagagacaccaatatagaggagattctacctgtctcaagaatctgccagcagcaccctgggtccccaccctgactccagctgctgccacaggggaagcagcagggactgaagctccaccccataaacaactctagggactggggatcaaacaagtaccaacaaattagtaactgtcctgtgtacaaatacaaattaggtggaaactataatgattgaacaccagtcattccagtcaagatcccaactggaggccgggcgcgatggctcaagcctgtaatcccagcactctgggaggctgaggcgggcagaacacgaggtcaggagttcgagaccagcctggccaacacagtgaaaccctgtctctactaaaaatacaaaaaaattttagcctggtgtggtggtgcgcgcctgtagtcccagctacttgggaggctgaggcaggagaatcgcttgaacccaggaggcggaggttacagtgagccgagattgtgccactgcactccagcctgggcaacacagcaagactctcgtctcaaaaaaagaaaaaagatctcaactggattttctttggaatctgacatttacctagaataggcatctgaggacagccagaaggagtgtgtgtgtgtgtgtgtgtgtgtgtgtgtgtgtgtgtgtgtgtgtgcagggggggggatggcttccttctggtagccactgctctagggagtatttctcaccatcatgtcacaaagcacacaacaggagcactctcacatggattagggaattagatgcagacctcctgcacaactgccctcttccagtcctagtaagataagacacaaaagaaaggcagggaaggagagtgtgaagggaagatttcagcacacaaaggaaaggggtgtaattcaaagcagtctgagaaaagactccagaggacaaagcagcagcaaagccaggctcctgccccgtcccccagaaaccaccctagggagcgggcaacgccctgggaatttgcagtcagtaagctggagagaagcaaccaagtgggagtccttcactttttccttttagacccagaaactccagctgggaggtgcaggagaaatggcaaagtgcccagtgagccagcccagctctgtgggaagcaactgctcttaggtatacacagattatggaaccacccagagactgaggtgccccctatccccatggaaatggcacacacatccctcgtgcagctagagtgagccttagtaagacatccaacacagttcttagaacaaagagaagaatccagatagggctgaagactacatggctgcagctccctccagcgtgcaaattctctccggatacaagataacaagcctgcacgcgatagctcagaggggaaaacagcaagagaagatgccaagaaactgggaagagagagccaagaattcctccactgtctcaaagcaaacagaacgactatgcagagccatccaagcctgagccaagacgaaaagaagtgacatggtaactaggcaaacatattatggccagaagaaaaaaaagaggcccagggagggagatggcacgagaaaggcaaagtctcccaccaagaagagaatacacaaggaagggaaaaaaattccccacaacttcataagaacatgttcccaataaaagagttcaaagatgggatgataaaacagaataagatgaaaagacaaatttccaacctagagaaacaaactgcagaccaaaacacatcattatgaaactaataaatacattgaaaaacagccagaaacagaatatacatagctgaaaatcaaattagacaaagtgaatgcagatgaaaaagacaaaagctaaaccaattacggcaaagctaatagcattggaagagagacaaagacaatccaacatgaggaatttgtgtccctgaagtacagaactcaacaaatggaacagaagatgctgtcaaagatccataagagagctgacctgaaacagcaacgactacatctgcagactgaaagaatacaccatgttcccaggacaatttgataaagaatgctcaatagcaagccagactctagtcaacctactcaacttcaaggataaagaaagcattcttcaggcaccttgggattcttccaagggggaaacatcagaagaccagacagaatgtctacaaagttctgaggcagcttagcgcagtggtggtgggggagaggtcagaggtaaattcagagagatggacaggggccaaaagcctctctgagaagacgaaatctgaacacagatctgaaggaagtgagtggtgagggagcaggtcaagtaaagaggggtccagccaatgaggagcagcaagagccaaggctctgactctagcaacattatggcaagttccaggaagagcaagagcagtgggagccaggtgagcaagggagagaatggtagagaatgagctcaaataggcaaggagggatcatgttccatgtggctgctgaggcaggcccagttacacaatttgtggagcctggtgcaaaatgaaaatgcagggcctcttgttcaaaaattaagaattttgagatggtgagagtagagtattaaaccaagcctgggttccagcaagcccatgggcagttacaaaggcccatgaagctggctctgctttcaagtaatggacttcgggttttattctgagagggtttttctcaagggagtaacctgatctaataaacatttttcaaagagcccatctgaggctgggcacactggtacacgcctgtaatcctgcattttgggaggccaaggcgggaggattgcttgagcctgggagttcgagaccagcccgggcaacatagggagaccccagtctctacaaaaaatataaaaattagccaggtgtggtggtgcatacctgtagtctcagctacttgggaggctgaggtgggaggactgcttgagcccaggaggttgaggctgcagtgagtcgtgactgtgccattgcattccagcctgggtgacaaagggagaccttatctcaaaaaaaaaaaaaaaaagcccattctaactatgggaagatatagagtagagggagtggggcaggagggcacaagatgccacaggggggctctgcagaagcagatgttgggtcacggtttgaggtgtaagatgttcatcaggaactgacatccataaagggaggtgggaagaagtcaaagagaaggccctataagggccttgtacccttacctcgctcagtcaccagggtgctgtcctggaaatggcgtgaccttgggtgaggaggctcttgcagctgaggctaaccggagtgtccgcagggcatccagagaggagagtgacctccgggtctgccacgtgagactactgcagagtctaggcagggatgcagggagctggtctaggtgccatccctgaagggcatgggcaccgggacagcgaaagggcgagagatccaggactctggcttccgtttctcatgtttttgatactgaggtatttagctttctagaggcctaaagggcagctggatgtatgaatctggagttcaggggagaggtctgaagagccaggcgagtgcgtgagggcgtgctgaatataagtgtaaacaaccctccccctgctatttggagttgtgatgaggagaaagaatcagcagaggagacagagaaagaggagtcagtgcagagaaggaagatcagacatatctgtcaagattattggtggcaatcaatagaaaccaactctagctgatttatgcagacaaggactgatgaaaagctattgaagatgcatgtggtgatggttgcacaatataaatgtgctcaataccacagaattgtacacttaaaaatggttaaggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaatagtacagactggggggcctattcaactgaaatttctcacagttctggaggctagaagtccaagatcaaggtgtcagcacattcagcccctggtgagggctctctttctgacttggagatggctgccttctcattgcatactcacatggtggagaaagcaagctctctgctgtctcttgttataaggacactaatctcatcatgcgaaacccaccctccctcctgatttcatctaaacctaaccacctctcaaataccccatctccaaataacatcacattggaggtttgagcttcaacactggaattttgggggacacaaacattcagtccataacagtgctgatgtttatgttttaatgttaaatgataacagcacagcacagcagcacacacactgtgtgatgccaatctgtttgtttgtttgtttgtttgtttttttagataggttctcactctgttgcctgggctatagcagtagtgtgatcacacctcactgcaacctcgacctccaggttcaagcaatcctcccacctcagcctctcaaagtgctgggattccaggcatgagccaccatgcctggcctccaatttgtatttaatgccactgaactgtacatttaaaaatggtaaattttaggtgatgtgtattttactacaatttttttaaaagtctaagagaaggcaagaaaggagaaggaaaatttaaaagaacagaaaatatggaaaaatagaatgcacaaatatgctataaatgaatctaaatacatcagaaatcaaatagatgttaaaggacgaaacagacaatggattttttaaaaaatctcgaggccgggtgcggtggctcacgcctgtaatcccagcactttgggaggctgaggcgggcggatcacgaggtcaggagatcgagaccatcctggctgacacggtgaaaccccgtctctactaaaaatacaaaaaaaaaaaaaaaaaaaaaatcagccacgcgtggtggcgggcacctgtagtcccagctactctggaggctgaagcaggagaatggcatgaacccggggggcggagcttgcagtgagccgagatcgcgccaccgcactccagcctgggcgacagagcaagactccgtctcaaaaaaaaaaaaaaaaaaaaaatctagctatcagctgggcatggtggctcacgtctgtaattccaacactttgggaggctgaggcgggtgatcagctgaggtgaggagtttgagaccagcctggccaacatggtgaaaccacatctctactaaaaatacaaaattagccgggtgtggtggcacgtgcctgtagtcccagctactcaggaggctgcggcaggagaattgttttgaacctgggaggtggaggttgcagtgagccgagatcacgccattgcactccagcctgggcaacaagagcaaaactccgtctcaaaaaaaaaaaatctagctatctgacattttcaaaagctccacctcactgatgcataaagacacagaaaggaggaaaataaaaaactgggatggccgggcgtggtggctcacacctgtaatcccaacacttttagaggccaaggctggtgaactgcttgagcccaggagtttgagaccagtctgggcaacatggcaaaaccctgtctctactaaaaatacaaaaacttagccaggcgcgctggtgcaagcctgtaatcccagctactcaggaggctgaggtgggaggaccacttgagcccaggaggcggaggttgcagtgagctgagattgcaccactgcactccagactgggtgacagagggagaccctgtctcaaaaaaaaaaaaaagaaagaaaaataaataaaataaataataatttaaaaaaaaataacatattagtatggtcgcttcataataccaaagggttcaatacaccaggaatgtgaaactgtatctaaaactgaaaatgtggcctcaaaataaataataaaatgaaaatgaccaaactctgtggagaaactgatgtgtccatcaccacagtaggttttaacacgtattccatcagttgataaatcaagtaaacaaaatgacagtaagaagagaaaatactttcacaacaaacggataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcctcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaaatatctttgggctaacttaaagtgacaatactatcagaacttgctagatacagttgaagtagttccagagggttagccttaaatgtttacatttgaaaaaagggtagaaaaatcaatgaaccaaatttataacttaagaagttagggccaggcgtggtggctcatgcctgtaatcccagcactttgggaggccaaggcgggtggagcacctggcgtcagcagttcgagacccgcctggtcaacatgccaaaaccccatctctactaaaaatacaaaaaatttgccgggtgtggggcaaatgcctgtaaatctcagctactcgggaggttgaggcacgagaatcacttgaacccaggaggtggaggttgcagtgagctgagattgcactactgcactccagcctgggcgacagagcaagactctctctctcaaaacaaaaaacaaacaacaacaacaacaacaacaaaacacagagaatgtactctaagaccatagaaaaaataataaagataaaagcaaaagcagaatttaatgaactagaaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgtacatagaacacctcaaaagacacagacaagaccctggatgcagccgttccctgaagagaggcctaggcagctgggagaccagggcagcagggacactcagaccttgcatcactctggagtttgcacttcctgaattgtgaagcatgcacatgtctcacttatgcaacagtgaatccaaacgtgcctgtatacaaggaaaggcctcacctggctgcgccgtggaggctggcctggcgtgtggagcaggcagaacattagcaagctaccgagcaggtgcaggtatgaacatcagctgacgctggctctttgctttctttttaatcttgacaaatttggtaggtgaaaaggcatcatttttgttctcgtttgcatctctttgattaccagcaggcagaactcttttcctatcttcattggccatctgtatctcttcttttatgaatttcctgttcatagtctttgttcattagtggtgactagtggtaagttagcaataagaactgtttgcattcaagtctagactgagaaggaaattaaaaaatctgcccatgtattctcacaataaatgactactgactagcctgagataattgtacccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtgtttttaccttgcccagaccctgcacactgcatcaaggtcctgagtttcaagcaacagaaatcaactctggttaaattcaatcacaaaggagttcttgggcagcagatctggaaatggagagagaactagagaactaggctcagaaaagcagcaggaatagaggctgcaccactgcaaacacagccaaggttatactgcagggacctgctggttgggacacccaccctgggcactgttgcatgtcatcactggacattagccaccactgctggttttgtgactcaactgccaccaccatgactaatccctcactgtccctcaagagtcaaagtccctgaaggcagaatgggtttggccaaacctaggcttcatcgccatcccctagtttccagagagcaaggggagggaatatatccattcccctgtggcaggcactgccagttgtcccccaacatccatgttctccatctgccttactaatgagaccctgcgctcagctaaggagagttattccccgcttcccagcagaccatgggactacgttatggctaaggagacagtggccgagtgcactcctgttcatcgttctctttcaagcttgctcttgttctactgactatgggcggagcacacctcccacccactgactctgggcttgctcacgtgttgatgggatgggggaagaagaggctttaagaggcttctgtgactctgctcactcctcttggactcctgacctccgcctacgaagagacttcccctggcagctgcttctccctcctgggtcctggaacgacaggcttgagaacagatctgaatcccatcttgcagctgacccagacccatgtgtgagaaataataattgctgttatagctactgagctgctggtgctgtttgttccctaggacaagatgatgggtgtgaagatggaaatggaaatattgaatgggcctagaagttaagatgtcaagtgccattttgcctttcccctatgacctctttcttcctacctggaggagtggatgcaatgactagagcagcaaccgtcatctcacaaccaagaggcaatcttgagaaatggaagacacccactgaggggccctgggtcctggatccttacaaagccactgcagtggtcatggacagcatgagaaggaagtacaccacaggcccccaaccccatcttcaggttttcttaggtagaaactagggtccacctgcctcttactaagatatacacaatggggagacttttaacacaaaaaaaggtatgaagatggtcagaagccaaaaaagcaacaaaatgttcatgatatgccgtatgtggggtttactcactacactgcttttccaccgagttagcataatcactataactcaacccattgaaaaaatgacaaaacagattctgagattctcttcctatttctgttagctaaaaaagcagcctttgaattgtttataagtgaattcaagagataaaaataaacccagataattcagaatgtactgagtacaacacatatgccttctatgtgataagctcccagcattatttattcaaagaaaacttgccttgttgcaaaaatataaaaaaacttaaaaaaaaaaaacaagtaattacacaacacaccacctcctacaacaccagattccttttctttcctttgtaacctgaccagaagaaaaacaaaacattgttcaaattgctgagacccacaaagttcaattagagcataaaaaatgctctcccaaaatatagctactagcagggaaatgagcaggctaagcctcctggtgaacctggacattgggcacaagtaacaggcacatttagacaccaacgaccagattccacatgactgaatccagaaaccctgccccttcccattcccttggagatccagggggacgccatcaattgctcactccttctccttacacatacagttaggggtgctatactatacaggggaaggcgtgaggaagtcacacatgctttggtgttcaagaagctcataaagccattagggaaagagcaacatgccagaaagcagttgtctcttctggctacagaggttgcaaaagacgtctgcaagggtcagtgagggcccaaaggagtagtaaccaaggccctgaagcctgcctgggagctgaggtgggcagtatcagcctcttctcaataatcagttcctaaggttccatccgagaaagtagaaaaccacagaggccattctcatgggtactttaagcagtacatctgttggcaaaacacaaatgttgttacacaaatactaagccacagattgcaaaggcacctgacagcctttaaaattcatttctcttgtttcgcaaagctgcactgggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaacttttacagcactatccactgtaaaagttgtttgagaaaaaataaaatgtagccagccttcagagcatatatgcatctttattttattttatttattgagaccaagtctcactctgtcgcccaggctggagtgcagtggcacagtctcaattcactgcaacctccgcctctggggttcaagcgattctcctgcctcagcctcctgagtagctgtgattacaggcacccgccaccacacccggctaatttttatacttttagtagagacggtgtttcaccatgttggccaggctggtcttgaacccctgacctcaggtgatctgcccgccttggcctcccaaagtgctgggattacaggtgtgagccaccacacccagcccagagcatatgcatctttaaaaagttgtcttcggccaggcacggtggctcacacctgtaatcccggcactttgggaggcagaggcaggcggatcacctgaggtcaggagtttgagaccagtctgactagcatggtgaaaccccgtctctactaaaataaaaaaaattagccaggcgtggtggtgcatgcctgtaatcctggctacttgggaggctgaggcaggagaatcgcttgaacccgggaatgcggaggttgcagtgagccgagatcacaccattgcactccagcctgggcaacaagagtgaaactccgtctcaaacaaaacaaacaaacaaaaagttgtcttcaagagcataatcaaagatactttcacttcttaatgttttgtttccatgtctcgtcacagaacatggtacagacaaatattagaatagactcaagggatcacttgattttaactacagaaactttccggtgaatcatgagcactgtcttgtttccagctgctgaagtatatgggcaccagacaagagcacagcgctgtcactcaaagccaggagtaatatggctgttaccatgaggactacttagcagaagataagcatctcattatgtctacagtgaactaaactattgttgccaatggtatatggattaggaccgactgccactgcccatctgcttatagcttagaatctggtgaatgcaaacaactgttttggggggacttctggcccttccttgggctctgctatcctggaaatggacaggcttctacaggggttcgatggtagccccgaatagttaggtgtatgtcttaacccccagaccctgtggctctgaccttatttggaaggtctttgcttctgtaattaagtgaaggatcttgatatgagatcatcctggatttagggtgggcctaatacagtgacaagcatccagagaagaatacggggacacagagaaggccatgtgaagacacaagcagagaatggagcaatgcaactgcaagccaaggaaagtctaggactgccaggcagccaccaaaagctggaagaggcaaggaaggatccatgctagaggctctggggggaatggagccctgcaacatcttgatttcagacccctggcttcctgcactgtgcaagaatacagttaggggtactttattctgactactccataaacttaagctctaattctcgctcagcttctgagctttaacaaagggtccgtgcaacttctaccgttcccgttccccgtctttaccaaagaggaagcatttactcaaagcccacctcctgcaacagctctagatgccgcttcccccctccacacaaggagtctgctcctccaggtccccatttcctccttctcacgctcccctctctcctgggccattcccagaaggatgtaaacatgctctcatattcacccacgtgaaaaacaccctcatccccctctaccccactcctatttttctggtcaccatcacaacaaaacttcttaaagagagttgtctatacccaatctccactccctcaccttccactcactccaatctggcttctgtccccatcacctctaattcagttcaccatgtgacaggtagggtttttgctagttttagacataatggatcttgttattcctgggctttaaagccttcaccagaggatggccaactgcctacatgtaattgccacttgacccttcaaacctcaaagaaaccgaagtacagacatatgaaagggaagaaatttctaacagaggcaatagcaggagaggacctctgaacggataagatacactcagcaaatttctagatgctggaagtaggcaagaacatgttgactaatggaacagagaggaatgtactacaagagagctgtagagcagatgagagcctgtatacctgtcagagccccaaagaagctctcagaccagaccagaccagaccagaccagaccagacgagaggaggggcaagcagtgctgtcatgtgtgcaacacctgggggctgctgactgccagatcccgacccacaagctttggggcagggcaccttcaataagctcccaggtgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagcccaggagttcaagaccagcctagacaacacagacacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtgacacagtgagactctgtctcaaaaaaaaaaaaaaaagtatccattaaaatattttcaccctttaaaaatcaggttgtctttttattaccgagttataggaattcttctgaatacaaatcctttgtcagatatgactttctattttttctatgactggtctcaactgttttcttggtggacttgtcttttcattttctttgagacagggtctcactcagtcacccaggctggggtgcggtggcgcgacctcagctcactgcagccttgacctccttgggatcaagcaatcctcctgcctctgcttcccgagtagctgggactatggactacgggtgcacgccaccatggttggctaattttttgtatcttttgtagagatgggatttcactgttgcccaggctggtcttgaactcctgagctcaagcaatccatctgccttgtactcccaaagtgctgggattacaagcatgagccacagctctcagcctattttcttttgttttttctttttctttttttttttaagagacactgtctcactatattgcctatgttggcctagaactcctgggctcaagtgatcctcctgcctcagcctctcaagtacccagtagtgactacaggcaagcctcaccacgcccagctctgtcttttcattttcttaatggtatcttttgaggaccaaaagttttaaattttaatgaagtccaatttattttttcttttaatagctattgcttcatgtatcctaataaatctttttttggcctggcacggtggctcatacctgtaatcccagcactttgggaggccgaggcaggcagatcacttgaggtcaggagtttgagaccagcctggccaacatggcaaaaccctgcctctactaaaaatacaaaaattagccaggcatggtggcgcacacctgtaatcccagctacttggaaggctgaggcatgggaatcgcttgaactcgggaggcagaggttgcagtgagctgagatcgcaccactgcactccagcctgggcaacagagtgaaattgtgtttaaaaaaaaccttattctttggactgcacagatattctcctatgttttcttgcagaagctttatatttttagcttttaaaacatttaggtctataatctctcatgaattaatttttatgtatggtgtgaagtagtgtcatgggttggactatgtcccccaaaaaagatatgttgaagtcctaaccctcagtacctcacactgagaccttagttggaaacagcgttgttgcaggtgtaattagttaaggtgaggtcacactggagtagggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccaggctggagtgcagtggtgcaatcttggctcagtgcaacctcccaggttcatgcaattctcctgcctcagcctcctggctagctgggattatatgtgtgcaccactacacctgactaagttttttgtatttttagtagagacaaagtttcaccacgttggccaggctagtcttgcactcctgacctcaggtgatctgcccgactcggcctcccaaaggccgggattacaggcgtcagccaccgcacccagccaaatttctgtggttttaagccacctagtttgtggcaactctaagaaactaatatttagggtaaggtcaaggttcatttttgtctggtatggatgtcatttgccatcatccggcacgtgctaaaagactttcctttcccgcaccggactgttctggtgcctctgttaaaaatcaaatgactataaagtcacatcacataagccccttaattttgttctctttcaagtttactttggatgttctaggtcctttgcatttccatatacgttttatttatttatttatttgaggcaaagtctcactctgttgcccaggcgggcgtgcagtggcatgatcttggctcactgcaacctccacctccgggttcaagtgattctcatgcctcagcctcccaagtagctgggattacaggtgtgtgccaccatgtctggctaatttttgtattttttgtagagacggggtttcgtcatgttagccaggctggtctcaaattcctgacctcaagtcatctgtctgcctcagcctcccaaagtgctggtttacaggcataagccaccgtgcccagcttccatatacattttacaatcaatttctacaaaaaaaaccctgcagttatgactggggttatgaatctacagttcaatgaagggagaactgacactgtaaagacacttagtctttcagctgatgaacatggtacaacattccatttatttaggtctttaatttctttcagcaacattttcagtttcagcgtgtaaatcttgtacatttcttattaaattattcctaacgatattgcatttgaaatttcatttctgattagtttttgaatgatctcgtaccctgagaccttgctgaattcactttttagttctagcaggttctgatagtttctttcacattttcgacattacctacaaatagaaacagttttacttcctttaaatattaatgcctcttatgttttttcttgcctcattatactggctatgacctctagtataatgttgaatagaagtggttagagtggacatctttgcctttttcctgattttcggggtaacatgttcaatatttcacaattaagtacaatctatctgtagctctttcatacatgcacttcctctatttctaatctgctgaatttttatcatgaaagggcactgaattttgtcagatgcgttttctgtatttattgaatagactatatggtttttctcctttattatcttttttttttttttttttttttttggatactgggtctcactgttgcccaggctagaatgcattggcgtgatctcagcttactgcaacctccgcctcttggtttcaaggattcacctgcctcagcctcccgaatagctgggactaaaggtgcgtgccaccctgcccggctaatttttctatttttagtagagacaggatttcactatgttggccaggctgctctcaaactcctggcctcaagtgatctgtccacctcggcttctgaaagtgctgggattacaggtgtgagccaccgcacccggcctcctttattatcttaatgtggtgaattacaccaactgatttttgaatgttgaagcacactcgtgtttctgcgaaaagcctcttggttgtaatatgcaggcgcacctcatttgattgtgctttgctttactgtacttcgcagatactgagtttttaacaaattgaaggtgtgtggcaaccctgcatcaagcaagtttaccagtgccatttttccaatagcatgtgcttacttcatgtctctgtcacattttggtaattttcacaatgtttcaaatttctcattattatatttgttatggtgatctgtgatcaatgctctctgatgttactactatcatcattttgcggcaccacaaactgcacccataaaagatggcaaacttggccgggcggggtggctcacgcctgtaatcccagcactttgggaggctgagccgggcagatcacctgaggtcaggagttggagaccagcctggccaacatggtgaaaccccgtctctactaaaaatacaaaaaacaagctgggcgtgctggcacatgcctgtagtcccagctactcgggaggctgaggcaggagaatcgcttgaatccaggaggcagagactgcagtgagccgagattgcatcactgcactccagcctgggtgatggagtgagactccatctcaaaaaataaaaaaaataaaaaaggtggcaaacttggccaggcggcagtggcttacgcctgtaatccccgcactttgggaggccaaggcgggtggatcacttgaggtcaggaattcgagaccagcctggccaacatggcaaaccctgtctctactaaaaaatataaaaattagctgggtatggtggcgcacgcttgtaataccagctactcgggaggttgaggcaggagaattgcttgagcccaggaggcagaggttgcagtgaactgagatcatgccactgcatgccagcctgggtgacagagcaagactgtctcaaaaaaaaaaaagaaaaagaaaaagaaaagatggcaaaacttaagtgataaatgtgtatattctgactactccaccaatcagctgttcccccatctctctctctctccttgggcctccctattcccttggacaagacagtactgaaattaggccaattaataaccctacaatggcctctaagcattcaagtaaaaggaagagtcatatgtctttctctttaaaccaaaaaccaaatgatcaggcttagtgagaggcatgttgaaagccgagaagccaaaagctaggcctcttgtaccaaagttagccaagttgtgaatcaaagttcttgaaggaaactaaaagtgctactccagtgaacacacaaatgatatgaaagtgaaatagccttattactaataaacgttaaggaagttttaatggtctggataaaagatcaaatcaaacacaacatttccttaaggcaaagcctaatctagtgcaaggccctaactctcttcaattctatgaaggctgagagaggtgaggaagctgcaaagtgtattgtttaatttttaaatatttggggctttctctggatcttccattatttcttttttttccccccactcactctgttgtccgggtaggagtacagtggcacaaccacagctcactgcagcttcaaactcttaggttcaagcagtccctccacctcagcttcctgagtagctgggactacaggcgagcgccgccatgcccagctatttatcgtaatattggtattataattttgtaattttatgtctattacaagataaagcaaataagtaactatgttaacattagtaagacccaacattttcagtgtaaggaaaagatatatacagatcaaataaaagttggccaggcatggtggctcacacctgtaatcccagcactttgggaaatcgagatgggaggatcacttgaggccaggagttcgagaccagcctgggcaacgcaacgagaccccccatctctacaaaaaatttttaaaaattagctgggcatggtgatatgcacctgtagtcttagctactcgggaggctgagggaggaggattgtttgaagcctaggcatttgaagctgcagtgaattaggattgtaccactgcaccactccagcctgggcaatagagcaagaccctgcctcaaaaaaaagaaaaaaaaaaaaaaaagttaaggaagaaccctgtaatgttaaattgccatagaagacatcattatgtatttatgacttaaaaaaaaaatggagggcacagtggctcacatctgtaatcccagcactttggtttttttatttttcttttgtgaaaatatttaccagcagtttgccctgacagatgtaatcccagcactttgggaggctgaggtgggaggatcgcttgagctcagttcgaaaccagcttgggcaacatagtgagaccttgtctctacaaaaaaattaaaaataaaaaataaaaactgaatatattttctagcgatgtcctctgaaagtgcctagatataatgttaccccagtaagaatcagcacatttagtacccacatgttggattctaaataccgttgccactataaggaaccagagctccttggaatcagttctaggacacgaaaagcacatattgggatggaatatcttgtgccagaaaacaagaaattgctcaaagactaattaatgagggtatgccaggagaatataggaaccaacatgaagggactcttgttgacccaatttgaattgtaaaacatttaataaataaatccctatgagtccatattgacatgaaagagaaaaggaaacacaacagcaaatattttgccaccatttgaggtgattattctaccaactccttactctgaaatgtaataaaggcaaagattaagcatctatactgtctttttaggaggaaatataatgcctccttatttgatgagggaaaattcattacagaggaatgacagtactaaatgtagaagaggtgacaattaaaaaaactatcattttgcaacccccaatgtaataatggtttcaggcaaggatcaatgaatgctaaaataattatgcaaatggctgttgggcaataggatatttgtatggtgccaaagcatcacatcacagattatatatcaattaccacaggaaaactgtatgtctacaatggggagatttggcagtcacctccttctttaatcaagtgttaaaacgtagcatcacaaaccacagggtaaccaaccattaagtgcctggtgagctgatgctatatgaagtacacagtactgcctatgaaatattcttgcccaaaatgtttaacctgaacatgcctgtagacctaacttcttgtctacaagtaatatatatggacaaacaagttaaattatatcacaagaaaagagagacatctaaaatgtgggccagctagtcgtggtggcacaagcctgtagtcccagctacctgggaggctgaggcaggaggattacttgaggccaggagttcaaggccagcctaggcaacatagtgacacgccatctctaaaaatatgtatcttaaaatgtgggcccttctagatgacaattgggctgactgcttcaaaaagtcagtatcacaagtgaaggagaggtgggtaggctgttcttgttaaaagagacaaaggggctgggcatggtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgaggcaggagaatcgcttgaacctggaaggcggaggttgcagtgagctgagatcacaccactgcactccagcctgggagacagcgagactctgtctcaaaataaaataaataaataaataagagacaaaggaagcatattcaaatgcaatgtataaatcttaattgctttggagcccctcaacagcgataagagacatttggaggaaatctgaatttaaagtgggtgcctgataacattagagaattattgttaacttttaaagatgtgatcggggtattgtgcttatattggaaaatgtccttatttttaggagatgtatactgaagtacttaggggtgaaatgtcgtgacatctgtgagttccttttaaatggtgagcaaaaaggtataaaaatgcaccctatctatacagaccaggaaaatacgccaaaatgttaacaattgtctaatctaggcagtaggcacacaggcttcacagtaagttaaaaaaaaaaaaaaaaaggtttggctgaaataaagaatttaacagaagggatagaaaataaagtcaggaggctgggtgcggtggctcacaccactttgggaggctgaggcgggcggatcacttgaggtcaggagttcgagaccagcctggcaacatggtgaaaccccatctctattaaaaatacaaaaattagccgggcgtggtggtgcaggtctgtaatcccagctacgtgggaggcagaggcagaattgcttgaacctggaaggcagaggttgcagtgagccgagatcaggctactgcactccagcctgggtgacagagcaagactctgcctcaaaaaaaaagaaaaaaggaaaaagaaaataaatgcaggagatcttccaaaattcagagcaccccccaccgcccaataaatgaaaaatatgagagaagacagaagaccaatataagaggtccaaagttaaacagtagtccccatagagaaaatgaaagcatgtaaattagtaatttttttttaaaaaaaagagttgacaaaagtattcagattgaatgaccacagtacaacgagtgaacaagacacaactctagacatattctcatgagatttcaggacactaaaaataaggagacgaaatcctaaaaacttccagggaaggaagagaaaagaagggcacctacaaaagaaccataataagattggcatcaggcatttgttgcatttgttactctgcatactagaagagatgcctccaaagttaggagaaaaaatgattttcaacttggaaccctatactcagccaatcaagtgtaagagtagaagaaaggtatttcaggcatgcagtgactcagaagacctatctgttacaatgcttttggttacaagtaacagaaaagaaaactgaagctggctcattcagtaagaaagtccatcctatctgagtccctagctcaggtaggacaggccccagccacagtgcaatcaccagctaagcaacggcatcaagacccaggttcttcccgtttctctgctccgccttccttggtgagcaggctttatcctcaggctttgtccctcagtctgaggttacagaagagcccccagcaacacctttctcacttactccagtgagagaaaaagagaaagtcttccctgaacgtgccatggaagtccttcccttcagtctgagtgaaccaacttagatcgtatgtccatccttgaccagtaacagttgccaaaggaatgcaatgtgtggaatgacttaaggatcctttctgaagttgggaataaggtagaaaggtgaataatatcaggattctgttaggaatgggcaaagaagaaatggatatggggtaggtgacaacggtatccactacagtttactccccatgcactctatctgagcacattatttaaggatgcagtccagaaaacgagggagtaaaccatgtgaaaggaagatatgggttttaagacacgggctccaacccaagagcccagtgaggagaaggtccaggtacagctgtatatgcaaccttaaatcaaagagcagatacttgcccagattgcagaagggcagaggccttccaagagaaaggtcttcagtggggaaaaagccgaatcgtacgaaataaacagcactgctaatagcattttacaacataatcaaggaggaatagtaaacaaaataaaaaggcaactagaaatggtgggcaaaacaaagagctatataagcaagccaaggtttgaatatgaagtagattaaatcctagcaaggattttaagcaggtgacagagtctaagaaaagggaatccatttgaccttgattggtcattctcctttgagtggtccagatctgtaaagaaggaaatgtaatcctgggcacattcattatttggtctcgccaagaacaatactcacatgtgtaataatgtaaataatgttattttcgactttagaattaagctacaacttggctgtggttgcagggcagaacacacatgttaacaaatgcaagaatgggtatggtcaagtacagcttttaagacgcagaagttaaggagggaaagtggaaggaaaagtagggttattaatatccttatcttaaaaagaggggaactgacatatggactaaaatactgtttaaaatttacagagaaatgtgggcttggcatggtagctcacacctgtaatcccagcactttgggaggccaaggcaggcagatcacctgaggtcaggagtttaagaccagcctggccaacatggtgaaaccccgcctctactaaaaatacaaaaattagcccagtgcactggtgtgcgcctgtagtcccagctactcaggaggctgaggcacgagaattgcttgaacccgggaggcagaggtttcagtgagccgagatcacatcactgcactccagcctgggcgacagagtgagactccatctcaaaaaaaaaattacagagaaatgtgaatatgaatttcaacatggggaggtaacgtaagctaagtcattctctttcatttcagggagttaacacagttccctaaagttggcaaatcaagaaagatgtataagcatatgatttaattttggaggtaaccatcaaaggaactaaaatcagaaacagttaaaagctgtcatgtctgagtcagggaagggaaggggaaggggtagactgctgtttttacgatgacctcttttgttatatctaacttgttgccgagtagttgcaatattttgataaaaattcaaaacccaaaccaccttacccttcatgttttctatcgctctgatgttaacattcaaaatcctgcatgatccagcccctgttgacctctctgatggcccggaccctttgccactctcccctaacccctcgttcagctcctgccacacaggactaagctcttgccagactgagggccttcacacatgctcttctccatctggaaagcctttttcctctctgcaccttgcccacttctgttcaaccctcggttccctgcatcggcgttgcctccttggggaaggcaggctgagctgttcccccattgtacagtcatgagtcgctcaacaacagggatatgttctgagaaatgtgtcattgggcgatttatttgtgctaacatcagagagtgttcttacacaaatctagatggtgtagcatactacacacctaggctatacggtatatagcctattgctcctgggctataaaactgtacagcatggtactatactgaatactgtagatcactggaacacaatggtaagtatttgtatatctaaacatagaaaaggtacagtaaaaatatggcattctaatcttatgggaacaccactgtatgtgtgctctgttgtcggttgaaacgttgttgtgcagcacgtgactgtagaggactggagtggctcccacctccatacttgtccttctgaacacttaagtactggtacaattatctaagatctgtctctgccgctaaagtcaagctccatgaggacaggtaccaaatctgtctaggttaccccatccctgcctaacacagggcctgaggtactatagataccttacttactcaattgtggaatgaattgatggactatagcctgatgtactgcaaatccttcagcatgcagcaggaatggaacttggtgtttaaactaaactataatggctagatgaaaaagagactaaatgtgaaataattccatcattcagaattgagtgttggtataacaaacagacccatgaaatatgtagcgtttcacaaggatatcagtgaggaagttgttcaatatgtcatccgaagtcccgttgcataatgatacttgcacacgcatgcttatagcagcacaattcacaattacaaaaatatagaaccagcccaaatgcccatcaatcagaaagtgaatagagaaattgtggcatatatatacaaaggaatactactcagccataaaaaggaatgacttaatggcattcacagcaacctggatggaactagagactattattctaagtgaagtaactcaggaatggaaaaccaaacaccgtatgttctcactcataagtgggagctaagctatgaggatgcaaaggcatcagaatgatacaatggactttggggacttgagggaaagggtgggagggggtgagggataaaagactacaaattgggttcagtgtacactgctcgggtgatgggtgcaccaaaatctcagaaatcaccattaaagaacttactcatgtcaccaaataccacctgttcccctaaaatctatgggaataaaaaattaagaaaataaataaaattttaaaaggaaggtcatccctacacttcaagttataaaataattctaccgtaaaaaaaaaaaaaacacacacacacacaacaacaacaaagtcctgttgcgtacctctgagaggtgttttgtggcttggactagcatactggcagtgcagatgctgagaagtggttggcctaacaggacttgctgacagatcagggatgatgagagaaagagcagaatcagggcgggtgcagtggctcacgcctgtaatcccagcactttgggaggctgaggtgggcggatcacaaggtcaggagttcaggaccagcctggccaacatggtgaaaccccatctctactaaaaatacaaaaaattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatttgagacacttatgagcaactcaagtaaatgctgacgaggccatcaaatctggagctcaagagagaggtttgaaatgcagaaacagggttgtagccatcagcaggcagacatatcatcattcagagtcatgaacatgcagaaataatggaaatgcctcttaattaaatgaaggcatagacatacaacgaaatgttatgtgattactaaaaatgatggtagaaaaacattatccagaagttatctttatctgtagatgacagatttatggacaatttttacttttcatctttgcatattttctgaaaattttttgtccattgaacatgtattacttttataataagaaaatgcaggctgggcacagtggctcacgactgtaatcccagcactttgggaggccaaggcaggaagatcacttgaggccagcagtttgaggccagcctgggcaacatagtgaaatcccatttctgcaaaaaatattttaaaaattagccaggcgtcgtgacatgtgcctgtagtcttagctatcttggaggctgaggtaggtggaatacttgaaactggaggtggaggctgtagtgagctgtgacatcactgcactccagcctgagcaacagagcaagagcctgtctcaaaacaaaaacaaaaacaaaaaagaaaatgcaagttaagttattttcattttagggaaaagtgaagatatacgtctatttttatggacatggatatttacaacattttgttgaggaaaggtagcaagttacaaaagtacatatatgatctcattcatctaaaacaatatgtgggccaggcacagaggtgcacacttgtaatcccggcactttgggaggccgaggcggaaggatcgtttgagcaaaggagtttgagaccagtctgggcaacatggtgaaactccgtctctacaaaaaaaatacaaaaattagctgggcatggtagcggacacctgtagtcccacctacttgggaggctgattgggaggatcacttgcacccaagaggtcgaagctgtagtgagctgtgattgcaccactgtgctccagcttgggcgacagaccttgtctcaaaacaacaacaacatgtgtacgtgcttacaggcaaataagaaagactctagaaggatgtttaaaatgccaacagcaggcccagcgtggtggctcatgcctgtaatcctagcactttgggaggccgaggtgggcagatcacaaggtcaagagatgaagaccatcctggccaacatggcgaaaccctatctctactaaaaatacaaaaattagctgggcatggtggcgcgcacctgtagtcccagctagtcaggaggctgaggcgggagaatcgcttgaaccagggaggcagaggttgcagtgagctgagatcgcaccactgcactccagcctggcgacagtgtgactctgtctcaaaataaataaataaataaataaataagtaagtaataaaataaaatgccaacagcaaaagtaacttttaggctattatgcaccaacaaatttatgtgatatcgagaagtgttaaacagttttagttgcattacactttgcataatatacacaaaacactaaacatgttaataaatgtttgatataataagatgacctaagtttaagtgtaattttgactccttttactgtacctgtgttttcccccactaactgactagtcaagtgctgactggtttttaagagatggggtcttgctctgttgcccaggctggcctcaaactcctgggctcaagtgattttcccacctcagcctcccaagtaggtggaactacaggtgtgcatcaccatacccggcttaacgtctgtttttatatttgtagccacatggtacaaagtacagaacaggtgttcttaacctttttctgccatggacccttttggccttctggacccctcctcagaagaatgttttgaaatgtgtaaaatgcacagaaattaacaacatatttcaagagttcgttctcaaataatatgtgcttcttcagtaaatcattaaataaccagatctagagatgggtctaataattaccttaagtttgaagcagtgatggacatatatatttcaaaatatctgtaacaactataatatgatatgaaagtatctttgatctctactggtgacagtcactgctattctaatactaccatgatctgttgcttacaattgtcattgaagaaaatgtggatttttttttttttttttgagacagagtctcgctctgtcgcccaggctggagtgcaatggtgtgatcttggctcactgcaacctctaccttccgggttcaagtgattctcctgcctcagcctccggagtagctgggattacaggcgcccaccaccatgcccggctgatttttgtatttttagtagagacaggatttcaccatgttggtcaggctggtctcaaactcctgacctcaggtgatctgcctgcctcagcctctcaaagtgctgggattacaggcatgagccaccacacccggctggattttttttttttttaaaagacagggtcttgctatgttgcccaggctggtctcaaactcctgggctcaagtgatctgccctccacgggcttccaaagcactgggattacaggcacgagccaccatgcccagctaaaaatctgggttttcagagacattagtgaaaataaagagtgaatgtttttcccatccaaggtcacagacccggctgaattctcaaccaaagttggaggccttggtctagaaagatacataccaaatattaacagcagttttttttttttttggatagtggaatcgccagagtgattctattttgttttatgatatttttgtagagatagggtctcaatatgttgctcaggctggtcttgaactcctgggctcaaaagatcctcccaccttggcctcccaaagtgctgggattacaggcgtgagccatggcatgcctggcctaattttttatctttgtacctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggctgcagtaagctatgatcatgctgttgcactccagtctgggtgatggagtgggatcctgtctctaaaaaaacattaaaaaaaataagtaaaaaatttaaaaactggttaaataaattgtggtacatccataacagactatttaaacccaacccttaaaaggaatgatacggctctgtatgaaccgattctaaataatctacaggatacattaaaataaacaaatgtgcacaatattttatagtatgtgtaaaaacacaacgcccacatacccttgtgtatttatacacacatgtaaaatatatacacaaacctaaacacacaaaaatatgtccaatagagacaaagagtagaatagtagttgccagagggtggggtgggggaaaggggagaagtgggagttagtgtttaataggtatgaaatttcagttttgcaagacgaaaggttgtagagatggatggtagtaatggctgtacaacaatgtgaatgtactcagtgccactgaactgtacagttaagatgattaaaactgtaaattgttatatatatcgatatatattttttgagacggagtctcggtctgtcgcccaggctggagtgcagtgacgcgatctcggctcactgcaagctccgcctcctgggttcacgccattctcctgcctcaggctctcagagtagctgggactacaggcgcccgccaccatgcccggctaattttttgtatttttagtaaagacgaggtttcaccgtgctcgccaggatggtctcgatctcctgacctcgtgatcagcctgcctcggcctcccaaagtgctgggattacaggcgtgagccaccacgcccagcctgttatatatattttataataaaaatttaacacacgggtacacacacgcttttttttttgagatggagtctcattctgttgccaggctggagtgcagcggcgtgatctcagttcactgcaacctctgcctcccaggttcaagcgattctcctgcctcagcctcccgagtagctgggactacaggtgcccgccaccatgcccggctaattttttgtatttttagtagagatggggttttaccatgttggccaagatggtctcgatctcttgacctcatgatccacccacctccacctcccaaagtgctaggattacaggcgtgagccaccgtgcccggccacaatttttttttttttttaaagaaacaggtaatagtggctgcctccagggaaagaaatgaatgtttggggcagggtagcagagatactttacaatataactcttttttttttttttttgagacggagttccgctcttgtcgtccaggctggagtgcaacggcatgatcttggctcactgcaacctctgcctcccaggttcaggcgattctcctgcctcagcttcccaagtagctgggactacaggcacgcaccaccacgcttggctaatttttgtatttttagtggagacggagtttcaccatgttggccaggctagtctcgaattcctgacctcaagtgatcaagctgcctcagcctcccaaactgctgggattacaggcatgagccaccatgcccagccccatataacttttttctattattatttttctgagatggagtctcactctgtcgcccaggctggagtgcaatggcacgatcttggctcactgcaacctctgcctcctgggttcaaacgattcttctgcctcagcctcccgagtagctggattacaggtgcataccaccaagcccagctaatttttgtatttttagtagaaatgatgtttcgtcatgttggctaggctggtctcgaactcctgacctcaggtgatccacccacctcggcctcccaaagtactgggattgcaggcgtgagtcactgtgcccagccccgtataactttttacaccacctttttaattccgtattgtccatctaactattcaaaaaatcatttaaaaaaccccggccttatacaagaagtcttttccttaatcgtgtcatttattctatccctcttcctttaagtaaaaaatattttcaatcaaaatcagaattcgacttcagctttgagggtatttattagattcaaataatgcaatttataaaaattacacttgctaccctaaaaatatattcactaaaagccttttctttttttcttttttctttttttttttttttaaagagacagtgtcttactctaaagaacgaggctgcccaggctagagtacaggagtacagtggtgtgatgatggctcactgtagcctaaaactcctgggctcatgggatcctctcacctcatcctcccgagtagctgggactacaggcatgagccaccatgcctggcccctctatttttatcaggtgttacagaaaagcttcaaaatcatcatggaagaaaattatcatttttaccagtacaaaacttttattgcatcccaaccaagctaagatgaatacagaattgtttcaacagaagttaccattatcataattcaagacaaaaatcagccggcaattacatgagttggaaaacaaactactcttatgtcacagtctaccctaaagctccaacttatgtcagaatttaaaatacacacacatatacacaaccctgtggattcctcctcatttatgtaaaacctacttttgtgatgatctgctattttcttgagtcttctggaatgaacactgtagccccactcccggataaggagaagataccacttccagggcttagcactgcccctggcttgaagcagatactcaaatatttgttgggtgaatgaatgattgtctgctgatagggctgcccatcaagcctcataaagaaaaaattcagaaaaaagcaactttatagagaaaataggaaaaagtttaagagatattttgctcacttgaagaaatcagcatttgttaaaggtgaagactggattgactggttcatcaagtggcttagacacaactgactaagtgggctataccttatcccaccccaaagttaaatacaaaacaggtatttttttttttaatcacaggaaaaacacagggcaacttaactataaaattattatttttattttttatttttgagacagagcctcactctatcgcccaggcaggagtgcagtggcgtgatcttggctcaccgaaacttctgcctcctgggttcaagcgattctcctgcctcagtcaccccagtagttgagattacaggtgcccgccaccacgcctggctaatttttgtatttttagtagagacgggatttcaccatcttggccaggctggtcttgaactcttgacctcaggtgatccacccgcctcagcctcccaaagtgctgggattacaggcatgagccaccgcatctggcccttttgtatgtattaaatacgtatgtatgaatataatacatcatcaggttttttaggaagaaaatatagatgactattgatctgttgttaagagtaggaaaggatttcctggcggggcgcggtggctcacgcctgtaatcccagcactttgggaggcagagacgggcggatcacaaggtcaggagatcgagaccagcctggctaacatggtgaaaccctgtctctactaaaaatacaaaaaaattagccaggcgtggtggcgggcgcctgtagtcccagctactcgggaggctgaggcaggagaatggaatgaacccgggagatggagcttgcagtgagccaagatcacgccattgcactccaacctgggcgacagagcgagactccgtctcaaaaaaaaaaaaaaaaaaaaaaaaaaagagtaaaaaaggatttcctaagtatgaaagcaaaagaataaatcataacataaattttatatatcagaaagacaagaatcaagacgtaagacaaaacaggaaaatatctgcatgacaaagagttaacatctttaatacattaagagctatgacaatgattattgaggtttagcctcagtaataatccaagcggcaccaatttaaaagatgtatatccaattctgggacgatatgggaaaatggcactttctcagactgttgtgggaactgggatagccattttggacagtgatgtggtggtatccaccagaaattccaagtctaggcagccattcttcaaaatgactggcacatgaggaatttcaatcctgtagcatttttaataacatagagagacaacgaaatgcatgacggtaagtcagccctggactacactgctatttaaaagaaatgaggcagagatgaatatatgagatggaaaaatgcagaatatgtatatataacaccatcctgaggccaggcacggtggctcacgcctgtaatcccagcactttgggaggccaaggcaggtggatcgcctgaggtcaggagttcgacaccagcctggccaacatggtgaaacccatctctactaaaaatacaaaaattagctgggtgtggtggcaggcgcctgtaatcccagctactcaggaggctgaggcaggagaatcacttgaacccaggaggtggaggttgcagtgagccaagattgtgccactgtactccagcctggatgacagagcaagactccatctcaaaaaaagaaaaaacaaaacaaaacaaaaaccctcctgttaattacaacacaaaaagtacacagtttagtcttagaagacttagaaggatctacattaagctattaacagcagttattctgggtagtgggagcagagattaagcggggagctttcatttttttacctgatacttttttttttttttttttttgagaccgagtctcactctgtcacccaggcaggagtgcagtggtgtgatcttggctcactgcaacctccgcctcccaggttcaagtgattctcctgcctcagccttccgagtagctgggactacacgctcaagccaccatggccagctaatttttgtatttttaatagagatggggtttcgccgtgttagccaggctggtctcgaactcctgacttcaggtgatccacccgcctaggcctcccaaagcgctgtgattacaggcatgagccaccttgcccagccacctgatcaatttttaagtggtttgatttttctataaatccatgtattattttagtaattctttaaaaagtaaaagaagaaaaatagatatcaagcatttatctactaaagacgggtactgtcctttgagaattccctcaaaagttctttgaagctcaaatggctacatctttcccattcataagatactttttaaatttcctctttctacatttctttttaaaagtttattttcaattagcttcctcaggttgaactctctgtacatttcttaggagaaactgtatggtgtcaacactgcctgttttataacatccattcgtaatctgtaatctgagaaaaagactcgtaaaaacccaaaccaccctccaggcctaacatcttccagaagaaacccattcactgcccatattacatttagtccacacaatttctgagacaaagcacaaagcactagccatacaactcccaccagcataaatacgtggagtacaaagaatgtcctgtcagctgggcccagagcacaccccacagcagtaaaagagaatgacaatttgagtcacaggatcaggagcagaatcaaatttgggacttgaggcagtgtgatgctcttctggtcttccgcttccttccacaccttctattctccttcagccaaaccttgccctcacataatccctaagcaggctatttcttatggatgtctacaacagcttcacactgaggtgtcagaaaccactagagagacaacaaagaacgacttagggtctcagtcggaatcacaatggccgcataagtgaaaactcacatttttgcttaggggaaaaaaaatgggaaaattcaattggaacattctgctttaccacacagaagttctgaaatccacatgtcaaaacatcaaatgcggagtgaccactaatcaaaaagacaaaacaaaacaacaacaacaacaacaacaacaaacagcttgagatgttgagcctgaaggttgagaaattaaggaaccattcatttttacaaaactaaagtccacacaatggtgccaagtagttcaaactgcagctgatacagcacctgagtgtcagacctagaatgactggggcccccaggtttttacaaagtactcatcctcctctagagtcccaagaaccagatgtatatctgggtactctctttagttaccatgggaggagtgtagcaagcacatgacattagccatggcccccggtgttctgagacagctttcaggagggtgtccttctagggaaccaaccacataccagttcccatatctgaaaatgcattaccactgctcactaatgttgaccactaagccatttaccccaaaccaaagcaaacacatgctgaagaccgctaaggcaacagcagcagcgcaaaagggctcagtgcaagcgctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaaattactggcacgtaacacacagtgctaaaataaaggaaagattcatgcttgttagaatcaacactatcacaagccttgtcacctctaggggacacttcgacactacaaaagcataccatgagtggcgatttctggcaagtatttcttctaccacggcacacagaaattctcagggaagaatacatgttcaagagaatacgcaacatcaaaataccatccctgaaagaacacatggaacctagaggcagtctcccttctttttcaagcagctgaatgaagttgcaataagctgctgtaacaacatcacataaaggggctttaatcctgagagaaaaaatcagcaccaagggaaaccaagtgctctgggagacccaaagccatcatccaaaacatgcaagtctatttcagggcaatcagttttaagcctctcagatcagtcaatctcgatgttcaacaaactcagttattagtttgatagtttctctttttcttttgaacacatgttcaaaaaaggacttttgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtctcaaaaaaaaaaaaaaaaaaagaaagaaagaaaagagaaaatgagagcagtttatgaaatctaaaaaagaaagttaatatatatataaaacacccctagctcttgggctaggaagacaagtgcatccttactaaggcttggtcctgtcaacttcagaggcaataatgagagcccagactacagtgtctacagtaactgcaaaacagccacacagcacagcgggaacacattcacacgccaggagacccagcatacatgtgcttgaagaagttataagactcaggctttattctctaacgaaatggtcattccccctttgatgtgggggtgggggtggggatgccctgcccaccccccaattccggctcccactcagttatcccacataccatacataccatcaaagtatttaagcaatggcatgcaaagcaagctttcgacaggtttcttgcaagagaaaggcagaagagaacaggtaaaagcagaagagcacacaggtaaaagcagaagagcacaacttctacttaagcccaaagaagagggacctgttcacatcttgtcctacccggaatgatgcacacgcacaggggcttgccgggacagcagtagtttcactggaaagggctggtatggaggcaccgaggacaaggtccttccatcgcagcggtgataatgctctacccaagaaaaaaagattgcgtctgccagccacgcaagactggtctgcaaggatgtcaccatagcagagggcagggaaaacaagcaggtgtcctgccacactctttgggactggccagtctaggagtgtgctttaccccacgcactgaaaacactggttactagaaatatcaaacatttcctgtgattctctcctccaagataactcgggcagcttgagaacaagctgctcttagctaattaaaagatttctgctgatattaacctttataaaagatttcaggttccaggacacgtcatttatcatgcagagtcccaagcaggtacattagcaatggaaaccaggctccaataaggaactaacaattttatctctgttgttctttattttaggttaaagaaatgaacttctcgtttcatctccacatgggaggaatgttctggagggggtaacagcctattaaactcatctagctttttttttttttttcaaactccacagcttgcctccctaccctactagactagattgcacagaggcagggcaggcacgggaaacgactctggttggaaattacaaacatatacacacagaatgcaagcaccataaccctttgaatacacagtggtttgtgccttgccccagacctacctaaggatttaaacagcacagaagtcggagttcggctgactgcatgacactctcctatcaatcgggtgaaacaaagacccagtactctaagcttaaagcattccaggcaaaattttagttaacaggcaataggaaggtgtgataggccagtgctaacaagaaagccacagatgggtttctttgagctgttaagacactggaaagggctggtatggaagcccagtggagccattaggacaatggaaaaggaggtacccctccaccaggcactttgcagagaaaactatactctggaagctgcctgcactgttgatagggctagacgtatgataaacagctaaccggaggggcacccgaggagacaaactgccaactatgaagaacaaagcagagacctcaacttgtcacgtctcaagctcagatgtacaaactttgggatcgtcaagtgaggctcgtgtgtatgcctggggatatgactgtattccagtgatcagccacctagctgacctgccacgaatgggtgacctgtggtgacttactttaatcaactgtagtacttctagattgattgggtgatttaaggttctgacatattcaggcaagaaaataaaagcaagtgtttcctagacttcctcattgggatttgaaatagaaatcctgaaaagcccataaaagcctatttccctaaatccttggtggaaattcccaaaagattaaaaaatccagaccctgtcttattatagggacccagcagatttcaaaagactcaagaggtcagcttaatctggttattaactgaaattgctgagatactgatgaacattccagccatggaacccaaaattctctagagtaataattacctattagtgcaatgttactactgaggccgtatatgcttcatttttacagtataacaaaatgtctaaaacttatgagagtcctacaacgtctaggccactcagtatcacatccaagtaggtatggttcctggatcaccaaccaacccctgaattcgatcctgttatctcacagtctggggtactgatcccgcacagcagagacacaacgtgtgaaaggctcggcagagcccattcctgttcctggaaaaataaccagaagcacacatctgcctgaccatgagtcaggaatatcaattttgtggtggagcccatttctgctgtgaccaacccacacccgaacacactcgcaacagaagcaaccgccacagagcaattccagaatgagctttttccccctcggggtccatacttagcaatgtcataaacggtctcccctgcgacagcaatccttttacactcttcataatgaccttaagtctttagtgcaaaaccacagaaacattgccactgccatataaaagtcatctgagtttcagtttgggtgattcggtcatgaccaaactgaacagaggataacctttcaggcacaattaacaggagccacagcgtcgcgatgaacttgccccatctggtaccggtgatcccgagcgctccagggcgatgagagcccgttacctactatgtcccactccacttatgtaactggaagatcgccggcgaaggggagggtaggatgggagggtgctcacattccgaggccacagcactccaaagaacctctgagcaccctggggacacgctcgcaccttagagcctctggcgccgaagagcctcgggtgctgctggacgcacagtcccctacccacggctcctgatgggaactataaccacctctttatgatgagttgtgggacccagaacacaatgtctagtcccttttgtggataataatccccacctacttgttcctgctagatggggaaaggagccggtggacctactcgctcgcgggggggtagcggggggcagaaattcatggaatgggcgagaaggagggggaggcaaagcccagagatgggggtgagagctcaggagcccttgtggcgcactctcccgacgggaggcgaagtgcgcacgcgcgccggtgggggggccgagtaacgggagagggggcgcgcgagggagggagggggagagcgcgatccagggagaggccggggccgcgggcgcgcgacggcgccgcggcccaaagccccgagaagggcaggagcgcgcgcagccccgacaggcgaaccccggcgacaggggcgcccgcggggccgggggccgggatgcgcgtcgagggcgggaggaagaggggcgtcaggcgaaggcggctccagggaggccgcgccgaggacggtcacccgcgagcacgggtgacgggccgaggggagagtcgccaccggcggcggcgggagggggagggtagagaggagggacgccatccgccagccgtgtcgtccgaccccgcgggcccctcccgcgccacgtcccgcccctgacccccgccccccggcaagggtccccgcccgcggccacggcggtcccactcacagtctctcctcctcgcctcctcctcctcctccgctcggcgcggcggcggcggcggcggccattttccggacggcttttaccacagccctctctccgagaggagggagcgcgcgcgccgccgacgccgg
